United States Patent 9,572,897 (MODIFIED POLYNUCLEOTIDES FOR THE PRODUCTION OF CYTOPLASMIC AND CYTOSKELETAL PROTEINS) - sequence listing, part 16

SEQ ID NO: 29689 - DNA, 1461 bp, Artificial Sequence
  Description of Artificial Sequence: Synthetic coding sequence
atgtctgtaacgtacgacgactcagtgggcgtggaagtgagttccgattccttttgggaggtcgggaattataaacggaccgtcaaacgcatagatgatgggcatcgactgtgttccgacttgatgaactgtctgcatgagagggcccgtatcgagaaagcttatgcccagcagcttaccgagtgggctcggcgatggcgacagcttgtggaaaaaggacctcagtacggcactgttgagaaggcgtggatggccttcatgagcgaggcagagcgagtgagtgagctccatctcgaagtcaaggccagcctgatgaatgacgatttcgagaagataaaaaactggcagaaggaggcgtttcacaagcagatgatggggggattcaaggagactaaagaagccgaggacggattccggaaagcccaaaaaccttgggctaagaaacttaaagaagtggaagccgcaaaaaaagctcaccacgcagcatgcaaagaagagaaactggctatcagtcgagaagccaactcaaaagcggacccatcccttaacccggagcagttgaagaagctgcaggacaaaattgagaaatgtaagcaagacgttctcaaaaccaaagaaaagtatgaaaagtcactgaaagaactcgatcaggggacaccacagtatatggagaacatggagcaggtatttgaacagtgccaacagtttgaagagaaacgcctgcgcttcttccgagaggtactgctcgaagttcagaaacacctggatctatcaaacgtggcagggtacaaggccatctaccatgatttagagcagagtattcgggcagccgacgcagtagaagacctaagatggtttagggccaaccatggcccaggcatggccatgaactggcctcaatttgaggaatggagtgccgacttgaacaggaccttatcccggagggagaagaagaaagcgacagatggcgtgacgctgacagggatcaatcagaccggagatcagagccttccttctaaaccatcgtctacgctgaatgtaccttcaaaccctgcacagtcggcacaatcccaatcatcctacaacccatttgaggatgaggatgatactggctccacagtcagcgagaaagatgacacaaaagcaaaaaacgtgagttcctatgaaaagacccagtcatatccaaccgactggtccgacgatgagagcaacaatcctttctcaagcaccgacgccaacggagacagtaacccgttcgatgatgacgccacaagtggcactgaggtgagagttcgggctctttatgactatgagggccaggagcacgacgaactgagctttaaggccggagacgagcttactaaaatggaagatgaggacgaacagggctggtgtaagggaaggctggataacggccaggtgggattataccctgctaactatgttgaagccatccagtag

SEQ ID NO: 29690 - DNA, 3075 bp, Artificial Sequence
  Description of Artificial Sequence: Synthetic coding sequence
atgaatttcattaaagataactctcgggcactgatacagcgaatggggatgacggtaataaaacagatcacagatgatttgtttgtgtggaacgttctgaatagagaggaggttaacattatttgctgtgaaaaagtcgagcaggacgcggctaggggtatcattcatatgattttgaagaaggggtctgagtcatgtaacctcttcctgaaatcactgaaagagtggaactacccactctttcaagaccttaacggccagtctctcttccaccagactagcgagggcgacctcgatgatcttgcacaggacctcaaggatctgtatcacaccccgagcttcctcaacttctacccacttggcgaggacatcgacattattttcaatctcaaatctacattcacggagccagtgctgtggcgtaaagatcagcatcatcaccgagtggaacagctcaccttgaatggactcctgcaggccctgcaaagcccatgcataattgagggggagtcggggaagggcaagtccaccctgcttcagaggattgccatgttgtggggctctgggaaatgcaaagccctcacaaaattcaaattcgtgttcttcctgagactctcacgagcccaggggggacttttcgaaacactttgtgatcagctcctggatatcccagggacaatcaggaagcaaactttcatggctatgttattgaagctgcgccagagggtcctgtttctgctggacggctacaacgaattcaaaccacagaattgtcctgaaatagaagctcttatcaaggagaatcatcgcttcaagaacatggtcatcgtgaccactaccacagagtgtctgaggcatatcagacagttcggggcactcactgccgaagtgggagacatgactgaggacagcgcccaggcgctgattagagaggtgttgattaaggagctggccgaaggcctgctgctgcaaatccagaaatcaagatgcttgcgtaacctcatgaaaacccctctgttcgtggtgataacatgcgccatccaaatgggcgaaagtgagttccactcacatacccaaacaaccttgttccacacattctacgatctgctcatacagaaaaacaaacacaaacacaaaggtgtggcagcctccgacttcataaggtctctcgaccactgtggagatctggcactggagggagtgtttagccacaagttcgactttgaattgcaggacgtgtcatctgtaaatgaggacgtgctgttgactactggcctcttgtgcaaatatacagctcagagatttaagcctaagtacaaattctttcataagagcttccaggaatataccgctggcaggcggctctccagcctcctgacctcgcacgaacccgaggaggtgaccaagggcaacggttatttacagaagatggtgtctatcagcgatatcacttcgacttattcctccctcttgaggtacacatgtggaagctcagtcgaggccacgcgcgctgtgatgaagcacttagctgcagtgtaccagcacggttgtcttctaggcctctcaatcgccaaaagaccactttggcggcaggagagcttacaatcagtcaaaaacacgactgagcaagaaatcctcaaggccattaatatcaattccttcgtggagtgtgggattcatctctatcaggagagtacctccaagagcgcattgtcccaggaatttgaagcctttttccagggaaagtcactgtatatcaattccggtaacatccctgactatctgttcgacttctttgaacacttaccgaactgcgcttccgctctcgactttattaaattagatttttacggtggagccatggcctcatgggagaaagctgcggaagatacggggggaattcatatggaggaagcacctgagacttacattccctcccgcgctgtctctctgtttttcaattggaaacaggaattccggacccttgaagtgacgctgcgcgacttctcaaaacttaataagcaagacatccgatacctgggaaaaattttttcctcagcaacgagcctcagacttcagattaagcgatgtgccggagtggcaggctctctgtcgttagtgctgagcacctgcaagaacatttactcccttatggtcgaagcctcccccctgacaatcgaagatgaacggcacatcacaagtgtcacaaaccttaagacgctttccatccacgatctgcagaatcaacgcctgcctggagggctgactgactcactggggaatctaaaaaacctaactaaactgattatggacaacataaaaatgaacgaagaagatgcaatcaagctcgcggagggtttaaaaaatttaaaaaaaatgtgtctatttcacctcacacacctgagcgatataggagagggcatggattatatagtgaaatccctgtcctccgaaccttgcgacctcgaggagatccagctggtctcatgttgtctgagtgctaatgctgtgaaaatcctggcacagaatctgcacaatctggtcaagctgagtatcctggacctaagcgagaactaccttgagaaagacgggaacgaggctctacacgaactcattgataggatgaacgtactggagcagcttacagccttgatgctgccatggggctgcgacgtgcaaggctccctgtcatctctgttaaaacacctggaagaagtacctcagttggtaaagttgggactcaagaattggcggctgacggataccgaaatccgcattctgggcgctttcttcggcaaaaaccctctcaaaaactttcagcaactcaatctggccggaaatagagtgagcagcgacggttggctagcattcatgggcgtcttcgagaatctgaagcagttggtgttttttgatttcagcacaaaggaatttctacccgacccagcactggtgaggaagctttcccaggtactgtctaaactgacttttttgcaggaggcccgtctggtcggatggcaatttgacgacgatgatctgtcagtcattacaggagccttcaagctcgttactgcttag

SEQ ID NO: 29691 - DNA, 1767 bp, Artificial Sequence
  Description of Artificial Sequence: Synthetic coding sequence
atgagcagttgtgtatcctcacaaccaagctcaaatagagcggctcctcaggatgaactcggcggaaggggatcgtcctcaagcgaatcgcagaagccctgtgaggcgctgcgcggtttgagtagcctgtctattcatctgggcatggaatcatttatagtagtgactgaatgtgagcccggttgtgccgtggacctgggactggcaagagatagacctctggaagccgacggccaagaggtccctttagacacctcgggatcacaggctcggcctcacctgagtgggcgaaagctttcactccaggagcgttcgcaggggggtctcgccgctggaggaagcctggatatgaacggacggtgtatctgtccttcccttccatatagtccagtgtctagtccccagtccagcccaagactgcctcggcgtcctacagtggagagccaccatgtgtccattaccggtatgcaggactgcgtgcagcttaatcaatacacactgaaagacgagatcggcaaagggtcctacggggtggttaagctggcttataatgagaatgataatacttactacgcgatgaaagtgctttcaaaaaagaagcttataaggcaggctggtttccctcggcgaccccctccacgcggtactcggcctgccccaggaggttgtatacagcccaggggccctatcgaacaggtatatcaggagatcgcaatccttaagaaattagatcacccaaatgtcgtgaagcttgtggaagttttggatgaccctaacgaggaccatctctatatggtatttgagctcgtgaaccaaggcccagtaatggaggtcccaaccctcaagccgctcagtgaggatcaggccagattctattttcaggacttgattaagggtatcgagtacctgcactatcagaaaatcatacacagagatattaagcctagcaacctcttagttggagaggacggtcatataaaaattgcggattttggagtttctaatgaattcaaaggatctgacgccttactatcaaacaccgttggcacacccgcattcatggcaccggagtccctaagcgagacaaggaagatcttttccggaaaagccctggatgtgtgggctatgggagtgacactctactgcttcgtgttcggccagtgcccttttatggatgagaggatcatgtgccttcacagcaagatcaaatctcaggcactggagtttcctgatcagccagatatcgctgaggacctgaaggatctaatcaccaggatgttggataagaaccctgagagcagaatcgttgttcctgagattaaactccacccatgggtaacccgccacggggcagagccactgcccagcgaggacgagaattgtactctggtggaggtaactgaagaagaggtggagaattccgttaaacacatcccctccctggccaccgtgattttggtgaagaccatgatcaggaagaggtccttcggaaatccattcgaagggtctagaagagaggaacgaagcctgtctgctcctggtaatctcttgactaaaaagcccaccagggagtgcgagagcctgagtgagctgaaagaagccagacaacgcaggcagcccccaggacacaggcccgctccaagggggggtggcggatccgctcttgtacgcggatcgccttgtgtggaatcttgttgggccccagcccctggctctccagctagaatgcacccgctgaggccagaagaggccatggagcccgaatag

SEQ ID NO: 29692 - DNA, 666 bp, Artificial Sequence
  Description of Artificial Sequence: Synthetic coding sequence
atgctgaaaaacaaggggcactccagtaaaaaagataacctggctgtgaacgccgttgccctacaggatcacatactccacgaccttcagctcagaaatctctcagtggccgaccatagcaaaacccaggtgcaaaaaaaagaaaacaagtccttgaaacgcgacacaaaggccattatagataccggtttaaaaaagaccacgcagtgcccgaaacttgaagactcagagaaagagtatgtgttggatccaaagccacctccactgacactcgcccagaagctcggccttatcggtcctccccctcccccattgtctagtgacgagtgggaaaaagttaagcaacgatctctcctgcagggcgactccgtgcagccgtgcccaatatgtaaggaggagtttgaactgaggccacaggtcctactgtcttgtagccacgtgtttcacaaggcttgtctgcaagcttttgagaagtttaccaataaaaagacctgccccttgtgccggaaaaaccagtaccagacacgcgtgatccacgacggcgcacgactcttccggatcaagtgcgtgacccgaatacaggcatactggcgaggatgtgtggtccgaaagtggtacagaaatctgcgcaagactgttccaccaaccgacgccaaactgcgatag

SEQ ID NO: 29693 - DNA, 900 bp, Artificial Sequence
  Description of Artificial Sequence: Synthetic coding sequence
atggtggataagaaactcgtggttgtcttcgggggtaccggcgctcagggcggatccgtcgctagaaccttgctggaagacggaactttcaaagtgagggttgtgaccagaaatcctaggaagaaagccgctaaggaattacggctgcaaggagcagaggtcgtccagggggaccaggatgaccaggtgatcatggagctggcacttaacggagcctatgcgacattcatcgtaaccaattactgggaaagctgtagtcaagagcaggaggtcaaacaaggaaaactcctggctgatttagctcgcaggctgggactacactacgtggtatatagcggactggagaacatcaagaagttaacggccggtagactggctgctgctcacttcgatggtaagggagaggtagaggaatattttcgtgacataggcgtgccaatgacaagcgttaggcttccatgctacttcgaaaatctactttcccatttcctcccccagaaggctcccgacggcaagtcctacctcctatcgctcccgactggcgatgtgccaatggacggaatgagcgtcagtgacttgggccctgttgtgctctctttgttaaagatgccagagaaatacgtggggcagaacattggtctttctacatgccgccataccgcagaggaatacgccgcactccttacgaagcatacacggaaggtggtgcatgacgccaagatgacacctgaagactacgagaaactgggctttcctggtgccagggacctcgcaaacatgtttcggttttacgccctgcgacctgacagagacatcgaacttacactaaggcttaatccaaaggcgttgaccctcgaccaatggttggaacaacacaaaggcgacttcaacctactgtag

SEQ ID NO: 29694 - DNA, 2193 bp, Artificial Sequence
  Description of Artificial Sequence: Synthetic coding sequence
atggaggatctattcgagactttccaggacgaaatgggatttagcaacatggaggatgacggcccagaagaggaggagagggtcgccgagcctcaggcaaattttaatacacctcaggccctgcgctttgaggagctgctggcaaatctgctgaacgaacagcatcaaattgccaaagagctgttcgagcagctgaagatgaagaaaccctctgccaagcaacagaaagaagtcgaaaaggtgaagccccaatgcaaggaggtgcatcagactctcattctcgatcccgcacagaggaagagactacagcaacaaatgcaacagcacgttcagctcctgacgcaaatccacctgctcgctacgtgcaaccctaatctcaatcctgaggcgagctccactaggatctgtttaaaagaactggggacttttgctcagtcatctattgccttgcaccatcagtacaaccctaagtttcagacactgtttcagccctgcaatctgatgggggcaatgcaactcatagaggacttctccacacacgttagtatcgactgttcgccccataagacagtgaagaagaccgctaacgagttcccttgcctgccaaagcaagtggcatggatcttggccacttccaaggtctttatgtatcctgagcttcttccagtgtgtagcctgaaggccaaaaacccccaggacaaaatcctgtttacgaaggccgaggacaacaaatacctgttgacctgcaaaaccgcacggcagctgaccgtcagaataaagaacctcaacatgaaccgggcacctgacaacatcattaagttctacaagaagacgaagcagctgcccgtgttaggcaaatgctgcgaagaaatccagcctcatcagtggaaacctcccatagaacgagaagaacatagactgccattttggctgaaggcttcccttcccagcatccaagaagagctgcggcacatggcagatggtgccagggaggtgggtaacatgactggtaccaccgaaatcaattctgatcagggcttggaaaaggacaactctgaattaggctccgagacacgatatccgttactgctccccaaaggggtcgtgttaaagctgaaacccgtggccgaccggttccctaagaaggcctggaggcaaaagcgcagttctgtcctgaagcctttactgattcagccctccccctccctccagccctccttcaatcctggaaaaactcccgctcagagcacccactccgaggcacctcctagcaaaatggtactccggattccacaccctatacagccggctacagttctgcagactgtacccggagttcctccattgggggtttctggcggagagagcttcgaaagcccggctgccctcccagcaatgcccccagaggcgcgaaccagctttccactgtcagagagccaaacgcttctctcatctgcacccgtgcccaaggtcatgatgccctctcccgcatcttcaatgtttcggaagccttacgtgaggagacgtccctcaaagaggcgaggagcacgcgctttcaggtgcattaaacctgcccctgtcatccatcccgcatccgtcatcttcacagtaccggcaactaccgtgaagatcgttagcttgggcggaggatgcaacatgatacagcccgtcaatgcggctgttgctcagtcacctcagactattcccattgctacattgctagtgaatccaacgtctttcccctgccctctgaatcagccactggtcgcgtctagtgtttctcccctcatcgttagtggaaattcagtgaacctgccaatcccctcgacccccgaggataaggctcacatgaatgtcgatattgcctgtgccgtcgcagatggggaaaacgcctttcagggactcgagcctaaactcgaaccacaggagctctcacccctgtcggcaactgtgttcccaaaagtggaacacagccccggaccaccgcctgtcgataaacagtgccaggaggggttgagcgaaaactctgcttacaggtggaccgtcgtgaagaccgaagaggggcgtcaggccctggaaccactgccacagggaatccaggagtcattgaataattcttcgccaggcgatttagaggaagttgtgaagatggagcctgaggacgccactgaggagatatccggcttcctatag

SEQ ID NO: 29695 - DNA, 1563 bp, Artificial Sequence
  Description of Artificial Sequence: Synthetic coding sequence
atgtttgtgagcgattttagaaaagagttttatgaggtggtccaatcccagcgcgtactattgtttgtggccagcgacgtggatgcgctatgcgcttgcaaaatcttgcaggcattatttcagtgcgaccacgtgcagtacaccctggtccccgtgtcggggtggcaggagctagagacagcctttcttgaacacaaggaacaaattaagctgctgataaagcaggacgatgacctggaggttcccgcatatgaggacatttttcgtgacgaagaggaggacgaggaacatagcggcaacgatagtgacgggagtgaaccgtctgaaaagcgcactagactggaggaagaaatcgttgaacagaccatgaggagacggcagcgtcgggagtgggaggcccgacggagggacattttgttcgactatgaacagtacgaatatcacgggacatcctccgctatggttatgtttgagctcgcctggatgcttagcaaagatctcaatgatatgttgtggtgggctatcgttggtcttactgaccagtgggtccaggataagattacacagatgaagtacgtcaccgatgttggggtcttacaacgccatgtcagtcgacacaaccacaggaatgaagacgaggagaacacactgtcagtagactgtacgcgaatatcgttcgagtatgacttgcgccttgtgctgtatcagcattggtctctccatgacagcctgtgcaacacctcctataccgccgcacggttcaaattgtggagcgttcatgggcagaaaagactgcaggagtttctggccgacatgggacttcccctaaaacaggtgaaacagaagttccaagcgatggacatctctctcaaagagaatctccgtgaaatgattgaagagtccgccaacaagttcggtatgaaggacatgcgggtgcagaccttcagtatacactttgggtttaaacacaagttcctggcatctgacgtggttttcgctactatgtcactgatggaatctccagagaaggatgggtccggaacagatcatttcatacaggccctggattccctgagtcgctctaacctcgataagttgtaccacggtctggagctcgccaaaaaacagctccgcgctactcagcaaaccatcgcttcttgtctgtgcaccaacctggttattagccagggacccttcctgtactgttccctgatggagggcacaccagacgttatgctgttctccaggccagcatccctcagtctgttgagtaagcatctcctgaagtcattcgtatgctcaaccaaaaatcgtaggtgtaaattactccctttagtgatggccgctcctctgtcgatggagcacgggaccgtgaccgtggtgggcattcccccagaaacggatagttccgatcgcaaaaacttcttcggcagagctttcgagaaagcagcggaaagcacgtcgagccgcatgctgcataaccatttcgacctctccgtaatagagctgaaggccgaggatagaagcaagtttctggatgcactgataagccttttgagctag

SEQ ID NO: 29696 - DNA, 567 bp, Artificial Sequence
  Description of Artificial Sequence: Synthetic coding sequence
atgacggcgccatcttgcgctttccccgtacagtttcgtcagccttctgtgtctggcctttcccagattacaaagagtctctatatttctaatggggtggcggctaacaacaagttgatgctctcaagcaaccaaattaccatggtgatcaatgtcagcgtcgaggtcgtaaacacactctatgaggatattcagtatatgcaagtccctgtggctgacagtcccaacagcagattatgcgactttttcgatcctatcgcggaccacatccatagcgtggaaatgaaacagggacggacactgctccattgcgccgcaggggtttcccgatctgccgctctgtgccttgcatatctgatgaaatatcatgcaatgagcttgttggatgcccatacctggactaaatcgtgcaggccaattatcaggcccaactccggattttgggagcagctgattcactatgaatttcagttatttggtaaaaacaccgttcacatggtgagctcacccgttggcatgatccctgacatttatgagaaagaagtccgcctgatgataccactgtag

SEQ ID NO: 29697 - DNA, 1182 bp, Artificial Sequence
  Description of Artificial Sequence: Synthetic coding sequence
atggacgcagccacgttaacatatgacacactgagattcgctgaattcgaagacttccctgagaccagcgaacctgtctggattctcgggcgaaaatattcaatcttcactgagaaggatgagatcctctctgacgttgcttccaggttatggttcacctaccggaagaatttccctgctatagggggtacgggcccaacctctgataccggatggggctgcatgctgcgctgtggtcagatgatttttgcacaggccctcgtctgtcgacatctaggtagagactggagatggacgcaaagaaagcggcaacccgattcatatttctccgtgctcaacgccttcattgatcgcaaggacagctactactcaattcaccaaatagctcaaatgggggtaggggaagggaaatcaattggtcagtggtatgggccaaacactgtggcccaagtcctcaaaaaattagccgtattcgacacgtggagctctctggctgttcacattgcgatggataatactgtggtgatggaggagatcagacgcttgtgcagaaccagcgtcccgtgtgcgggtgcaaccgccttccccgctgattcagacaggcactgtaatgggtttccggctggcgctgaggtcactaatcgtccatctccttggcgtcccctggttttgcttatcccactgaggctcgggcttactgacattaacgaggcctatgttgagacactgaagcactgttttatgatgccacagtccctgggggttatcggcggaaagccaaatagcgcccattattttatagggtatgtcggagaggagttaatctatctggacccacataccacccaaccagcggtcgaacccactgacggttgttttatcccggatgagagttttcactgccagcacccaccttgtcgaatgtcaattgcagagctggatccctcaatcgctgtggggtttttttgtaagaccgaggacgactttaacgactggtgccagcaagtgaagaagttatcgcttcttgggggagcactgcccatgtttgaactcgttgagttacagccatctcatttggcctgccccgatgtcctgaatctgtccctggacagttcagacgtggagcgccttgagcggttcttcgattcagaggatgaggacttcgagatcttgagtttatag

SEQ ID NO: 29698 - DNA, 780 bp, Artificial Sequence
  Description of Artificial Sequence: Synthetic coding sequence
atgaaggatgttgacaacctcaagtctattaaggaagagtgggtgtgtgaaacgggatctgacaaccagccacttggaaacaatcagcagtcaaattgcgagtattttgtagatagtttatttgaggaggctcagaaggtgtcttccaaatgcgtatcgcccgctgaacagaagaagcaagtggacgtcaacatcaagctgtggaagaatgggttcactgtgaacgatgacttccggagttatagtgacggtgccagccagcagttcctaaattccatcaaaaagggtgagcttccctccgaactgcaagggatctttgacaaggaagaggttgatgtgaaagtcgaagacaagaagaatgagatctgcctgtctacgaagcctgtcttccagccgtttagcggccaaggccaccggcttggctccgcaactcctaaaatagtttcaaaggccaagaatattgaggtggagaacaagaataatttatccgctgtgcccctaaacaatctggagccaattaccaatattcagatttggctggcaaatggcaagcgtatcgtccaaaagttcaacataacacacagagtttctcacatcaaagactttatcgagaaataccagggctctcagcgctcacctccgttcagtctcgccactgccctcccagtcctacgcctactggatgagacgctgaccctggaagaagccgatcttcagaatgccgtcatcatccagagactgcagaagaccgccagcttcagggaactgtcagagcactag

SEQ ID NO: 29699 - DNA, 852 bp, Artificial Sequence
  Description of Artificial Sequence: Synthetic coding sequence
atgatacctccccaggaagcgtccgctagacggagagaaattgaagacaaactcaagcaggaggaagagaccctgtcttttatccgcgactccctcgaaaaatcagatcaattaaccaaaaacatggtaagcattctgtcctcatttgaatctcggctgatgaagcttgagaattcaattatccccgtccataaacagacagagaacctgcaaagactgcaagagaacgtagagaagactttgtcatgcctggatcatgtcatctcttactatcacgtagcctccgacacagaaaagatcatccgggaaggtccaacgggcagactcgaagaatatctgggctccatggctaaaatacagaaggcagtggagtatttccaggacaactccccagattctcctgaacttaacaaggttaagctcctcttcgagagaggtaaggaggcattggagtcagagtttaggtcactgatgacacggcactccaaagtggtatctcctgtacttatcctcgacttgattagtggcgacgatgatctcgaagctcaggaagatgtgacactagaacaccttccagagtccgtcctgcaggacgtgatccggatctcacgatggctcgtcgagtatggtcgcaaccaagactttatgaacgtctattatcagatccgatcctctcagttggatcgaagtatcaagggactcaaggaacattttcacaaaagctctagcagttcaggcgttccatacagccctgcaatacccaataagagaaaagatacacctaccaagaagccagtcaagcgcccaggggaaccgccatcctggccaatctccgccacagccaggggatag

SEQ ID NO: 29700 - DNA, 2121 bp, Artificial Sequence
  Description of Artificial Sequence: Synthetic coding sequence
atgaacgaggctatggctacagactcccctcggcgtccatcgagatgtacgggcggtgttgtcgtgagaccccaggctgtgacagagcagagctatatggaaagcgtcgtaaccttcctccaggatgtggttccccaggcctacagtggtacccctctgactgaagagaaggagaaaatcgtctgggttcgcttcgagaacgcagacttgaacgacactagccgcaatctggaattccatgaaattcattctacaggcaacgaacctcctttactgatcatgatcggctattcagacggcatgcaggtgtggagtatcccaatttccggtgaagcgcaagagctgttttccgtgcgtcatggacccattcgggcagctcgtattctgcctgcccctcagttcggcgcacagaagtgcgataatttcgccgagaaaaggcctcttcttggagtgtgcaagtccattggcagctcaggcacaagtccgccatattgctgtgttgatctctattctctgaggaccggggagatggtcaaatcaatccaattcaagacccccatttatgacctgcactgtaataagcggattctcgttgtggtcctgcaagaaaaaatcgcagccttcgattcatgcacatttactaaaaaattttttgtgacgagctgctatccttgcccagggccaaatatgaatcctatagctcttgggtccagatggctggcctacgcagaaaacaaactgatccggtgccaccaaagtcggggtggagcctgtggtgataacatccagagctataccgctacagtgatttccgccgctaagacactgaagagcggactaaccatggtcggcaaggtggtgacacaactgactggtacccttccatccggggtgacagaagacgacgtcgccatccactccaatagcagacgttcccctcttgttcctggtatcattactgttatcgacaccgagaccgtcggagagggccaggtgcttgttagcgaggactccgattcagacggcatcgtggcacactttccagcacacgagaaacccgtgtgttgtatggccttcaatacatccgggatgctacttgttaccaccgataccctgggccatgatttccatgtgtttcagattttgacacatccatggtccagctcccagtgtgctgtccaccacctctacaccttgcacaggggagagaccgaagctaaagttcaggacatctgctttagtcatgactgccgatgggtggtggtctccacactgcgagggacttcacacgtatttcctatcaatccctatggtggacagccgtgcgtgcggactcacatgagccccagagtggttaacaggatgtcacggttccaaaaatccgccggactagaggagatcgaacaggagcttacttctaaacaggggggtagatgctcccccgtcccaggactgagttccagccccagcggtagccccctgcacggtaagctgaattctcaagactcatacaacaacttcacaaacaacaacccgggaaacccacggctctctccgctgccgagcctaatggtagtcatgcctcttgcacagatcaaacaaccaatgactttgggaaccatcaccaagcggactggaccctatctgtttggcgctggctgcttctctattaaagctccttggtcgtatatcatgacaaagtatatattttatattaagccaccgaataaggttaagccccctccccaaatttctcccagcaagagcatgggaggagagttctgtgtggcagccatctttggcactagccggtcctggttcgccaacaacgccggactaaagcgggaaaaggatcaaagcaaacaggtcgtggttgaaagcctgtacattatctcgtgctacgggactctcgtggagcatatgatggagcctcgccctctttccaccgcaccgaaaattagcgatgatactccacttgaaatgatgacaagccccagggccagctggacactggttagaaccccgcagtggaacgagttgcaaccgccatttaatgctaatcaccctctccttcttgcagctgatgccgtgcaatattaccagtttttgctggcaggctag

SEQ ID NO: 29701 - DNA, 1815 bp, Artificial Sequence
  Description of Artificial Sequence: Synthetic coding sequence
atggggggttgcttctcaaaacctaaaccaggggcagcactgcctactgtcgagctcaaaatcgaagtggtcctccctgagaaagagaggggcaaagaagaactgagcgcttccggtaaggggagcccaagggcttaccagggaaatgggactgccagacacttccatactgaggaaaggctctccacgcctcacccataccccagtcctcaggactgcgttgaggctgcggtttgtcacgtgaaggacctcgaaaacggccaaatgagagaagttgagctgggatgggggaaagtgctgctggtgaaggacaacggggaatttcatgccttggggcacaagtgtccccactatggcgctccgctcgtgaagggtgtgctgagccggggacgtgtgcgatgtccttggcacggggcatgcttcaacatttctactggtgacctggaagacttccctggattagacagcttgcacaaattccaggtgaaaattgagaaagaaaaagtttacgtgcgggcaagcaaacaagctcttcagctgcaacggcgtactaaggtgatggctaaatgcatatcccctagcgccggttatagctcttccacgaatgtcttgattgtgggcgctggagctgccggtctggtgtgcgctgagaccctgcgccaagagggcttctcagaccggatcgtgttatgcaccctagataggcatctgccgtacgaccgacccaagctctcaaaaagtctcgacactcagcccgaacagcttgcactgcgcccaaaagagtttttccgcgcttacggcatagaggtcctgacggaggcccaggtcgttactgtcgatgtgagaaccaaaaaagtggtatttaaggatggcttcaaactggaatacagtaagctccttcttgcacccggtagctcacctaagactctctcgtgcaaagggaaagaggtcgagaacgtgttcactattcgcaccccagaagacgcaaatcgggttgtgcggctagccagagggcgaaacgttgtcgtcgttggggctggatttctgggaatggaagtggccgcatacttgacagaaaaggcacattctgtttcggttgttgaactggaggagaccccttttcgacgcttcctgggagaacgggtgggccgagccctcatgaaaatgtttgaaaataacagggtgaagttttacatgcagactgaggtgagtgaactgcgcggtcaggagggaaagctgaaagaggtggtgctgaaatccagcaaggtcgtgcgcgcagacgtgtgcgttgttggaatcggtgcagtgccggctactggatttctgcgacagtccggaattggcctcgactctaggggcttcattccggtgaacaaaatgatgcaaacgaacgtcccaggagtgtttgctgccggagacgccgtgacattcccgctcgcctggagaaacaaccgtaaagtaaacataccgcactggcagatggcacatgcccaaggaagggtagcagctcagaacatgctggcacaggaagctgagatgtctacggtgccatacctttggacagcgatgtttgggaagagcctaaggtacgccggatacggtgaaggattcgatgatgtaatcattcagggggatttagaagaacttaagtttgtggccttctacacaaagggcgacgaggttatcgccgtcgcatccatgaactacgatcctatcgtgagcaaggtggcagaggttcttgctagtggcagagctatcaggaagcgtgaagtggagaccggagacatgtcgtggcttactggcaagggtagttag

SEQ ID NO: 29702 - DNA, 744 bp, Artificial Sequence
  Description of Artificial Sequence: Synthetic coding sequence
atgagcacagccgctgttcccgaactaaaacagatctcacgcgtagaggctatgagactcggacccggatggtcccattcatgtcacgcaatgttatatgccgctaatccaggccaactgttcgggaggattccaatgcgattttcggttctgatgcaaatgaggtttgatggcctcttaggatttcctggaggcttcgtcgatagaagattttggtctttggaagacgggttgaatagggtgctggggctgggcctgggatgcctgcggcttactgaggccgactacctctcatctcacctgactgaaggcccacaccgtgtggtcgcccatctgtacgccagacagcttactcttgaacagctccatgctgtagaaatttcagccgttcactccagagatcacggcctcgaggtaggcccaccgccaggacctcgaccccctccccgaggactggccctcgcgccttggaaggctcctatgggtaatacttcccccgaggggccactcgctggcctcggcagagtttctctgagcccagctatgggatggggtgagggctctggcgcaggaagacctggaaaggagggaagaggttggggccctgcactgggactgccacaaggctgcgtaactagcgctttgttacccgctatcgctaatcccggtagcggcggagtgggatccgtgggcagaaaaggctgggggagaagtggagactgtctgggcagctgggaaacatag

SEQ ID NO: 29703 - DNA, 1338 bp, Artificial Sequence
  Description of Artificial Sequence: Synthetic coding sequence
atgtacccgaatcctctgatttactgtacttgctgggatccatggaatctgggccctcgcaaactgatcaagactccgcagttgccacgaaaaaacagtactgggtcttccaagttgactccgcttgttccagctcccaagaaccataattatctgcagccaaccaaacctgttgtgtcacctaagatgaaaatccattctgcccgtcaggaggagactaacaaatctttttatgaggtcatcaacgtgagccctggatatcagctggtaagaaaccgagaacaaattagcgttacactgggagatgagatgttcgaccgcaaaaaacgttgggaaagcgaaatccctgacaagggccgatttagtcggaccaacattatctctgacctcgaggagcagattagcgaactcaccgctatcatcgaacagatgaatagagaccaccaaagtgcccagaaacttttgtcctcggaaatggacctgcgatgtgcagagatgaagcagaactttgagaataaaaaccgtgagctcaaggaggcacacgaggcagagctgtcggaactcgagaataattataaagcagctcttaaggccgaaaaactggccgctcaggaaaagctcgaggagatggggaaggaatacaaatatctcaagaacatgttccgtacctatcaagacagcatttacgatgaaatggaagagaagtggagcaaacagaaggcaaagtggaagaaagatgagaaatttgagcgggagaacatattgcttcagcagaagaaaaagatgacaaaaaagtttgagatggagtcaggggaggaagataagaaaatcaacgaatcttgctctgctgtatttgagaacttcatacaggagaaggaagagctgctgaaacaacatcaatccgacaccctgcagcttgaagagctgcgaaagaccaaggaggtgccttggaggcgcgaccagatcaacagacactggcatgatgtcttacaacaattgcttctcatgcaggtcatgcaggaggaattgcacgcccaggcccttattctggagtcccttaacactaatctgtattacacacagcttgaattgcagaaggaaaaggctatcgtagggaacctggaaaaaatgctccagaccaaattcgcagagacagaagaaaaatacaagcatactatccagattctgacggaagaaaacattcacctgaaacagaagattatctccaagaacgaggaaatctgcgaggggtgcagtgggagacttgcctccatcaccgtctctaaagacgattctgatacggtacaggacggtagtaagaaagggcaagagtcttag

SEQ ID NO: 29704 - DNA, 1335 bp, Artificial Sequence
  Description of Artificial Sequence: Synthetic coding sequence
ttcagagtccctgccgcaggtcgccgttgtcccttggcccgaggggctcgtcggcctccggactcagcatgcggaaggtttcctcctgaccccggaagccccccagaggaagaagatgcagatctgtctgagagagaggaatcctggcttctcgcagaacgggaagaaaaccaggaggcggagtttccagggcttaggagggctgtgcagctgaatctgagccggcctattgaagagcaagggccactggatgtaataattcacaagctgacagacgtaatattggaggccgatcagaatgattcacagagcttggaactggtccacagatttcaagagtatatcgacgctcaccctgagactatcgtgttggacccgctgcctgcgattagaacactcctagacaggagcaagtcctacgagctgattcgaaagattgaagcctatatggaagatgatcgcatttgctccccaccattcatggaactgacttccctctgtggcgacgacactatgagattgctggagaaaaacgggctgacgttcccgttcatttgtaagacacgcgtcgcacacggcacaaattcccacgaaatggcaatcgtgtttaatcaggagggactgaacgccatccagccaccatgcgtggtccagaattttatcaaccataacgccgtgttgtacaaagtgtttgttgtgggagagagctatacagttgtccaacggcctagcctaaaaaacttctccgccggtacatctgatcgcgaaagcatctttttcaacagccataacgtctctaaacccgagtctagtagcgtgttgactgagctggacaagatcgagggagtcttcgaacgcccttccgatgaggtcatccgggagctcagcagggcactgcgacaggctttaggcgtctctctgtttgggatcgatatcattattaataaccagactggacagcacgccgtcatcgacatcaatgccttcccgggatatgagggagtgtcagaatttttcacggacctcctgaaccatatagccaccgtgctgcagggtcagtccaccgccatggccgcaacaggggacgtcgctttgcttagacattccaaactcctggccgagcctgctgggggtctcgtgggtgagaggacttgctcagctagcccaggctgctgcggctcgatgatgggacaggatgcaccctggaaggcggaggcggatgccggaggtacagcgaagctgccccaccagcggctcggatgcaacgccggagtctcccccagtttccagcagcactgtgtcgcctctcttgccacaaaggctagttcccagtag

SEQ ID NO: 29705 - DNA, 864 bp, Artificial Sequence
  Description of Artificial Sequence: Synthetic coding sequence
atgtgtggccgacgtaggaggcagagagccgctctcctatcccattgggacccaacgttgtcgagcgactgggatggtgaaaggaccgccccacagtgcctcttaagaatcaagcgtgatatcatgtccatttacaaggagcctccccctggaatgtttgttgtgcctgacacggttgatatgactaaaatacatgccctgatcacagggccttttgatactccgtacgaaggtggattcttcctctttgtttttcgttgccccccagattaccccattcaccctcccagggtgaagttgatgactacagggaacaatacagtgcgttttaatcctaatttctaccggaacggaaaggtgtgtctcagcatccttggtacctggactggaccagcatggtcaccagcccagtccataagtagtgtcctgatttctattcagagcctcatgacagagaacccttaccataatgagcctggcttcgagcaggaaagacatcctggagacagcaaaaactacaacgagtgcatcagacacgagacaataagagtagctgtgtgcgacatgatggaaggaaaatgcccctgcccagagccgctccgtggtgtcatggagaagtcattcctggagtactacgacttctatgaggtcgcatgcaaagatcggttacatcttcagggccagaccatgcaggaccccttcggcgagaagagaggccattttgactaccagagccttctgatgagactgggtttaataaggcagaaagtcctggagcggctccataacgagaacgctgagatggattcggactcctcaagcagcggaacggagaccgatctccacggcagtctgcgagtttag

SEQ ID NO: 29706 - DNA, 852 bp, Artificial Sequence
  Description of Artificial Sequence: Synthetic coding sequence
cccccatgcagtctgatcagcgactgttgcgccggtaaccagcgcgactccgttggcgtggggccaagtgagccgggttgctacccttgccccggtccaaacatgaatccaattgcactcggcagtcgctggctggcctacgccgagaataaactaatccgctgccaccagtctcggggaggagcctgtggcgacaatattcagtcctataccgctactgtgataagtgccgctaagaccctgaaatcagggcttactatggtaggtaaggtcgtcacacagttgactgggacactgccttcgggggtaacggaggacgatgtagccatccacagcaatagtcggcgaagccccctcgttcctggaataataaccgtcattgacacagagacggtaggagagggtcaggtgctagtgtccgaggatagcgatagtgacgggatcgtggctcacttccccgctcacgagaagcctgtgtgttgtatggcctttaacacatccggaatgctcttggtgactacagacaccctgggacacgatttccatgtcttccaaatcctgacacacccctggtcctcatcgcagtgcgcggtgcaccatttgtatacattacaccggggagaaacagaggccaaggtccaggacatatgcttttcacacgactgccggtgggtggtcgtgtcaacgctgcggggaacaagtcacgttttccccataaatccctatggcggtcagccatgtgtccggacccacatgagcccgagggtcgtgaaccggatgagccgatttcagaagtccgcaggcctcgaggaaatagaacaggaattgacctctaagcagggaggtcggtag

SEQ ID NO: 29707 - DNA, 2235 bp, Artificial Sequence
  Description of Artificial Sequence: Synthetic coding sequence
atgagcgccgcaaatcccgagacgccaaattccacaatcagtagagaagcaagcactcagagctccagcgctgccgcaagtcaaggttgggttttacctgagggcaagattgtgccgaatactgtatttgtcggcggaatcgatgcacggatggacgagacagaaatcgggtcctgcttcggcagatatgggagcgttaaggaggtgaaaataatcaccaaccgcacaggtgttagcaagggctacggctttgtctcatttgttaatgacgtggatgtgcagaagatcgtgggaagtcagattcacttccacggcaaaaagctgaagcttggtccggcaattagaaaacagaagctatgtgcccgtcacgtccaacccagacccctggtggtgaaccccccacctccgccacaattccaaaacgtttggagaaaccctaacactgagacctacttacaacctcagatcacccccaaccccgtcacccagcatgtgcagtccgctgctaatccggagacgcccaatagtacaatttcccgcgaggcaagtacccagagttccagcgctgctgcttcccagggttgggttctgcccgaaggcaagattgttcctaacacagtgtttgtgggcggtatcgacgccaggatggacgaaactgagatcggctcttgtttcggcagatatggatccgtgaaggaagtcaagataatcaccaatcgaaccggagtatccaagggatacggatttgtttcctttgtaaatgatgtcgatgtccagaagattgtggggtcccagatccacttccacgggaagaagctgaaactcgggccagctatccggaagcagaaactgtgcgcgcgacacgtccaaccaaggccacttgtggtgaatccccctcccccaccacagtttcagaacgtctggcgcaatcctaatacagaaacgtaccttcagccgcagatcactcccaatccggtcacacagcacgtgcagagtgccgctaaccctgagacacccaacagtacaattagtagggaggcctcaacacagtcctcatccgccgctgcaagccaagggtgggtcctgccggagggcaagattgttcctaatacggtctttgtagggggtattgatgcaagaatggacgagacggagatagggtcttgcttcggcagatacggctccgtgaaagaagtcaagatcatcacaaatcgcaccggcgtttctaaaggctacgggtttgtgtcttttgtgaatgacgtagatgtgcagaaaattgtgggtagtcagatccattttcatggcaagaagctgaagcttggccctgctataaggaaacaaaagctgtgcgccaggcacgtccagcctagacctctcgtggtgaacccaccccctcctccccagtttcaaaacgtttggcggaaccccaatacagaaacgtacctgcagccccagataaccccaaacccagttacacaacatgtgcaggcatacagtgcctacccccattcacccggacaggtaattactgggtgtcagctgctggtgtataattaccaggagtatcccacgtaccctgattcagctttccaggtgacgacaggctatcaactgcctgtctacaactatcagccctttccagcatatcctaggagccccttccaggttactgcagggtaccagctgcccgtctataactaccaagcctttcccgcttatcccaactcaccgttccaggttgccacagggtatcagttcccggtctacaattaccagccctttcctgcctatccttcttccccttttcaggtcaccgccggataccagttgccagtatacaactaccaggcgtttcccgcataccccaattcgccttttcaggtggctaccgggtaccagtttccggtctataattaccaggcgtttcctgcatatccaaacagcccagtccaggtgaccactggatatcagctgcccgtctataactaccaggcatttccagcttatcccagtagccctttccaggtcacgacagggtaccaactgccggtctataattaccaagcctttcccgcataccccaactcagccgtgcaagtgactacgggctaccaatttcatgtctacaactatcagatgcccccacagtgtcccgtgggagagcagagacgcaatttatggacagaagcttacaagtggtggtatctggtttgcctgatccagcgtcgtgactag

SEQ ID NO: 29708 - DNA, 1089 bp, Artificial Sequence
  Description of Artificial Sequence: Synthetic coding sequence
atgttgaagaacaagggtcactccagcaagaaagacaatctggctgtgaatgcagtcgctttacaagaccacatcttacacgatctgcaattgcggaatttgtccgtggctgaccattcaaagactcaggtgcaaaagaaagaaaataaatcacttaaacgggatactaaagccatcattgacactggcttgaagaaaacaactcaatgcccgaaattagaagattcagaaaaagagtacgtgctggaccccaagccacctccattgactttggctcagaagctcggcctaataggtccccctccccctccactctcttcggatgaatgggagaaggtcaaacagcggtcactgctgcagggtgacagcgtccagccctgtcccatatgtaaggaggaattcgagctgcggcctcaggtactcttgtcctgtagccacgtgttccataaggcgtgcctacaggctttcgaaaagtttaccaataaaaagacctgtcctctctgccggaagaaccagtaccaaacgagagtgatacacgatggagcacggctctttagaataaaatgcgtgactagaatccaggcttactggagggggtgcgtggtccggaagtggtaccggaacttgcggaagaccgtacccccaaccgatgccaagttgcggaagaagttctttgaaaagaagtttacagagattagccacagaattttgtgctcttacaacactaacatagaggagctttttgcggagatcgaccaatgcctggcaatcaataggtctgtcctgcaacagttagaggagaagtgcgggcacgaaatcactgaggaagagtgggagaagatccaggttcaggcactgcgcagagagacacatgaatgtagcatctgcctcgctccattgtccgctgcagggggacagcgcgtgggggctggccgacgcagcagggagatggctctactttcgtgttctcatgtcttccaccatgcttgcttgcttgctctggaggaatttagcgtgggggaccgcccacccttccatgcctgtcccctctgtcggagctgttatcaaaagaaaatcctggagtgctag

SEQ ID NO: 29709 - DNA, 2130 bp, Artificial Sequence
  Description of Artificial Sequence: Synthetic coding sequence
atggccgatgctggcatccgtagagtcgtgcccagcgacttgtaccccttggtactgggattcttaagggataatcagctgagcgaggttgcaaataaatttgctaaagccacaggggctactcagcaggacgctaacgcctcttcactgctggacatctactccttctggttgaaaagtgctaaggttcccgaaagaaagttacaggccaatggacctgtcgcaaaaaaagccaagaaaaaagctagttcttccgacagcgaggacagtagcgaggaagaggaggaggtccagggaccgccagctaagaaggcagccgtgcctgcaaagagagtgggactcccccctggcaaagcggctgcaaaggcttctgagagctcatcatcagaggagtccagcgacgatgacgatgaagaggatcaaaagaaacagcccgtgcagaaaggcgtcaagccccaggcgaaggcagccaaggcgcctccgaaaaaggctaagtcctcagatagcgacagtgatagctccagcgaagacgaaccgccaaagaaccagaaaccaaagattaccccggtcactgttaaggcccagacaaaggctcccccaaaacccgctcgagccgctccaaagatagccaacggaaaggccgctagctcttcttcctcttcatctagcagttcatcttctgacgactctgaggaggagaaggcggcagccactccaaaaaaagtgtggacaatcacttccgtgcgtgccgagactgtaccgaagaaacaggtagttgcaaaagctcctgtgaaggctgcgaccaccccaacccgaaagtctagttcttcagaggattcctccagcgatgaagaagaagagcagaagaagccaatgaagaacaagcctgggccttatagtagcgtgccaccacctagtgcccctccaccaaagaagagtttgggtacccagccccctaaaaaagctgtcgagaaacaacagccggtcgaatctagcgaggactcatccgatgaatcagattcaagttctgaggaggaaaagaaaccccctacaaaggccgtggtttccaaggccaccaccaaacccccacccgctaagaaggctgccgaatccagctctgattcctccgattcagacagctccgaggacgacgaggccccatccaagccagccggaaccaccaaaaactcgagcaataaaccagcagtcacaacaaaatcacccgctgtgaagcctgccgcagcaccaaaacaacccgttgggggtggacagaaacttttgactaggaaggcagactcgtcctccagtgaagaagagtcttctagttctgaggaggagaagacaaagaaaatggtggctacaaccaagcctaaggctaccgcaaaagctgccctgagtctgcctgccaaacaggcaccccaaggctcacgcgactcctcaagtgactctgattcctcctcgagcgaggaggaggaagaaaagactagtaagtccgcagtgaagaaaaagcctcaaaaggtcgcaggaggagccgctccttcaaaacccgcatccgctaagaaaggcaaagctgaatcatccaattctagttcatctgatgatagctccgaagaggaggaggaaaagctaaagggcaagggctctccacgccctcaggctccaaaggctaatgggacatccgcacttaccgctcagaacggaaaggccgcaaagaactctgaggaggaggaagaagagaagaagaaagccgctgtggtggtgagcaagtctgggagcctcaagaagagaaagcagaatgaagcagcaaaggaagccgagaccccacaggccaagaaaatcaagctccagactcctaacactttccccaaacggaaaaagggggagaagcgggctagtagccctttccggagggtacgcgaagaggagatcgaggtagattcccgcgtggcagataatagttttgacgcaaaacgcggagccgctggggattggggggagcgtgcaaaccaagtgctgaagtttaccaagggcaagtctttcagacacgagaagacaaagaaaaagaggggcagctataggggcggtagcataagcgtgcaggtgaactccatcaaatttgactcagaatag

SEQ ID NO: 29710 - DNA, 558 bp, Artificial Sequence
  Description of Artificial Sequence: Synthetic coding sequence
atgcagcagaagagccaaaagaaagcggagctgctggacaacgagaagcccgcagctgtggttgcccctatcactaccggctacacagttaaaatctcaaactacgggtgggatcagtccgacaagttcgtgaaaatctacatcacgctgaccggagtccaccaagtacccaccgagaatgtacaggtgcactttactgagaggtcattcgatctgctggtcaaaaatttaaatggtaaaagctactccatgattgtcaataacctgttgaagccgatttccgtggaagggtcaagcaagaaggtgaaaaccgacacagtgctgatcctgtgccgtaaaaaggtcgagaataccaggtgggattatttgacacaagtggagaaagagtgtaaagaaaaggaaaagcctagctatgacacagagacagatccatcagagggcctgatgaacgtgctgaaaaagatctacgaggatggcgacgacgatatgaaaagaaccataaacaaggcctgggtggagtcacgagaaaagcaggcgaagggagatactgagttctag

SEQ ID NO: 29711 - DNA, 1764 bp, Artificial Sequence
  Description of Artificial Sequence: Synthetic coding sequence
atggccagcgaggatatagctaagctggctgagacactggccaaaacccaagtcgcgggtggccagctcagcttcaaagggaaatctctgaaattaaacactgccgaggacgcaaaagatgtcataaaggaaattgaggacttcgactctcttgaggcacttaggctggagggcaacaccgtgggagttgaagcggcaagagtcatcgccaaagctctggagaaaaagtctgagcttaaacgctgccattggtccgacatgtttaccggcaggttacgcacggaaatccctccagctctgataagcctcggcgagggactgatcaccgccggagcccagctggtcgagttagatttaagtgataatgcgttcggacccgatggtgttcagggcttcgaggcgctgctgaagtcatcagcttgtttcacattgcaggagcttaaactgaataattgcggaatgggaattggtgggggaaagattcttgcagccgcattgactgagtgtcatcgtaagagttctgcccagggaaagcccttagctcttaaggtatttgtcgcagggagaaacagactcgaaaatgacggggcaactgcccttgcagaggccttccgggtgattggaacactggaggaggtgcacatgccccagaacggaattaaccacccaggcattacagcactggcacaggctttcgccgtgaaccctttacttcgggttattaatttgaacgacaatacgttcactgagaaaggcgcagtggcaatggccgaaacgctgaagaccctgcgccaggttgaggtgatcaattttggagattgtttggtacggtccaagggggctgtggctatagccgatgcgattagagggggattgcccaaattaaaggagctaaatctgagcttctgcgagattaagagggatgctgccctggcagtagcagaagctatggcagataaggcggagctggagaagcttgatttgaatggcaatactctgggcgaagaaggctgtgagcaattgcaggaggtcctcgagggtttcaacatggcaaaggtcttggcgtcattgagtgatgatgaggatgaagaagaggaggaggaaggtgaggaagaagaggaggaagcagaagaggaagaggaggaggacgaggaggaagaggaggaggaggaagaagaagaggaggaagagccacaacaaaggggacaaggagagaagtctgccaccccctcgagaaagatcctggaccccaacaccggcgaacccgctccagtcctttcctccccacctcccgcagatgtgagtacattcctcgccttcccgtcgcccgagaaactactccggctcggcccaaaaagctccgtgcttatagcgcagcaaacagacaccagtgaccctgagaaggtggtgtcggccttcctgaaagtgtccagcgtgtttaaggacgaagcaaccgtgcgaatggccgttcaagacgctgtcgacgccttaatgcaaaaggcgtttaatagcagttcctttaactccaacactttcctcactaggttactggtccatatgggcctgctgaagtccgaggataaagtgaaagctattgccaatttatatggacccctcatggccttgaaccatatggtgcaacaagactatttcccgaaagcccttgccccactgctgcttgcctttgtgaccaaacccaattctgccttggaaagctgtagcttcgcaagacactcccttctacagacactctataaggtatag

SEQ ID NO: 29712 - DNA, 1098 bp, Artificial Sequence
  Description of Artificial Sequence: Synthetic coding sequence
atgaaggagctgtggtgcgtgatggattgggctgttcctggtctgctaggcagtgggacatacttcaaaaagcaattttctgaccccgtagagcatggtcagagacataccgccaccaagagagagctggccaccgggagaaaggccatgcagcgccttgctaaaaagatgagcgggtggtttctgcggagaactaagacgttgatcaaggaccagttgcctaaaaaagaagaccgcatggtctattgctctttgacagattttcagaaagctgtttatcagacggtgctggaaaccgaggatgtgaccctgattttgcagtcaagcgaaccctgcacatgccgaagtggtcagaaacggaggaactgctgttataaaaccaatagccacggtgaaaccgtcaaaaccctgtacctctcctacctgaccgtgttgcaaaaagtagccaatcacgtggcactcctacaagccgcaagcacaagtaaacaacaggagacattgatcaagagaatctgcgaccaggtcttttctagatttccagatttcgtgcaaaaaagtaaagatgccgcttttgaaactctctctgatcccaagtatagtggcaaaatgaaggtgctgcaacagctgctgaatcactgcagaaagaacagggataaggtactcctcttttcattctccacgaagctgttagacgtgctgcagcagtactgcatggccagtggcctggattaccggcgactggacggttcaaccaaatcagaagaaaggctgaaaatagtcaaagaattcaatagcacccaggacgttaacatctgtctggtctctactatggcagggggacttggtttaaatttcgttggagcaaatgttgtagttctgtttgacccaacctggaatcccgcaaacgacctgcaggccatcgacagaacccagactcactgtagaagagagcgagacgctgaaccgctttcgtcagctcctgggctacaaaacgggagcgagaatgctgttccctacccttggtggtgttgcgtaactggtgcatcaatttcctgttggagatgtgaaatctgtcgcatccaggatgtgctggagtag

SEQ ID NO: 29713 - DNA, 1104 bp, Artificial Sequence
  Description of Artificial Sequence: Synthetic coding sequence
atggaaaagaagaaaatggtgacacagggcaatcaggaacctacaaccacccctgatgccatggtgcagccatttaccacaatcccttttcctcccccaccccaaaacggcattcccacagagtatggcgtgccacacacgcaggactacgccggacagacgggagaacataacctcaccctgtatggttcaacccaggcccacggggagcagtcctcgaatagtccttccacccagaatggaagcctgactcagacagagggtggcgcacaaaccgacgggcaacagagccaaacccagagtagcgaaaactctgagtccaagtcaacgcccaaacggctccacgtatcaaacattccttttagattccgagatccagatctgcgtcagatgtttggacagttcggaaagatccttgatgtggaaatcatcttcaacgaaaggggctccaaagggtttggattcgtgacttttgaaaatagcgccgatgcagatagggcccgtgaaaaactccacggtaccgttgtggagggaagaaagattgaggtgaacaatgctactgcaagggttatgactaataagaaaatggtaacgccatacgctaatggatggaaattaagtccagtagtgggggctgtttatggcccagaactatatgctgcttcgtctttccaggctgatgtgagtttagggaacgacgccgctgtcccactgagcggcagggggggtattaacacttatataccccttataatcccaggatttccatacccaacggcagccaccactgcggctgccttccgcggtgcacatttacgtggaagaggaagaactgtatatggcgctgtccgggctgtaccacccacagccatccctgcataccctggagttgacatgcagcctaccgatatgcactcacttctactacaaccgcaacccccacttctgcagcccctgcagcccctgactgtcacagttatggcgggttgcacacagccgactcccacgatgcctctgccactgcctctcgccatggagctggctctttggagggtgtacacggaggtagccaccgcggacctgccaccaacagaggttacttag

SEQ ID NO: 29714 - DNA, 1764 bp, Artificial Sequence
  Description of Artificial Sequence: Synthetic coding sequence
atggcaagcgaagacattgcaaagcttgcagagaccctcgccaaaacccaggttgcaggcggtcagctaagttttaagggcaaatctctgaagctgaataccgccgaagacgccaaagacgtgataaaggaaattgaggatttcgattctctggaagcactgaggttggagggcaatacagtaggagtggaggcagcacgggtcatagccaaggccctggagaagaagtctgagctcaaacggtgtcattggtctgacatgttcaccgggaggctgcggacagaaatccctcccgctttaatcagcctcggcgaaggtttgattaccgccggagcccagctggttgaacttgatttgtccgacaacgccttcggacccgacggtgtgcagggcttcgaagcgctgctaaaaagttccgcctgtttcaccctgcaggaattgaagctaaataactgcggtatgggtatcgggggtgggaaaatcctcgcagccgcacttacagaatgtcatcggaaaagctccgcgcaggggaaacctctggccctgaaagttttcgttgctgggcgaaatagacttgagaacgatggggctaccgccctggccgaggccttccgggtgattggcacgctcgaagaagttcacatgccacagaacggcatcaatcaccctggtattacagccctggcccaggcatttgcagtaaacccattactgcgtgttataaacctcaacgacaatacattcactgaaaaaggagcagtagcaatggcagagacacttaagaccctccgccaagtggaggtgatcaatttcggcgactgtctcgtgaggtctaaaggggctgtggccatcgcagatgccattcgcggagggctcccgaagctcaaggagctgaatctttctttctgcgaaattaaacgggacgccgctttagctgtggccgaagctatggcagacaaagcagaactggagaagttggatctgaacggaaataccctgggcgaggaggggtgtgagcagctgcaggaagtgctggaaggcttcaatatggctaaggtactagctagtctctctgatgatgaggacgaagaggaagaagaggagggagaggaagaagaagaagaggctgaagaggaggaggaggaggacgaagaagaagaagaggaagaggaggaagaggaggaggaagaaccccagcagaggggccaaggcgaaaagtccgctactccctctcgaaaaatcctggatcccaacactggagaacccgcaccagttcttagtagcccgcctcctgccgacgtgagcacattcctcgctttccctagccccgagaagttgctccgcctgggtcccaagtcctccgttctgattgcacagcagacggatacctctgaccctgagaaggtggtgtcagcattcttgaaagtctcctccgtatttaaagacgaggccacagttaggatggctgtccaagatgccgtggacgcactaatgcagaaggcgttcaactctagctcctttaactcaaataccttccttacacgccttctcgtgcacatgggactgcttaagtctgaggataaggtgaaggccatcgccaacctgtatggtcctcttatggccctgaaccatatggtgcagcaggattacttccctaaagctctcgccccactactgctggcctttgtaactaagcctaacagtgcgctggaaagttgcagtttcgctagacactcccttttacaaaccttgtataaagtctag

SEQ ID NO: 29715 - DNA, 1143 bp, Artificial Sequence
  Description of Artificial Sequence: Synthetic coding sequence
atggacgccgcaactttgacttatgataccttaaggttcgcagaattcgaggactttccagagacaagcgaacctgtgtggattctcggacgtaaatattcaatatttacggaaaaagacgagatcttgagtgatgtggcatctaggttatggtttacctacagaaaaaattttcccgctatcgggggaacaggccctactagcgacacaggttgggggtgcatgcttagatgcggacagatgatctttgctcaggctttggtttgcagacatcttggcagggattggcgttggacccagaggaagcgacagccggacagttatttttccgtccttaacgcctttatagataggaaggactcatactatagcatacatcagattgcccagatgggggtgggcgagggcaaaagtatcggccaatggtatggtccgaacactgtcgcccaggtgctaaagaagctcgcggtatttgacacctggtcatctttagctgtccacattgcaatggataatacagtagtgatggaggagatccgacgattgtgcaggacctccgttccatgcgcgggtgccacagcctttcccgctgacagcgaccggcattgcaatgggtttcccgcaggggctgaggtgacaaatcgaccctccccatggagacccctcgtgctgctgattccactgagacttgggcttactgatataaatgaggcgtatgtggagacattgaaacactgcttcatgatgccccagtctctgggtgtcatcggaggaaagccaaatagcgcccattattttattggatacgtcggggaagagctgatttacttggaccctcacacgactcagccggctgtcgaacccactgacggctgcttcatccccgacgagtcattccactgtcagcaccccccttgccgcatgtcgatagcagaattagatccttcaattgcggtgggctttttctgtaaaaccgaagacgattttaacgactggtgtcaacaggttaaaaagctgagtttattagggggagcactccccatgttcgagctggtggaacttcagccctcccacctggcctgccctgatgtactgaacctcagtctgggcgaatcttgccaggtccagatcttgttaatgtag

SEQ ID NO: 29716 - DNA, 2124 bp, Artificial Sequence
  Description of Artificial Sequence: Synthetic coding sequence
atgataccacctcaggaggcgtccgcacgaaggcgcgagattgaagataaactgaaacaagaggaggagaccctgtcgtttattcgagattccttggagaagtctgatcagctgacaaaaaatatggtcagtatactctcctcattcgaatctcgtctcatgaaattggaaaacagcatcatacccgtacacaagcaaactgaaaacctgcagagattgcaggagaacgtagagaaaactctgtcctgcctggatcacgtcattagctactaccacgtggcatctgatacggaaaagataataagggaaggaccaacaggcagactcgaagaatacctgggaagtatggccaagattcaaaaggccgtggaatacttccaggacaactcacccgattccccagagctcaacaaggttaagctgctcttcgagcggggaaaggaagccctggagagcgagtttcgcagtctcatgacccgccactcaaaagtggtcagcccggtcctaatactggatttgatctccggtgacgacgacctggaggctcaggaagatgttactctggagcacctgccggagtcagtgctgcaagatgtcatccggattagtcgatggcttgttgaatatggcagaaatcaagacttcatgaatgtctactatcaaatccggtctagccaactagaccggtccatcaaaggtctaaaagaacactttcataagtcatcctcttctagtggggttccgtattcaccagcgatccctaataaacgtaaagacactcccaccaagaagcctgttaagcgccctggtacaatcagaaaggcgcagaatttgctcaaacagtactcacagcatggcctagatggaaaaaagggcggtagtaacctgatccccttggaaggccatgaacacgattttcgcgtcaaacatctcagcgaagctcttaatgacaagcacggtccattggcgggaagagatgacatgttggacgtcgaaactgatgcttatatacactgcgttagcgcgttcgtgaagttagcccaaagcgaatatcagctactcgcagacatcattcctgaacaccaccaaaaaaagacgttcgactcattaatccaggatgccctcgatggactgatgctggagggggaaaacatcgtctccgcggctcgaaaagccattgtgcgccacgacttttccacggtgctgacagtgtttccaatcctgagacacttgaagcagaccaagcccgagtttgatcaggtattgcagggtacggccgctagcaccaaaaacaagctcccgggtcttattacgtctatggagacgatcggagccaaggctcttgaagacttcgcagataacattaagaacgatcccgataaggagtataacatgcccaaagatggcaccgtgcacgaactcacttccaacgccatcctgtttctgcagcaactcctcgactttcaagagaccgcgggagcaatgctggcctctcaagagacgtcctcttctgctactagctattctagcgagttctctaagcggctgctatccacatacatctgcaaggtcctggggaacctgcagctcaatctactgtccaagagtaaggtctacgaagaccctgcactctccgcaatttttctgcacaacaattataattatatactgaagagtctggagaaaagcgaactgatccaactggttgctgtgacacagaagaccgcggaaagatcatatagagagcatattgaacagcaaatccagacataccaacgctcctggcttaaggtgacagattacatcgcagagaagaacttgcctgtttttcaacccggagtgaaactgagggacaaggagagacagataatcaaagaacgttttaagggcttcaatgatggtctcgaagaactctgcaaaatacagaaagcatgggctatcccagacaccgagcagcgggatcgtattaggcaggcccaaaagaccatcgtgaaagagacctacggggcattcttacagaagttcggctccgttcctttcacgaagaacccggagaagtatataaagtacggcgtggagcaggtgggggacatgatcgatagactgtttgatacatctgcttag

SEQ ID NO: 29717 - DNA, 1026 bp, Artificial Sequence
  Description of Artificial Sequence: Synthetic coding sequence
atggcccaggaatcccccaagaacagcgcagccgagattcccgtcactagcaacggtgaagtagacgattccagagagcacagtttcaatagggatttaaagcacagtcttcccagtggattgggtctctcagaaacacaaattaccagccacggatttgacaacacgaaagaaggagttatcgaggccggagcctttcagggcggacaaagaacgcagaccaagagcggacccgtaatactagccgatgaaatcaagaacccagcaatggaaaagcttgaactggtacgtaagtggtctttaaacacctacaaatgcacacgccagatcatttccgaaaagttgggcaggggctctagaactgttgatctagaactcgaagctcagatagatatcctgcgagacaacaagaaaaaatacgaaaatatattgaaactggcacagacgctgtcaacgcaactgtttcagatggtgcacacacaaaggcagttaggagacgcctttgccgatctgtcacttaaaagcttagaactgcatgaagaattcgggtacaacgccgacacacagaagttgcttgccaagaacggagaaaccctactcggggcaatcaatttcttcatcgcaagcgtcaatacactggttaataaaaccatcgaggacactcttatgacggtgaaacagtatgagtctgcacgcattgaatacgacgcatatagaacggacctggaggaactgaatttgggacccagggacgctaataccttgcctaagattgagcagtcccaacatctgtttcaggcccataaggagaaatacgacaaaatgagaaatgatgtgtccgttaagttaaagttccttgaagagaataaggtcaaagtcctgcataaccaactcgttctgttccacaatgcaatcgcagcatactttgcgggtaatcaaaagcaactggagcagacgctgaagcaattccatatcaagttgaaaacacccggagttgatgcccctagctggttagaagaacagtag

SEQ ID NO: 29718 - DNA, 1488 bp, Artificial Sequence
  Description of Artificial Sequence: Synthetic coding sequence
atggcaggggttggtcgttcagggggtccgtgggggagaacacgaggaggtagatccggccgtctgggtgtctccctgggggctctgagtagcctcccgctggaggagcttcccagacctctatgttgtcgcagatgcaggcggcactttgggtttgctttacggggagagacaatcccagtctcggtcgccggttcagcgtcctcacagttcgccccactggccctgcacctttctctcctgctcagcagaatttctgcctcccgcttgacacgctggcctcctcccgataaaagagaagggagtgcagtcgaccccggaaagaggcggtctctcgcagcaactcccagcagcagccttccttgcacactgatcgctctcgggctcaggcatgagaaagaagccaacgagctcatggaggatctttttgagacctttcaggacgaaatgggttttagtaacatggaagatgacggtcccgaagaggaagagagggtcgccgagccccaggccaacttcaatacacctcaggctttgagattcgaagaactgctcgctaacttacttaatgagcaacatcagattgccaaggagctgtttgaacaattaaaaatgaagaaacccagtgcaaaacagcagaaggaggtagagaaggttaagccacagtgcaaagaagtccaccaaactctgatcctagatcctgcccagcgcaagcggctgcaacagcaaatgcagcagcatgtccagctgctgactcagatacatcttctggcaacttgcaacccaaaccttaatcccgaggcttcttctactcgcatctgcctcaaggagcttggcacattcgcccagtcaagtatagcactgcaccaccagtacaacccgaagttccagactctcttccaaccttgcaacctcatgggcgcaatgcagctgatcgaagatttttccacccatgtgagcatcgactgctctccccacaagacggtaaaaaaaacagctaacgaattcccttgcctccccaagcaagtagcctggatcttagccacctccaaagtctttatgtaccccgagctgctaccggtctgctctctgaaggctaaaaacccacaggacaaaattctgttcacaaaggccgaggacaacctgttggccttggggctcaagcattttgagggaacggagtttctgaaccccctcatttcaaagtacctgttaacctgtaagaccgcaagacagctcactgtgcggatcaaaaaccttaatatgaacagggccccagataatattattaagttctacaagaagactaagcaactacccgttctcggcaaatgttgtgaggagatacagccccaccagtggaagccccctatagaaagggaagaacaccggttacccttttggctgaaggtgcagccatcatcctccaaaagcgtagggggacgaaggagtttaaaagtgctccgggagtatcagggactcccttag

SEQ ID NO: 29719 - DNA, 180 bp, Artificial Sequence
  Description of Artificial Sequence: Synthetic coding sequence
atggctgctccgggtgccttgctcgtaatgggcgtgtcagggtccgggaattgggatggcaattccatgatgttaatgattattactagaagaaagattgagggccgatgggaaaaggcctatcgatctatgacccggaccggctttcatgggtcggttacttgtatgactttctactag

SEQ ID NO: 29720 - DNA, 207 bp, Artificial Sequence
  Description of Artificial Sequence: Synthetic coding sequence
atgggcgagaccgaggggaagaaggatgaggccgattataagcgcctgcagacgttccctctagtccggcacagtgacatgcccgaggagatgcgtgtcgagaccatggagctttgtgtcaccgcatgcgaaaaattttccaacaacaatgaagtactcccggcagtacaggctgccccaagagctttcgatggcccttgcgggtag

SEQ ID NO: 29721 - DNA, 2451 bp, Artificial Sequence
  Description of Artificial Sequence: Synthetic coding sequence
atggtattaatgttccagattcgctatatttctcagacccagggactcccagcggagtatctcctttctgcgggaacaaagacaactaggtttttcaatagggatcccaatctcgggtacccgctttggcggctgaaaacgccagaggaacatgagctggagactggaattaagagcaaggaggcccgaaagtacattttcaactgcttggacgacatggctcaggtgaacatgtcaaccgacttggagggtacagacatgctggcagagaaagccgacaggagagaatacattgatttgttgaaaaagatgcttacgattgacgccgataagcgcattacaccacttaaaaccttgaatcatcagttcgtgacgatgactcacctgctggactttccacactcaaatcacgtaaagtcctgctttcagaacatggagatctgcaagagacgggttcatatgtacgataccgtgtctcaaattaaatcccccttcaccactcacgtggctcctaatacttctaccaatctcaccatgagtttctctaaccagctcaatacagtgcacaatcaggcttctgtgctggccagttctagcaccgcagccgcagctaccttatccctcgctaattccgacgtcagtctccttaactatcaaagcgccctttacccaagttcagccgcacccgtgcccggagtggcgcagcagggcgtatctcttcagcctggcaccacacagatctgcactcagacagatccgtttcaacaaacattcatagtgtgtccacctgcgtttcagacgggccttcaggccactaccaagcatagcgggttcccagttcggatggacaatgccgtgcctattgtccctcaggcacccgctgctcagccattacaaatccagagtggagtgttaacccagggatcatgcacacccctgatggtggccactctacacccacaggtggccacaattacgccacagtacgcagtccccttcacgcttagttgtgctgcagggagacctgcactggtcgaacagactgctgcagtcctacaagcttggcccggtgggactcagcaaattcttcttccctctacttggcaacagctgccaggcgttgctctgcataacagcgtgcagcccacggcaatgattccagaagccatggggagcggacagcagttggccgactggcgcaatgcccattcccatggcaatcagtactctactatcatgcaacagccttccctgctgacaaaccatgtcaccctggccaccgctcagcccttaaatgttggtgtggcccatgtggtgcggcagcagcagtcttcaagcctcccctccaagaaaaataagcagtctgctccagtgtcatccaagtcctctctggatgttctgccgagccaggtgtactctctcgtcggaagttctcctctcaggaccacatcaagctataacagcctcgtgcctgtccaggaccagcaccagcccatcataatccccgacactccttctccgccagtgtctgtcattacaatcaggtctgacaccgatgaagaagaggataataagtacaagcctagctcttcaggactgaaacccagatccaacgtgatttcttacgtgacagttaacgactcccccgatagtgattcatccctatcttcaccttatagcacagacactctgtccgcgttgaggggtaacagcggatcagtgctggaaggtccagggagggtcgtggcagatggaaccgggactcgcacaattatcgttccacctctcaagacccagctgggcgactgtactgtggcgacgcaagcttccggtctcctgagcaacaaaacaaaacctgtagccagcgtttctggacagtcttcagggtgctgtatcacaccaactgggtacagggcgcagcgcggtgggacaagcgccgctcagcctctgaatctgtcccagaaccagcagagttctgctgcaccgacaagccaggaaaggagctcaaatccagcccctcgaagacagcaggcattcgtggcccctctgtcccaggctccgtacacgttccagcacggctcccctctgcacagtactgggcatccccatctagcacccgcacctgcacaccttccatcccaggcccacctgtatacctacgccgcaccaacctccgcagccgcattgggttcaacctcctcaatagcccatctgttctctcctcaagggagcagcaggcacgccgcagcgtataccactcacccctcaaccttggtgcaccaggtcccagtatctgtgggcccttcactcctgactagtgcatcggtggctccggctcagtaccagcaccagtttgccacgcaatcctatatcggatcttctcggggatcaacgatttacactgggtaccccttgtctccgaccaagatttcccagtattcttacctgtag

SEQ ID NO: 29722 - DNA, 1119 bp, Artificial Sequence
  Description of Artificial Sequence: Synthetic coding sequence
atggacgtgctgtccccactgagcttcatcaaagtgtcacacgtgcgtatgcagggaatcctcctgttagtgttcgcaaagtaccagcatctcccttatatacagattctctcaactaagtcgacacctacgggcttattcggttattggggcaataaaggtggggttaatatctgtcttaaactctatggttactacgtctctataattaactgccatttgcctcctcacatctctaataattaccagagactggaacactttgatcggatcctcgaaatgcagaactgtgaaggcagagatatccctaatatcctcgatcacgacctgattatttggtttggtgatatgaacttcagaatcgaggattttggcctgcattttgtcagggagtcaatcaaaaatcggtgctatggaggactgtgggagaaggaccaactgagtattgccaaaaagcacgatccattgttacgagaattccaggaaggcaggctcctgttcccaccaacttataaatttgacagaaacagcaacgattatgacacatcggagaagaaaagaaagccggcttggactgacagaattttatggaggcttaagagacagccttgtgcaggacctgataccccaatacctcccgcaagccatttctcactgtccctgaggggctactcctctcatatgacatatggcattagtgaccataagcctgtctctgggacctttgacctagagctgaaacccctggtgtccgcgccattaatcgtgctgatgcccgaggacctgtggacggtagagaacgacatgatggtgtcctactccagtacctcagatttcccctcatccccttgggactggatcggcctgtataaggtgggtctccgggatgtcaatgattatgtctcttacgcctgggtaggcgacagcaaggtcagttgctctgacaatctgaatcaggtgtacatcgatatttccaacataccaacaactgaggacgagttcctgctatgctactactccaatagcctgaggtctgtagtcgggatctctaggccatttcagatccctcctggctctctgcgggaggaccccctgggagaagctcagcctcagatctag

SEQ ID NO: 29723 - DNA, 480 bp, Artificial Sequence
  Description of Artificial Sequence: Synthetic coding sequence
atgataccaccacaggaggctagtgcccgtcgtcgggaaatagaggacaagctgaagcaggaggaggaaaccctctcgtttattcgcgattcgctggaaaaatctgaccaactcaccaagaatatggtgagcatcctgtccagtttcgaatctagactaatgaagctggagaactctatcattcctgtacacaaacagacagagaacttacaacggctccaggaaaatgtggaaaagacgctctcgtgtttagatcacgtcatttcctactaccatgtggcttctgatacggagaaaattatccgagaagggcctacgggtagactcgaagagtatctcggaagcatggcaaagattcaaaaagccgtggagtattttcaggacaattcccctgactctcctgaactcaacaaggtggtccgtggaccacagaataacgtgcgctccttgggcatctctgtctccgctctggtgagctag

SEQ ID NO: 29724 - DNA, 243 bp, Artificial Sequence
  Description of Artificial Sequence: Synthetic coding sequence
atggctagcgaagaactgcagaaagacctggaggaggtgaaagtgctgctggagaaagcgaccaggaagcgtgtgagagacgcactgacggcagaaaaatctaagattgaaaccgaaatcaagaacaaaatgcagcaaaagtctcaaaagaaggctgagctactcgataatgagaaacccgctgccgtagtcgctccaattacaaccgggtacacggatggcatcagccagataagcctctag

SEQ ID NO: 29725 - DNA, 606 bp, Artificial Sequence
  Description of Artificial Sequence: Synthetic coding sequence
atgccctctgagacgctatgggagatcgccaaggctgaggtggaaaagcgaggcatcaacgggtcggaaggcgatggtgctgagattgctgagaaatttgtcttcttcatcggctccaagaatggagggaagactaccataattctgagatgccttgatagagatgagcccccaaagcctactctcgcacttgaatatacttatggaaggagggcaaagggccataacacccctaaagacatcgcacacttttgggaattgggaggcggaacatctctcctggatctgatctccatccctataaccggggacactttacgaacattctctctagttctggtcctcgatctgtctaaacccaatgatttgtggccaactatggagaatttgctgcaggctacgaaaagccacgttgacaaggttatcatgaagttggggaagacaaacgccaaagctgtgtctgagatgcgccagaagatctggaataatatgcctaaggaccaccctgtatcctgttgcctgggtctgctgcttgaatccctcgttccatttatcgttaatgataacattactaataattttttcaggttcttatgcatgacgtag

SEQ ID NO: 29726 - DNA, 1401 bp, Artificial Sequence
  Description of Artificial Sequence: Synthetic coding sequence
atgagttacaggccagtcgtctctccagtcatgagcctcactagacggtgtatgcgaagcaggactagcatgaggactgacgcggtgttcctgatcctctacaaagaactctattaccgacacatctacgcaaaggtgtcagggggtccttcactcgaacagcgatttgagtcctattacaattactgtaatctgtttaattatatcctaaacgcagacggcccagcgcctctcgaactgcctaaccaatggctctgggacataatagatgaatttatataccagttccagtcgtttagtcagtatcgctgcaagactgccaagaaatctgaggaagaaatcgattttctgcggagcaatcctaagatctggaatgtccattccgtgctgaatgtccttcacagcttggtagataagtcaaacatcaatcggcagctggaggtgtacacaagtggcggagaccctgagagcgtagcgggagaatatggcagacacagtttatacaagatgctgggttattttagcctggttggactgctgagactgcactccttattgggggactactaccaggccattaaagtattggagaacatcgaacttaacaagaaaagtatgtactctcgggtacctgagtgtcaagtgacgacttactattatgttggcttcgcttatctcatgatgcgcagatatcaggatgctatccgagtattcgcgaacatactgctgtatattcagcggaccaagtccatgttccagagaacaacttacaaatacgaaatgattaacaaacagaacgaacagatgcatgcattgttggctatcgccctcactatgtatcccatgagaattgacgagtccattcacctgcagctgagagaaaagtacggggataaaatgttgagaatgcagaagggcgacccccaggtgtacgaagagctgttcagttatagctgccccaaattcctctctcctgtcgtccccaattacgataacgtgcacccgaactaccataaggagcccttcttgcaacaattaaaagtgttttcagatgaagtgcagcagcaggcccagctttcaactatccggtctttcctcaagctgtataccaccatgcccgtcgctaaacttgctggatttctggacctcaccgagcaagaattcaggatacagctgctcgtttttaagcacaaaatgaaaaatctggtgtggaccagcgggatatcagccctagatggggagtttcaaagcgccagcgaggtggatttctatatcgataaagacatgatccacatagctgacacaaaggtggccagacggtacggagatttttttataaggcagatacacaaattcgaggaacttaatagaactctgaaaaaaatgggacaaaggccgtag

SEQ ID NO: 29727 - DNA, 597 bp, Artificial Sequence
  Description of Artificial Sequence: Synthetic coding sequence
atgagccgtgccgtgaccattgccgaggccttttgtcacatacttttccggattataagtgagatcctgatgagaatgctcgaagagcaatgcttgtttcctctgccggagccccaggatctgtttcaggccagccagatgaaatttgaagactttcagaaagacctcagaaagctaaaaaaggacctcaaggcttgcgaggtcgaggcaggtaaggtctatcaggtgagctctaaagaacacatgcaacctttcaaagagaacatggagcaatttattatacaggccaagattgaccaagaggccgaagagaactcactgacagaaacacacaagtgttttctcgagacgaccgcctacttctttatgaagccgaaactgggtgagaaagaggtctcacctaacgcttttttctctatttggcatgagttctcatccgacttcaaagatttttggaagaaggagaataagcttctgctgcaggaaagggttaaggaggccgaagaagtgtgccgccagaaaaaaggcaagtccttatacaagatcaaacccagacacgactcaggcataaaggccaagatctctatgaagacatag

SEQ ID NO: 29728 - DNA, 441 bp, Artificial Sequence
  Description of Artificial Sequence: Synthetic coding sequence
atggagcctacacgggactgtccgctgttcgggggtgccttcagtgccatattgccgatgggcgctattgacgttagcgacctgagacccgtcccggataaccaggaagtgttctgtcaccctgtgactgatcaaagcctgatcgttgagctcttggaattgcaggctcacgtcaggggagaggcggcagctcgatatcattttgaagacgtcggcggagtgcagggtgcaagggccgtccacgtggaaagtgtacagcctctgagcctggaaaatctcgccctgagaggtcgatgtcaggaggcgtgggttctgtccgggaaacaacagattgctaaggagaaccagcaagtggccaaggatgtgactctgcatcaagcccttctgagattaccgcaataccaaactgacctgttactgaccttcaatcagcctccctag

SEQ ID NO: 29729 - DNA, 1584 bp, Artificial Sequence
  Description of Artificial Sequence: Synthetic coding sequence
atgtcactgtgtggagctagggccaatgccaagatgatggcggcttacaacgggggtacatcagcagcggcagcgggacatcaccaccatcatcaccaccacctacctcaccttccacccccacatctacatcaccaccaccatcctcagcaccatttgcatccgggaagcgctgcagcggtccatcccgtacagcagcatactagctctgcagccgctgctgccgcagctgccgctgccgctgcagctatgctgaatcccggtcaacaacaaccttactttccttctcccgctccagggcaggcccctggtcctgcagcggctgctccagctcaagtgcaggcggctgccgcagcaactgtgaaggcccaccatcatcaacactcccatcatcctcagcagcagctggacatcgaaccggatagaccgatcggatatggggcatttggagtggtttggtccgtaacagatccccgagacggcaaaagagtcgcactgaaaaagatgcctaacgtttttcagaacttagttagctgcaagagagtgttcagggaacttaaaatgttgtgtttttttaaacacgacaatgtcctttcggctttagacattttacagccacctcacattgattattttgaagagatctatgtcgttacagagctgatgcagtccgacctgcataagatcatcgtttccccccagcccctgagctccgaccatgttaaggtgttcctgtatcaaatcctgcggggtctcaagtacctccactctgccggaatcctgcatcgcgacatcaagccaggcaacctgttggtgaactctaattgcgttctcaagatctgtgacttcggactggctcgcgtggaagaattagacgaaagccggcacatgacccaggaggtggtgacacagtattatcgtgccccagagatcttgatgggctctagacattactccaacgctatcgatatctggtctgtcggatgtatctttgccgaattactggggcgtcggatcctcttccaggcgcaatcccctatccagcaacttgacctgataaccgatttgctaggtaccccctcactggaggcaatgcggacagcgtgtgagggggcaaaggcccatattctgagagggcctcacaaacaacctagcctcccagtgctgtacacactgagctctcaggccactcacgaagcagtgcatctgctttgccgtatgcttgtttttgacccatcaaagaggatcagtgccaaggacgccctagcccatccgtatctcgacgaaggcagattgagatatcacacctgtatgtgcaaatgttgcttcagtacgagcaccgggcgtgtctacacctctgatttcgaacctgttacaaaccccaagtttgacgataccttcgaaaaaaacctgtcttcggtgagacaagttaaggagatcattcatcagttcattctcgaacaacagaagggcaaccgcgtgccgttatgcatcaacccacagagcgcagctttcaagagtttcatctcatccactgtggcccagccaagtgagatgccaccgagccccctggtgtgggagtag

SEQ ID NO: 29730 - DNA, 2742 bp, Artificial Sequence
  Description of Artificial Sequence: Synthetic coding sequence
atgaatgaagcgatggccactgacagtcctcggaggcctagtagatgcacgggaggagtggtggtacgaccccaggctgtaacagaacagtcatacatggagtctgtggttacttttctccaggacgtcgtgcctcaagcatattccggcacgcctcttaccgaggaaaaggaaaaaattgtttgggtgcggttcgaaaatgccgacctcaacgatacatcccggaatctggaattccacgaaatacatagcacagggaacgaacctcctctgctgatcatgataggatactccgatgggatgcaggtttggagtattcctattagcggagaagctcaagagttgttcagcgtgcgccacggcccaattcgtgcagccagaatattaccagccccacaatttggcgcacaaaagtgtgacaatttcgctgagaagcgtcccctgctgggggtgtgcaagtctataggaagcagcggcacaagtccaccctattgttgcgtagacctctacagtctgcgtactggtgagatggtgaaatccatccaatttaagacaccaatttatgatctacattgtaacaagaggatcttagtagtggtcctacaagaaaagatagctgccttcgatagctgcacatttactaagaagttctttgtcaccagttgctacccctgcccagggccaaatatgaatcccattgccctcggatctcgttggttagcctatgctgaaaacaagctgatcaggtgccaccagtctagaggaggagcgtgtggagataacatccaaagctatactgcaactgtgatttccgctgcaaagactttaaagtcggggctgacaatggtgggcaaggtcgtaacacagttgacaggcacactcccttcgggagtcaccgaagacgacgtagccatccattcgaactcgagacggtccccattggtcccgggaatcattaccgtgatcgacaccgagaccgtcggcgaagggcaagtcctcgtgagcgaagactccgacagcgacggcattgtggcacactttcccgctcatgaaaagcctgtgtgttgcatggcttttaacacctctggaatgctattggtgaccacagatactctggggcatgacttccacgtgtttcaaattctgacacatccatggtcaagttctcaatgcgctgtgcaccacctttacaccttgcaccgaggcgaaacagaggcgaaggtgcaggacatttgcttcagtcacgactgtcgctgggtggtcgtgagtactcttcggggtaccagccacgtgttccccattaatccatacggcggtcagccgtgcgttcggacacacatgtccccacgagtggtgaaccgtatgagcagattccagaagagtgcgggactagaggagatcgagcaggagctgaccagcaaacaagggggtagatgctcgcccgtccccggactgagttcctccccatcgggtagtccactacatggtaagctgaacagccaggattcttataacaactttaccaacaacaatccaggtaatcctcgtttatccccactgccttctctgatggtagttatgccactcgcccagatcaagcaacctatgacactgggcacaatcaccaaaaggacaggcaaggtgaaaccaccaccgcagatttcccctagtaaaagtatggggggtgagttctgtgtggccgcaatcttcgggacttctcgctcgtggttcgctaataatgccggattaaaaagggagaaggaccagtcaaagcaggtagttgtggagtctttgtatattatcagctgttatggaactctggtggagcacatgatggaaccgagacctctgtcaaccgcaccaaagatctccgatgatacacccttggagatgatgacctctccccgagccagctggaccttagttcgcactccacagtggaatgaactccaaccacccttcaacgcgaatcatccattgctactggctgccgatgcggttcagtactatcagttcctattggcagggcttgttccccctggttctcctggacccattacgaggcacgggtcttacgattccctcgcaagcgatcattccggtcaggaagatgaggagtggttgagtcaggttgaaatcgtcacccatacagggcctcacaggcgcctttggatggggcctcagttccaattcaagaccattcatccatcaggacagactacagtgatcagttcatccagctccgtgctgcagagtcacgggccttctgatactccccagcccctgctggactttgacacagacgatctggacctgaactcactgcgcattcagcctgtcaggtccgacccagtctccatgccaggcagctctcgccctgtcagcgatcgcagaggcgtgagcacagtgattgatgccgctagtggcacctttgatagaagcgtcacactattggaagtctgtgggtcctggccagaaggctttggccttcggcacatgagttcaatggaacacacagaggaaggacttcgcgagcgtctggccgatgcaatggcagaatccccctcaagggatgtggtgggctcaggaactgagctccagagggagggctctatagagacattatcgaatagttcagggagtacgtcgggctcaattccaagaaatttcgacggataccgcagcccgctgccaactaacgagtcccagcctctcagcctgtttccgacagggtttccttag

SEQ ID NO: 29731 - DNA, 2160 bp, Artificial Sequence
  Description of Artificial Sequence: Synthetic coding sequence
atgggcttcagcaacatggaagacgacgggcctgaagaagaggagcgcgtagcggagccacaagccaactttaatacgcctcaggccctacgctttgaagagctgttggccaatttgctgaacgaacagcatcagatcgccaaggagctgttcgagcagctgaaaatgaagaaaccttcagccaagcagcagaaagaggttgaaaaagtgaaacctcagtgtaaagaggttcaccagaccctgatactggatccagcccaacgaaagcggctccagcaacaaatgcagcaacacgtgcagttgctgacacagattcatctgctggccacctgcaaccctaacctcaatccggaagcgtcatcgacgcgcatctgtctgaaagaattagggaccttcgctcaatcaagcatagctctgcaccaccaatacaaccccaagttccagactcttttccagccatgtaatctgatgggcgcaatgcaattgatagaggacttctctacacacgtctccatcgactgcagcccccataagacggtaaagaaaactgccaacgagtttccctgtctgcctaagcaggtggcttggattctggccacgtctaaggtgttcatgtatcccgagctgttgccagtgtgttcgctcaaagctaagaacccccaggataagatcctattcactaaagcggaagataataaatacctgctgacctgcaaaactgccaggcagcttacagttagaatcaagaacctgaacatgaatagagctcccgacaacattatcaagttttacaagaaaactaagcagctgccagtgctcggtaaatgttgcgaggaaattcagccacaccagtggaagccccctatcgagcgagaagagcacagactcccgttttggctgaaagcctctttaccatctatccaggaagagcttaggcatatggctgacggtgcacgagaagtgggaaacatgacgggtactactgaaatcaattccgatcagggactggagaaagataattctgagcttggaagcgaaaccagatacccactgcttcttcctaaaggcgtggtgctgaagctcaagcccgtggctgatcgcttccccaagaaagcctggcgacagaagagaagtagtgtcttgaaacccctcctaattcaacctagtccttcattacaaccatcttttaatcctggaaagacacctgctcagagtactcactctgaggcacccccatcgaagatggtcctcaggattccacaccctatccagccggctactgtgctccaaacggtgccgggagtaccgcctctaggcgtgagcggcggagagtcatttgagagcccagctgccttgcccgctatgcccccagaagcacgcaccagctttcctctgagtgaaagtcagaccctactgtcctcggcacccgttccaaaggtcatgatgcctagcccagcctcttctatgttccgtaaaccgtacgtgagaagaaggccaagcaagagaagaggcgctagggcatttaggtgcatcaaacctgcacccgttatccacccagcatctgttatattcacagtgcccgctacgacagtgaaaattgtcagccttggcggagggtgcaatatgattcagcccgtgaatgcggctgtggcacagtccccacagactattccaatcgccactttattagttaatcccactagctttccttgccctttaaatcaaccccttgttgcgagttcagtgtccccgctcatcgtatcaggcaactccgtgaacctcccaattccgagtacacccgaggacaaagcgcatatgaacgtggatatagcgtgcgccgtggccgatggcgaaaatgcatttcagggtctggagccaaaattagaacctcaggaactcagccctttgtctgcgaccgtgtttccgaaggtcgagcatagccctggtccgccaccagttgacaagcagtgtcaggagggcctgtctgagaattctgcttaccgctggaccgtggtaaaaacagaggaggggaggcaagctttagaaccgctaccgcagggcatacaagaatcactgaacaattcaagccctggagacttggaagaggttgtgaagatggaaccagaggatgccactgaggagatcagcggattcttgtag

SEQ ID NO: 29732 - DNA, 324 bp, Artificial Sequence
  Description of Artificial Sequence: Synthetic coding sequence
atgtcggtgctgcgtcctctggataagcttccagggttgaacaccgctaccatcctgctggtgggcactgaggacgcccttctgcaacagctagcagatagcatgctgaaggaagattgcgcttccgagctgaaagtacatctggcaaaatccctgcctctcccatcctctgtgaaccggccacggatcgacctgattgtgttcgtggtgaacctccacagcaagtacagcctgcagaacacagaagagtcgctgagacacgtagacgcctcttttttcttaggtaaagtgtgtttcttggccactggaggcggaaggctctag

SEQ ID NO: 29733 - DNA, 1599 bp, Artificial Sequence
  Description of Artificial Sequence: Synthetic coding sequence
atgttcgtgctgggcattccattatgccctgcactcagcttcagtgggggtgacgattcccagacacagctttttgtgagcagtaaagatgtgatcaaagaaattgaggattttgattctttggaggcattgcgcttggagggtaataccgtgggagtggaggcagccagggtgatcgcaaaagccctggagaagaagtccgagcttaaaagatgccattggtctgatatgtttactggtagactgaggacagagatcccacccgcactgatctccctgggggaaggtctgattacagctggcgcacagctggtggaacttgacctctcagataacgcatttggtccagacggggtccaaggatttgaggcccttttaaaatctagcgcctgcttcacgctgcaggaattgaagctgaacaactgtgggatgggaattgggggaggcaaggtaattggaactctggaagaagtgcatatgccccagaatggcattaatcatccaggcattaccgccctagctcaggccttcgcggtcaatcccctgttacgagtcataaacctgaatgataacacatttacggagaaaggcgcagtcgccatggctgaaactttaaagacactgcgacaggtagaggtaattaatttcggtgattgccttgtccgctcaaaaggagcggtggccatagcagacgcgatccggggtggtttgcccaagctgaaggaactaaatttgtccttctgtgaaataaaacgggatgctgccctggcagtagctgaggccatggccgacaaggccgagctcgagaagctggatctaaacggaaacaccttaggagaggagggctgcgagcagctccaggaagtccttgaagggttcaatatggctaaggtgctggcctccttgtccgatgatgaggatgaagaggaggaagaggagggagaagaagaggaggaagaggctgaggaggaggaggaggaggacgaggaagaagaagaggaagaagaagaggaagaggaggaggagccccagcaacgcggacagggggagaagtctgccactcctagtaggaaaatactggaccccaatactggggagccagcaccagtcctctcttccccacccccagccgacgtcagcacattcctggcctttcccagcccggaaaaactgctgaggctcggtcctaagagctctgtcttaatagcccagcaaactgacaccagtgaccctgagaaagtggtttcagctttcctgaaagtttcttctgtctttaaagatgaggccacagtccgaatggccgttcaggatgccgttgacgctctcatgcaaaaagcttttaatagctcttccttcaactccaatactttcctcacaaggctgctagtgcacatgggtcttctaaagtcagaagataaggtgaaagcaatcgcgaacctttacggtcctttgatggcgttgaatcacatggtgcagcaagactattttcccaaggcactggcacccttgctgttggcatttgtgacaaaacccaactccgccctcgaaagctgctcatttgcgcgacacagccttcttcagaccctgtacaaggtgtag

SEQ ID NO: 29734 - DNA, 1383 bp, Artificial Sequence
  Description of Artificial Sequence: Synthetic coding sequence
atggacagtgagctgatgcactcgatagtcggcagttatcacaagcccccagaaagagtttttgtgccttcgtttactcaaaatgagccttcccagaactgtcaccccgcaaatcttgaggtaacgagtccaaagattttacacagccccaattcccaggcactgatattagccttgaaaactctgcaggaaaaaatccacagactagagctggagcggacccaagcggaggacaacctgaacatccttagccgcgaggctgctcagtacaagaaagcccttgaaaatgagacaaatgaaaggaacttggcacaccaggaactgattaagcaaaagaaagacatttcaattcagctctcctcggcacagagtagatgtacactcctggagaaacaactggaatacacaaagcgaatggtcctgaatgtagagcgcgagaaaaatatgattctggagcagcaagctcaactccagcgagaaaaagagcaggaccaaatgaagctctacgccaaacttgaaaaactagacgtcctggaaaaggagtgtttccgactgactaccacacagaaaactgccgaggataagattaaacacctcgaggagaaactcaaggaggaagaacatcagcgcaagctttttcaagacaaggccagtgagctgcagactggcttagagatatctaaaattattatgtcatctgtctccaacctcaaacactcaaaggaaaaaaagaaatcctccaagaagaccaaatgtataaaacgtaggcctccgtggcagatctgcagcaagtttggggctctgccgttcgttgccgaaaagatgaggcagcacagagacccacacattttgcaaaagcccttcaacgtgacggagacccgttgcctgcccaagccatctagaacaacatcctggtgtaaagcaattccacccgactctgagaaatcaatctctatatgtgataacctgtccgagctgctgatggccatgcaggatgaattggaccagatgtccatggagcatcaggaattgcttaaacaaatgaaggaaactgagtcacactcggtgtgtgatgatattgaatgtgaactcgaatgtctactcaagaagatggagattaagggagaacaaatctccaaactgaagaagcatcaggactccgtgtgtaaattgcagcagaaggtacagaactcgaaaatgagtgaagcctcggggattcaacaggaggacagctatccgaagggcagcaagaatatcaagaatagccctcggaaatgtctgacagacacaaacctgttccagaaaaactcatcttttcatcccattagggtgcataatttgcagatgaagctccgtcgggatgacatcatgtgggagcaatag

SEQ ID NO: 29735 - DNA, 567 bp, Artificial Sequence
  Description of Artificial Sequence: Synthetic coding sequence
atgacagcgccatcctgtgccttccccgtgcagtttagacaacctagtgtctccggcctttctcagattactaagagtctgtacatttctaatggagttgccgctaataacaagcttatgttgagctccaaccagattaccatggtgattaatgtttctgttgaggttgtgaacacactctatgaagacatccagtacatgcaagtccctgtggccgattcacctaattcacgtctgtgcgacttctttgatccaatcgctgaccacatccatagcgtggagatgaaacaggggaggaccctgctgcactgcgctgctggggtgtcaaggagcgcagccttgtgcctggcctatctcatgaagtatcacgcaatgagcttgctggacgcacatacctggaccaaatcttgtcggccaattatccgcccaaacagtggattctgggagcagttaatacactatgagttccagttgttcgggaagaacaccgtgcacatggtatcctcgcccgtgggaatgattcctgatatctatgaaaaggaagttcgactcatgatacctctgtag

SEQ ID NO: 29736 - DNA, 1596 bp, Artificial Sequence
  Description of Artificial Sequence: Synthetic coding sequence
atgaataaaaccaatcaagtctacgccgctaatgaagaccacaacagccagttcattgatgattactcatcgtcagacgagtccctgtctgtgagtcatttttcattctcaaaacaaagtcacaggcccaggacaatccgcgatcggacgagtttttccagcaaattgccatcccacaacaagaagaattccaccttcattccaagaaaacccatgaagtgtagtaacgaaaaagtggtcaatcaggagcagtcatatgaaagtatggataaatttctggacggcgttcaggaagtggcctacatccattccaaccagaatgtcatcggaagctccaaggctgaaaatcacatgagccgatgggcagcccacgacgtcttcgaattaaagcagtttagccagttacctgcaaacatagctgtctgttctagtaaaacatacaaggaaaaagtcgacgctgataccctgcctcatacaaaaaaaggtcaacagccgtcagagggtagcatctctcttccattgtacatttctaaccccgtcaaccagaagaagaagaaggtttatcacacaaatcagacaacgtttattatcggcgaaacacccaaggggatccgcaggaagcaattcgaagagatggcctcctacttcaactcttcaagcgtgaacgaattcgccaaacacattacaaacgccacttctgaagaacgacagaagatgctccgggacttctacgccagccagtatccggaggtgaaagagttctttgttgactcggtcagccagttcaacaacagttctttcgagaaaggcgagcaacgcacgaggaagaaatcagacaaacgtgaatcacttattaaacctcgactgtcggactccgagactctctcctttaaggacagcacgaataagatctcccaagtgtgctcccttaaaacttacaagcggaagagcgtcaagttccaaaatcatatatcgtatcgggaagaggtctttttcaacgacgccgaaacaaagaaatccccagtgtcgtccactcaggaaattgattccgggaagaactctcaggcaagtgaagacacagtgacttctagatccctgaatagcgagagcgagacacgtgagcgccgactggagaataccatgaaggatcagcaggacctgacccgcacgggaatatcacgaaaggagcccctgctgaagttagagaacaagaaaatagaaaatcctgtgttagagaacacttcggttattagtcttctgggcgataccagtatcctggatgacctgttcaagtcacacggaaattcacctacccaactccctaagaaggtgttgtcaggacctatggaaaaagctaagcagagacctaaagatttttgggacatactaaatgagcagaatgatgagagcctgtctaaactgaccgatctggccgtcattgagaccctgtgtgaaaaagcaccgttggcggctcccttcaagcgccgagaggaacccgctacatcattatggaagtccaacgagaagtttttgtggaaaaaattttcgccctctgacactgatgagaatgctactaatacccagagcacaacctag

SEQ ID NO: 29737 - DNA, 1089 bp, Artificial Sequence
  Description of Artificial Sequence: Synthetic coding sequence
atgaccggacacactcgctcttctctgcccaggtgcaccggtattgtgttgctgattaaactgaggtttagcgaaagactaacaggacaccttcatgcacagggcaccccgccttatgtgatcaatctggaccccgctgtccacgaagttccattccccgcaaatattgacatccgggatacggttaagtacaaggaggttatgaagcagtacggcctggggccaaatggaggcatcgtaacctccctgaatctgtttgcgacccggttcgatcaggtcatgaaattcatcgagaaggcgcagaacatgagcaagtatgtgctgatcgacacacccggacagattgaagtgtttacatggtccgccagtggcactataattacggaggcattggcttcatcttttccgaccgtcgtgatctatgtcatggatacctccaggtcaaccaaccccgttacctttatgagcaatatgctctacgcttgttctatcctatataaaacaaagttgccctttatagtcgttatgaacaaaacagacatcatcgatcattcctttgctgtggaatggatgcaggatttcgaagcctttcaggatgcactcaatcaggagactacatacgttagcaacctgacccgctccatgagcctggtgctagatgagttctacagcagtctcagggttgttggtgtgtcagctgtgctagggactggccttgacgagttattcgttcaggtgacatctgccgcagaagaatatgagcgagaatacaggcctgagtacgagcgcctgaagaagagcctcgcaaacgcagagtcccagcaacagcgggagcagctagagcgactcagaaaagatatggggagcgtcgcgttggacgcaggcacagccaaagacagtttgtctcctgtgctacacccatccgatttgattcttacccgcggaacactcgatgaggaggatgaggaagcagatagtgacaccgacgacatcgaccaccgcgtcactgaggagtcccatgaggagccagccttccagaactttatgcaagaaagtatggcccagtattggaagcgaaataataaatag

SEQ ID NO: 29738 - DNA, 1338 bp, Artificial Sequence
  Description of Artificial Sequence: Synthetic coding sequence
atgagcgtgacatacgacgactcagtgggggttgaagtttcgtcagacagtttttgggaggttggaaactacaagcgcacagtgaagcgaatagatgacgggcaccggttatgttccgatttaatgaactgcctgcacgagcgcgctaggatcgagaaagcctacgcccagcagttgacggagtgggcacgccgttggagacaactggttgagaaagggcctcaatatggcactgtcgagaaagcatggatggcatttatgtcagaggccgagcgagtgtcagagctgcacctcgaagtgaaagcaagtcttatgaatgatgatttcgagaaaatcaaaaactggcagaaggaggccttccataaacagatgatgggaggattcaaggaaacaaaggaggccgaggatgggtttagaaaagctcagaaaccttgggccaaaaaacttaaagaggttgaggcggctaagaaggcacaccatgctgcctgcaaagaggagaagctagcgatctcgagggaggcaaattctaaggcagatccttctctgaaccctgagcagttaaagaagttgcaagacaagattgaaaagtgcaaacaggatgtgttgaagaccaaagaaaagtatgaaaaaagcctaaaagagcttgaccagggcacaccacagtacatggagaacatggaacaagtcttcgaacagtgtcaacagttcgaggaaaagcggctgaggttttttagagaggtgctcctggaggtgcagaagcacttagacctttctaatgtcgccggatataaggccatctatcatgatctcgaacagtctatcagggccgctgacgccgtggaggacctccggtggtttcgcgctaatcacgggccaggtatggccatgaactggccacagtttgaggagtggtccgctgatctgaatcgtaccttgtccagacgagaaaaaaaaaaggctactgatggcgtaacattaactgggattaatcagaccggtgatcaaagtttgccatcgaagccttcctctgtgtcatcttatgaaaaaactcagagttatcccacggattggtccgacgatgaatcaaataaccctttttccagcaccgatgctaatggagattcgaacccgttcgacgacgacgctacttccggcaccgaagtgagagtgcgcgcactatacgactacgagggccaggaacatgacgagctgtctttcaaagccggagatgaactgaccaagatggaggacgaggacgaacagggctggtgtaagggtcggctggacaacgggcaggtgggtctctatcctgccaattacgttgaggctatacagtag

SEQ ID NO: 29739 - DNA, 405 bp, Artificial Sequence
  Description of Artificial Sequence: Synthetic coding sequence
atgtctgagaatgccgctccagggctcatttctgagcttcttctccaaagaggtaccactaaagtggccactggccttgttctgaacagagatcagagattggcctgggcagagaatagtatcgacttcatcagtcgcgagctgtgtgcacatagcatcaggaagcttcaagcccacgtattattgattaaagctgtacacggatattttgacagtagacagaattattctgagaaggagtcccttagctttatgatcgatacaatgaaatcaacattaaaagagcagtttcaattcgtggaagtcccgggaaaccattgtgtgcatatgagtgagccccagcacgtggccagcataatcagctcatttctgcagtgtacacacatgctccccgctcagctgtag

SEQ ID NO: 29740 - DNA, 321 bp, Artificial Sequence
  Description of Artificial Sequence: Synthetic coding sequence
atgtcttccaagggaagttccacagacggccgtactgatttggctaatggctctctgtcatcttcccctgaggagatgagcggggcagaagagggccgtgagacgagttctgggatcgaagtggaagccagcgacctcagcctcagcctcaccggcgatgatgggggacctaaccgcacgagcactgaaagcaggggcacagacactgagtcttccggcgaggataaggatagtgactctatggaagatactggacactattccatcaacgacgaaaatcgggtacacgaccgatcagaggaggaggaggaggaggaatag

SEQ ID NO: 29741 - DNA, 990 bp, Artificial Sequence
  Description of Artificial Sequence: Synthetic coding sequence
atggttcgcaccaagacttggacgctcaaaaagcactttgttggttatccgaccaatagtgactttgagttgaagactgcagagctacccccactgaagaacggcgaggtactgttggaagccctctttctgaccgtcgacccttacatgagggtagccgctaaacgcctgaaggaaggcgacacaatgatgggccagcaggtagccaaagttgttgagtcgaagaacgtggccctgcctaagggtacaatcgtactcgccagcccaggctggacaacacattcgatttccgacgggaaagatcttgagaagctgctgaccgagtggcccgatactattccgctgtctctggccctaggaacagtcggcatgccgggactgactgcctattttggcctacttgagatctgtggggtgaagggaggcgagactgttatggtgaatgctgccgctggtgccgtggggagtgtggtgggccaaatcgcaaagctcaaaggttgcaaggtcgtgggagcggtggggtccgatgaaaaagtggcttatctgcaaaagttaggatttgacgtggtgtttaactataagactgtggagagtctagaggagacgctaaagaaagcctccccagacggatatgattgctatttcgacaacgtaggaggagaattcagcaatacagttattggccagatgaagaagttcggacgaatagcaatctgcggggcaatatcaacctacaatcgtacaggccctttgccgccaggccctccgcctgaaattgtcatttaccaagaactgcgaatggaggcctttgtggtgtatcgatggcagggcgacgctcgccagaaggctctcaaggacctcctgaagtgggtcctggagggcaagatccagtataaggaatacatcatcgaaggatttgagaacatgcccgcagcctttatgggtatgctaaaaggggataatctgggaaagacaattgtgaaggcgtag

SEQ ID NO: 29742 - DNA, 2235 bp, Artificial Sequence
  Description of Artificial Sequence: Synthetic coding sequence
atggctaccgccaatttcggaaaaatccaaatcggtatttacgttgaaatcaagcggtctgatggcaggattcatcaggcgatggtgactagtctaaacgaggataatgagtctgtgaccgttgaatggatcgagaatggggacacaaaaggaaaggaaattgatttagagagcatattctccctgaaccccgacctggtgccagacgaggagatagagccaagcccagagaccccccctccacctgcgagtagcgcaaaagtcaacaaaatcgtcaaaaatagaaggaccgtggcctctatcaagaatgacccaccaagtcgcgataatcgcgtggtgggtagcgccagagcaaggccctcccagtttccagagcagtccagctccgcacagcagaatggtagtgtctccgatatctctcccgtgcaagctgccaaaaaagaattcggccctccttctaggcgcaagtcaaattgtgttaaagaggttgaaaaactgcaggagaagcgagaaaagcggaggttgcagcagcaagaactgcgggaaaaacgggctcaggatgtggacgctacaaacccaaattacgaaattatgtgtatgatccgggactttagagggtcgctggactacaggcctctgacgacggccgacccaatcgacgagcaccgtatttgcgtatgcgtgcgcaaacgccctctgaacaaaaaagagactcaaatgaaagatctggacgtgataacaataccaagcaaggacgtggttatggtccacgagccgaaacagaaggtggacctcactcgttatctggaaaaccaaacattccgtttcgattatgcgttcgatgacagtgcgccaaatgagatggtatataggttcaccgctcgacctctggtggaaactatttttgaacgcggaatggccacctgttttgcctatggacagacagggtccggcaaaactcataccatggggggtgactttagtgggaaaaaccaggactgcagtaaagggatttacgctctggcagccagagacgtttttctgatgcttaaaaaaccgaactacaaaaagcttgaactacaggtgtatgcaacatttttcgaaatctatagcgggaaagtgttcgatttgttgaatagaaagaccaagctgcgggttctcgaagatggaaaacagcaggtgcaagtggttgggctccaggagcgagaggtgaagtgcgttgaagacgtgttgaaattaattgacattggaaactcctgccgaactagtggtcagacgagcgcaaacgcccactcttcccgatcccacgcggtcttccagatcatattgaggcggaaaggtaaacttcatggtaagttctcccttatagaccttgctggaaacgaacgaggcgctgatacaagcagcgccgatcgtcagaccagactcgagggggcagagataaataagtcactcttagcactaaaagagtgcatacgcgcactggggagaaataaaccccataccccgtttcgggcttccaaacttactcaggttctcagggactcctttataggggaaaattcaaggacatgcatgattgccaccatctctcctggaatggcctcctgcgaaaataccctcaatactctgagatacgccaaccgcgtgaaggaattcggcatctccccgagcgacattccgttcagtcagggatctgggtcaagacctgatctgtctccctcatacgagtacgatgactttagcccctcagtcactcgggtgaaggagctgactgtggatccaacagccgctggcgatgttaggccaattatgcatcatccccctaatcagatcgacgacctggaaacacagtggggcgtgggtagctcccctcaacgagatgatctcaagctcctgtgcgaacaaaatgaagaggaagtgtcaccgcagctgtttacattccatgaggctgtgtctcagatggtggagatggaggagcaggtggttgaagatcatagggccgtgtttcaggagtctattcgctggctagaggatgaaaaggccttactcgaaatgaccgaggaagtagactacgatgtcgactcgtatgctacacagctggaggctatcctcgagcagaagatcgatattctcaccgaactccgagacaaggtcaagtcctttagagctgcccttcaggaagaagagcaggcaagcaaacagattaatccgaagagaccccgtgccctgtag

SEQ ID NO: 29743 - DNA, 1701 bp, Artificial Sequence
  Description of Artificial Sequence: Synthetic coding sequence
atgttcgtctccgactttcggaaggaattttatgaagtggtgcagagccagcgcgtgcttctcttcgtggcctctgatgtcgacgccctgtgcgcatgtaagatcctgcaggcactgttccagtgtgaccacgtacagtacacacttgtgcccgtgagcggatggcaagaattagagaccgccttcttggaacacaaagaacagttccactactttattctgatcaactgtggggcaaacgtggatctccttgatatcttgcaacctgatgaggatactatctttttcgtgtgcgacacccacaggcctgttaatgtcgtgaacgtgtacaatgatacccagatcaagctgctgatcaaacaagatgatgatttagaagtacctgcatacgaggatatcttccgcgatgaggaggaggacgaggagcacagtgggaacgacagtgacggcagtgagccatctgaaaaacgcaccaggctggaggaagaaatcgtagagcaaacaatgagaagaagacagcggcgagagtgggaagccaggcgtcgggacattctgtttgactatgagcagtatgagtatcatggaacatccagcgctatggtgatgttcgagctcgcatggatgctgagcaaggacctcaacgatatgctgtggtgggccattgtgggactgaccgaccagtgggtgcaggataagattacccagatgaaatatgtaacagacgtgggagtgctgcaacgccatgtgagcaggcacaaccatagaaatgaagatgaggaaaataccttatctgtggattgtacccgcatttcattcgagtacgatttgcgcctggtgctgtaccagcactggtcacttcatgactccctgtgtaacacctcttataccgccgctcgcttcaaactgtggagcgtgcacggacagaaaaggctgcaggagttcctcgccgatatgggactgcccttgaaacaggttaagcagaaattccaggctatggatatcagcctgaaagagaatttacgcgaaatgattgaggagagcgcaaacaaattcggcatgaaggacatgcgggtgcagactttttctatccatttcgggtttaaacacaagtttctggccagcgacgtggtctttgctactatgtcattgatggaatctccggaaaaagatggttccggcaccgatcacttcattcaggcacttgatagtttatcccgctcaaacctagataaactataccacggattggagctggcgaagaaacagctgagggccactcagcagaccatcgcgtcttgtctctgtaccaatctggttatatcccagggcccatttctctactgttcgctgatggagggaaccccagacgtgatgcttttctcacgcccagcctccttatccctgctgtcgaagcacctgttgaagagttttgtctgttctaccaaaaatcgacgctgcaagctcctcccacttgtaatggctgcgcctttatccatggaacatggaacggtgacggtcgttggtatcccacctgaaaccgactcaagtgaccgcaaaaacttcttcggacgagcgttcgagaaggccgctgagtcgacttctagccgaatgctgcacaaccactttgacctgtccgtgatcgaactgaaagcagaagatcggtccaagtttctagatgccctgatcagcttgttgagctag

SEQ ID NO: 29744 - DNA, 798 bp, Artificial Sequence
  Description of Artificial Sequence: Synthetic coding sequence
atgtgcacatcagagactttccaagcacttgacacgttcgaggccagacacgacgatatcgtactcgcgagctatcccaagtgcggatccaactggatacttcatatcgtatctgaactgatctacgcagtttctaaaaaaaaatacaaatatcctgagttccccgtgttggagtgtggcgactcagagaaatatcagcgcatgaagggctttcctagtccaagaatactggcaacccacctgcattacgataaactgccaggatctatattcgaaaataaggccaaaatcctggtcatctttagaaatccaaaggatacagctgtgagcttcttacacttccataacgacgtccccgatattccctcctacgggtcttgggacgagttctttcgccaatttatgaaaggacaggtgtcatgggggagatattttgactttgccatcaattggaacaagcatctggacggcgacaatgttaaatttatactctacgaggacttaaaggaaaacctcgctgcaggcatcaaacagattgctgaattcctgggctttttcctgactggtgaacagatccagactattagtgtacagagcacattccaggctatgcgcgctaaatctcaagacacacacggggcagtcggcccttttctgttcagaaaaggcgaggtgggagactggaagaatttattcagcgaaatccaaaatcaggagatggatgagaagtttaaggagtgcctggcaggtacgtcgctaggagctaagctcaagtatgaaagctattgccaagggtag

SEQ ID NO: 29745 - DNA, 2808 bp, Artificial Sequence
  Description of Artificial Sequence: Synthetic coding sequence
atgaacgaggccatggctacggactcacctaggagaccctccaggtgtacaggaggggtcgtagtgcgtccccaggccgtaacagagcagagctacatggaatcggtagtgaccttcttgcaagatgttgtgccccaggcctactctggcactccgttgacggaagagaaagagaaaattgtgtgggtacggttcgagaatgccgacctcaatgatacatctcgcaacttggagtttcacgaaatccattccactgggaacgaacccccactgttaatcatgattgggtactctgatggtatgcaggtctggagcattcccatctcaggagaagctcaagagctcttttcagtacgccatggtcccatccgcgctgccagaatcctccctgcaccccagtttggcgcacagaaatgcgataatttcgcggagaagcgtcctctgctgggagtgtgtaagagtatcggaagctcaggaacttcccctccttactgctgcgtagatctgtacagcctgagaacaggagagatggtgaagtcaatacagtttaaaacacccatctatgatctgcattgtaataagcgcatcctggtcgtggtcctccaagaaaaaatagccgctttcgactcttgcactttcacaaagaaattttttgtgacaagctgttacccatgccccggtcctaatatgaatccgatcgctctgggaagccggtggctcgcttatgctgaaaacaaactcattcgatgccaccaaagcaggggtggggcatgcggcgacaatatccagagctacaccgccacagtcataagcgcagctaagactttgaagtccggtctgaccatggtgggtaaagtggtgacacaattgaccggcacccttccgtcaggtgtaaccgaggatgatgtagcaatccattccaactcccggaggtctccactagtgccaggcattattaccgtcatcgacactgagaccgtgggtgaaggccaggtcctggtgtcagaggattccgactccgacgggattgtggcccactttccagcgcatgagaaacccgtctgttgtatggcattcaatacttctggaatgctgctcgtgactaccgataccttgggtcacgactttcatgtgttccaaatcctgactcacccttggagctcatcccagtgcgcagtgcaccatctttacactctgcatcgcggagagacggaggcgaaggtccaggatatctgcttcagccacgattgtcgttgggtcgttgtctctacgcttcgaggtacctctcacgtgtttcctataaacccttatggaggtcagccatgtgttcgcacacacatgtccccgagagtggtcaataggatgtcccgcttccagaagagcgccggtttagaggaaattgagcaggaactcacctctaagcaaggcggtaggtgctctcccgtgccaggtctctccagttctccctcagggagtcctctccacggcaagctcaattctcaagatagctacaataattttacaaacaacaatccaggtaatcccaggctgagtcccctgcctagccttatggttgttatgcccctagcccagattaagcaaccaatgactctggggacgataactaagcggaccggaaaggtgaaacctcccccacagatcagtcccagcaagtcgatgggaggagagttctgcgttgcggcaatttttggtacaagcagatcttggtttgctaataatgcagggttaaagcgggagaaagaccagtccaagcaagtggtcgtggaatctctgtacatcatttcatgttacggtaccctggtggagcacatgatggagcctcgtcccttatccaccgcaccgaaaatatcagacgatacccccctggagatgatgacttcacccagggcttcttggaccctggtgagaactcctcagtggaatgagttgcagccaccatttaacgctaaccatcctttgctcctggccgctgatgcagtgcagtattaccagtttctgctggctggcctggttcctcctggttcacctggaccgatcacaaggcacggttcgtatgacagtctggccagcgatcacagcggacaggaggacgaggagtggctttcacaggtcgagatcgtcacccatacaggtccccataggcggctctggatggggccacagtttcagtttaagaccatccacccatccggacagactaccgtcatttctagcagtagctctgtactccagagccatggccctagtgatactccacagcctttgttagactttgacactgatgacctcgacctaaatagtttaagaatccaaccagtcaggtcagatccagtttctatgcctggaagcagcaggcctgttagcgaccgtaggggtgtctcgaccgttatcgatgctgcctctggtacctttgataggtccgtcactctgcttgaggtgtgcgggtcatggcctgagggcttcgggctaaggcatatgagcagcatggagcacacggaagaaggtctgcgggagaggctggctgacgccatggcagaaagtccttctagagatgtagtgggttccgggactgacaccgccttagatgtcgcagtgaagacttttccccctgaaagacacgtggccgttaagtgcttcgagctgcagcgcgagggcagcatagagaccctttctaattctagtggctctacctccggttctatcccacgaaattttgacggctatcgcagtccgctgcccactaatgagagccaaccactctcactattcccaacaggttttccctag

SEQ ID NO: 29746 - DNA, 615 bp, Artificial Sequence
  Description of Artificial Sequence: Synthetic coding sequence
atggaagccgctggatctcctgcagctactgaaacagggaaatacatcgccagtactcaacgtcctgatggtacctggaggaagcagcgcagggtcaaagagggctacgtgcctcaggaagaggtgccagtgtatgagaataagtacgtgaagttctttaaaagcaaacctgaactgccccctgggctgtcgcccgaagccactgccccagtgacccccagccgtcccgaaggtggggaacccggtttgagcaagacagctaaacggaatctgaagagaaaggagaagcgaaggcaacagcaagaaaagggcgaagccgaggcactaagccggacactggacaaggtctctttggaagagaccgcacagctgccaagtgcccctcaggggtcacgcgcagcccctacagcagcatctgaccagcccgatagcgccgcaacgactgaaaaggcaaaaaaaatcaaaaatctcaagaagaagctgcggcaagtggaggaattacagcaacgaattcaggcgggtgaggtatcccagccttctaaggagcagttggaaaagctggcgcgaagacgggctctcgaggaagagctggaagatctggagctgggactatag

SEQ ID NO: 29747 - DNA, 663 bp, Artificial Sequence
  Description of Artificial Sequence: Synthetic coding sequence
atgtccagcggaaattaccagcagtccgaggccctctccaagcctactttctccgaagaacaggcaagtgcactggtggagtcggtctttggacttaaagtctctaaagtgaggccgctacccagttatgacgatcagaattttcacgtttacgtgagtaagaccaaagacgggcctactgagtacgtcttgaagattagcaacaccaaggcctctaagaatcctgatctgatcgaggtccaaaatcatattattatgtttctaaaagccgctgggtttcctacggcatcagtgtgccatactaaaggggacaacactgcctccctggtgagcgtggatagcggctccgaaataaaaagttacctcgtgcgccttctcacatatctccccggacgacctatagcagagctacccgtgagtccgcaactgctgtacgagataggaaagctggctgctaagctggataaaaccttgcagagattccatcacccaaaactgtctagtttgcacagagaaaactttatttggaatctcaaaaacgttcctctccttgaaaaatatctgtatgcattaggacaaaacaggaatcgcgagatcgtggaacacgtcattcatctctttaaagaggaagtcatgaccaagttaagccacttccgagagtag

SEQ ID NO: 29748 - DNA, 603 bp, Artificial Sequence
  Description of Artificial Sequence: Synthetic coding sequence
atgtcttcagactctatggatcagccacggaatccctgcgagaacgaacctctgacaccaggataccatggattcccagcccgagatagccagggtaatcaggaaccaaccacaaccccagacgctatggtgcagccgttcacaaccattccgttccctcctccaccccagaacggtatccccactgagtacggcgtgccacatacacaggattacgccggtcagacaggcgagcacaatcttaccttgtatggctctacgcaggctcatggcgagcagtcttccaactcaccatctacgcaaaacggcagcttgactcagacagagggcggagctcagacagacgggcagcagtcccagacccagtcgtccgaaaattcagaatcaaaatccacccccaaaaggctgcatgtgtctaacattccttttagattcagagatcccgatttgaggcagatgttcgggcaattcgggaagatcctggatgttgaaataatctttaatgagcgagggtcgaaaggcttcggtttcgtcacatttgagaactcagccgatgctgatcgggcacgcgaaaagctccatggaaccgtcgttgaggggtag

SEQ ID NO: 29749 - DNA, 387 bp, Artificial Sequence
  Description of Artificial Sequence: Synthetic coding sequence
atggcgcctgccaaaaaaggaggtgagaaaaaaaaaggacggagcgctataaatgaggtggtcacacgggagtacaccatcaatattcacaaacggatccacggtgtgggtttcaaaaagcgggcaccccgtgctttaaaagaaatccgcaaatttgcaatgaaggagatgggaaccccagatgttcgcattgatacaaggcttaataaggcagtctgggcaaagggcataaggaacgtgccctacaggattcgggtcaggttgagtcgtaaacgcaatgaggatgaagactctccaaataagctttacacactggtcacttatgttcccgtgactactttcaagattagcgtgctgaacagcgtgaccgtggcaaaaagcccttag

SEQ ID NO: 29750 - DNA, 393 bp, Artificial Sequence
  Description of Artificial Sequence: Synthetic coding sequence
atggcgcctgctaagaaaggcggagagaagaaaaagggcagatccgccatcaacgaggttgtcactagagaatacaccatcaatatacacaagagaattcacggcgtagggtttaaaaaacgcgcaccacgcgctctgaaggagatcagaaaatttgccatgaaagagatgggcaccccggacgtacgcattgatactaggctgaacaaggctgtgtgggcaaaggggattagaaacgtgccataccggatccgcgtgagattgtcacggaagaggaatgaggatgaagatagtccaaataaattatatacactagtgacatacgttcctgtgacaacgtttaaaagcttacagaacgatgacctgtttaaaactgattgccaccaccagtag

SEQ ID NO: 29751 - DNA, 1524 bp, Artificial Sequence
  Description of Artificial Sequence: Synthetic coding sequence
atgtggttaacgtcgtaccctagcccgaacttcccggtgtctgtgcttcagaacggagttaagatgacaaacgaggctcctaagggactgcgggctaacattatcagaagttacctgatggaccccatttccgatcctgaattcttcggtagctgcaaaaagcccgaggaattcaaaaaactattgtacggcctgtgcttctttcatgcccttgttcaggaaagacggaagttcggcccactggggtggaatatcccgtacgagttcaatgagactgatcttcggatatcggttcagcagctccatatgtttctgaaccagtatgaggagctcccttatgaagccctacggtacatgaccggggaatgcaattacggcggacgcgtgaccgatgactgggacaggcgtactctccggtccatactgaacaaattctttaacccagagttagtggaaaactccgattataagttcgattcatcaggcatctacttcgtgcctccatctggagaccataagtcttatattgagtatacgaagaccctccctttgacacctgcccctgaaattttcgggatgaatgctaacgccgacatcactaaggatcagagcgaaacccagctacttttcgataatatattgctgacccaatccagaagtgcgggagctggagctaaaagcagcgatgaagttgtaaatgaggtggcttcagacattctgggcaagttacccaacaattttgatatagaagcagccatgaggcgctaccctaccacgtatacacaaagcatgaatactgtgctggttcaggaaatggggcgtttcaataaactcctcaaaactatacgcgattcatgtgttaatatacagaaggccattaaggggctggcagtgatgtccaccgacctcgaggaagtcgtgtccagcatcttgaacgtgaagatccccgagatgtggatgggcaaatcttatccctcactgaagcccctcggttcatatgtcaatgacttcctggcacgcctgaaattccttcaacagtggtacgaagtgggcccaccacccgtattttggttatcgggatttttcttcacacaagccttcctcaccggtgcccagcagaattatgccagaaaatatacgatccctatcgacctgcttggatttgactacgaggtcatggaggataaggagtataagcatccccctgaggatggggtgttcatacatgggctgtttctcgacggcgcatcctggaatcggaaaattaagaagctggccgagagccatcccaagatcttatatgatacagtgccggtaatgtggttgaagccatgcaaacgcgcagatattcccaaacgaccttcttacgtcgccccactctataaaacctctgaacgccgaggcgtgctctctacgactggccactccaccaactttgtcatcgccatgaccctgcccagcgatcagcctaaggagcactggatcgggaggggcgtagcattattatgccagttgaattcatag

SEQ ID NO: 29752 - DNA, 1683 bp, Artificial Sequence
  Description of Artificial Sequence: Synthetic coding sequence
atggcagcctccgcaaagcggaaacaagaggaaaaacatctgaagatgttgcgcgacatgacaggcctacctcacaaccggaagtgctttgattgcgatcagaggggaccaacttacgtgaacatgacagtcggctcatttgtctgtacgtcatgttctggaagccttagaggccttaacccacctcatcgagttaagagcatctccatgacaaccttcacccagcaggagattgaatttctgcaaaagcacggaaacgaggtgtgcaaacagatctggctgggactgttcgacgatagaagttctgcaatacccgacttccgggacccacagaaggttaaggagttcctccaggagaaatacgaaaagaaacgttggtacgtccctcctgagcaagccaaagtagtggcttccgttcacgcaagcatctcaggtagttccgcaagctcaacctcttctaccccagaagtgaaaccgttgaagtcgctcttgggagattctgcgccaactctccacctgaataaaggtacacccagccagagccccgttgtcggacggtcccaaggacaacagcaagaaaaaaaacagttcgacctgctctctgacctgggttccgatatctttgcagccccagcccctcagtcaaccgccaccgctaattttgcaaactttgcccatttcaactctcatgcagctcagaactccgcaaacgccgactttgcgaattttgacgcgttcggtcagtcttctggcagcagtaattttggaggttttcccacggcgagccattctcctttccagccacagactactggaggttctgcggctagcgtgaatgccaacttcgctcacttcgataattttccaaagtcgagctcagccgacttcgggaccttcaatacgagtcaatcacatcagactgcatccgccgttagcaaagtgtccaccaataaggccggtttgcagactgctgataagtacgccgcattggccaatctagacaacatcttctctgccggtcaggggggagatcaaggatctggtttcggtactaccggaaaggctcccgtgggctccgttgtgagcgtgccatcacagagcagtgcaagttcagacaagtacgctgcccttgctgagcttgacagcgtcttcagttccgcagccacctcaagcaatgcatacacctccacctcaaatgcctcgtctaacgtgttcggaacagttccagtggtggcaagcgcccagacacaaccggcttctagcagcgtacccgctccctttggcgctacaccatctacaaatccctttgttgccgctgcgggtcccagcgtcgcttcctcaaccaaccctttccaaacgaatgcccgaggcgctactgcagccacattcggaaccgcaagcatgtccatgcctacggggtttggtacacccgctccttactcacttcccacaagctttagcggcagttttcaacagccggcattcccagcccaggccgcttttccgcagcagactgctttttctcagcagcctaatgggtttgcagcctttgggcagactaagcctgttgtgacaccttttggccaggtggcagctgcaggagtttcatcaaatccctttatgaccggggcacccacgggccagtttcctacagggtcttcctccaccaacccctttctgtag

SEQ ID NO: 29753 - DNA, 2403 bp, Artificial Sequence
  Description of Artificial Sequence: Synthetic coding sequence
atgtcttccctgggagcctccttcgtacaaataaaatttgacgacctgcaattttttgaaaactgcgggggaggcagtttcggcagcgtgtacagggccaaatggatttcacaggacaaagaggtcgcggtgaagaaactgctgaagattgaaaaagaagcggagatccttagcgtccttagtcataggaatatcattcagttctacggagtgattctcgagccacccaattatggaatagtgacagaatacgcctcattaggtagcctctatgattacatcaactctaacaggtcagaggagatggatatggaccacatcatgacttgggctaccgatgtggctaagggcatgcattatctgcacatggaagctccggtaaaggtgatccaccgcgatctcaaatcgcggaatgtggtaatcgcggcagacggtgttctgaaaatttgcgatttcggcgctagcaggttccacaaccataccacacatatgtctttagtggggacattcccatggatggctcccgaggtcatccagtccctgccagtgtctgaaacctgtgatacctattcatacggtgtggtgttatgggaaatgttgacccgcgaggttccatttaagggactcgaggggttgcaggtggcatggctcgtggtagaaaagaacgagagattgactattccttccagttgccccaggagtttcgcagagcttttacaccagtgttgggaagccgacgcaaagaagcggccatcattcaagcaaatcatctccattctggaatccatgagtaatgacaccagcctcccagacaagtgcaattcatttctccacaacaaagccgagtggcggtgtgaaatcgaggctaccctagagagactcaagaagttggagcgggatctatcgtttaaagagcaggaactgaaagaaagggaaaggcgactcaagatgtgggagcagaaacttacagagcagtcaaatacaccactactgcccagcttcgagattggggcatggacggaagatgacgtctactgctgggtccagcagttagtcaggaagggcgactccagtgcagaaatgtcggtttacgcgagtctgttcaaggaaaataatattacagggaagagactgctgctcttggaagaagaagatttgaaagacatgggcatcgtgtctaaagggcacatcattcactttaagagcgctatcgagaagctaacccatgattatatcaatttattccacttccctccactgatcaaggatagcggaggagaaccagaggagaatgaggagaagattgtgaatttggagctggtgtttgggttccatctgaaaccaggtactggaccacaggactgtaaatggaagatgtacatggagatggacggggacgaaatcgctataacctatataaaagacgttacattcaatacaaacctgccggatgccgaaatcctgaaaatgacgaagcccccattcgtgatggaaaaatggattgtgggtatcgccaagagccagaccgtggagtgtactgtcacctatgagagcgacgttcgaacccccaagagcacaaaacatgttcacagtattcagtggagccggaccaaaccccaggacgaggtcaaggcggtgcagctagccatccagacactctttaccaactcagatgggaatccagggtcccgatcagatagctccgctgactgtcaatggttagacaccctccggatgaggcagatagcctccaatacgagtcttcaacgaagtcagagcaacccgatcttaggctccccattcttcagtcactttgacggccaggactcttacgctgccgcagtgcgcaggccccaggtacctattaagtatcagcagattacccccgtgaaccagtcccgatcttcaagcccaacacaatacggcttgaccaaaaacttctctagcctccacctgaacagccgcgatagcggcttttctagcggaaatacagacacaagttctgagaggggtaggtattctgatagatccagaaacaagtacggccgtgggagcatcagcctgaattctagccctaggggacgttatagcggaaagtctcagcacagcactccatcccggggtcgttaccctggcaaattttaccgggtgagtcagtccgcccttaacccacaccaatcaccagactttaagagatcaccaagagatctgcaccaacctaacaccatcccgggtatgcccctgcatcctgagaccgatagtagagcttctgaggaggactcaaaagtctcggaggggggttggacaaaagtggaatatcggaaaaagccccacagaccttcaccggctaagacaaacaaagagagagctagaggcgatcaccgaggctggcgtaacttttag

SEQ ID NO: 29754 - DNA, 144 bp, Artificial Sequence
  Description of Artificial Sequence: Synthetic coding sequence
atggatgatcaacaggccctgaactcaatcatgcaagatctcgccgtgctccataaagcctcgcgccctgccctatctctccaagaaactcggaaagctaaaagctctagtcctaagaaacagaatgacgtgcgcgttaagtag

SEQ ID NO: 29755 - DNA, 1272 bp, Artificial Sequence
  Description of Artificial Sequence: Synthetic coding sequence
atggtgagcttcatgaataatcaaaagcagcagaagcctacactgtctggacagcgttttaaaacccggaaacgtgatgaaaaggaacgatttgacccgacccagtttcaggactgtattattcagggcctgacagagaccggaactgatttagaagccgtggccaagtttctggacgcaagtggagcaaagctcgactaccgaagatacgccgaaactcttttcgatatcttagttgccggaggcatgctcgcacctggtggcactttagccgacgacatgatgaggaccgatgtgtgcgtgttcgcggcacaggaggatctggaaactatgcaagctttcgctcaagtgtttaataagcttatccgaagatacaaatatctggaaaaaggctttgaagacgaagtcaagaagctactcctattcctgaagggcttcagcgagtccgagcgcaacaagttggcaatgttgaccggggttcttttggccaacggtacattaaacgcctcaatcttgaactccctctacaatgagaatttagtcaaagagggggtcagcgccgcttttgctgttaaactcttcaaatcttggatcaatgagaaagatataaacgcagtagcagccagccttcgcaaggttagcatggacaataggctaatggaactcttcccagctaacaaacagtctgtggagcactttaccaaatacttcacagaggcagggcttaaggagctatccgagtacgtgcgtaatcagcaaactatcggggcaaggaaggagttacaaaaagagctccaagagcaaatgtctaggggagatcccttcaaggatattatactctatgtcaaggaagaaatgaaaaaaaataatattccagaaccagttgtgatcgggatcgtttggtcctcagtcatgagtaccgttgagtggaacaagaaggaagagctggtggccgaacaggctattaagcacctcaaacagtacagccccttactcgccgctttcaccacccaagggcaatccgaacttacactgctgctgaaaatccaggaatactgttacgacaatatccattttatgaaggcatttcaaaagatcgtggtactgttctataaggccgaggtcctgtcggaagaaccaattctcaagtggtacaaggatgctcacgtcgctaaaggtaagtcggtttttttggaacagatgaaaaagtttgtcgagtggttgaagaacgcagaagaggagagtgaatccgaagccgaagagggagattag

SEQ ID NO: 29756 - DNA, 1119 bp, Artificial Sequence
  Description of Artificial Sequence: Synthetic coding sequence
atgtcccggagaaggttcgactgtcggtccatttcgggactgctgacaacaacgcctcaaattcctatcaaaatggaaaattttaacaatttctacatccttaccagcaaggagctgggcagaggaaagttcgccgtcgtcaggcagtgtatctctaaatccaccggccaggagtatgctgcgaaatttctgaagaaaagaaggcggggtcaggactgccgtgccgagatactgcatgagatcgccgttctggagctggccaagagttgtccgcgtgtcataaatcttcatgaagtatatgagaatacttccgaaatcattttgatacttgagtacgcggctggcggagagatctttagtttgtgtctccccgagttagccgaaatggtgtctgagaacgatgtaatcagattaattaaacaaatactcgagggcgtgtattatttgcatcaaaacaacatagtgcaccttgacctgaagcctcagaacattctcctgtcatcaatttatccactgggggacataaagatcgtcgattttgggatgtcacgcaaaatcggtcacgcctgtgagctcagggaaatcatgggtactcctgagtacctggccccagagatcctcaactatgacccaatcaccacagcaaccgatatgtggaatatcgggatcatcgcttatatgttgctgacacatacctctccttttgtaggtgaggataaccaggaaacctatctcaatattagtcaggtaaacgtggattactccgaggaaactttttctagtgtatctcaactggcaacagactttatccagtcgctgcttgtcaaaaacccagagaagagacccaccgcagagatttgcctctcacattcatggctgcagcagtgggatttcgagaacctctttcaccctgaggaaacgtcgagctccagtcagacccaagaccatagcgttagatctagcgaggataagactagcaagtcctcctgtaatggcacttgtggtgatagggaggataaggagaacattcccgaggattcatccatggtcagcaaaagattcagattcgacgacagcctgcctaatccccacgaactggtaagcgacttactgtgttag

SEQ ID NO: 29757 - DNA, 912 bp, Artificial Sequence
  Description of Artificial Sequence: Synthetic coding sequence
atgatggacgtctctggcgttggctttccgtcaaaagttccctggaagaaaatgagcgctgaggaactggagaaccagtattgtccctcccgctgggtagtacggctgggggcagaggaggcccttcgtacatactctcagatcgggattgaggctacaacccgggcacgcgcaacaaggaagtcactattgcatgtaccgtacggagatggcgagggagagaaagttgacatctactttccggacgagtcatcagaagccctgccgttctttcttttcttccatggtggctattggcagtccggctcaaaggatgagagcgccttcatggtacatcctttaaccgcccaaggggttgctgtagtcatcgtggcctacggaatcgcacccaagggaacattagatcacatggtcgatcaggtgacgagatctgtggctttcgtgcagaagagatacccaagtaataagggtatctatctctgtggccactcagccggtgcccacctggccgctatgatgctgttagcggactggacgaagcacggtgtaacccctaatttaagaggcttctttttggtgtctggcgtgtttgatttggaaccaatagtttatacctcacagaacgtggctctacagctaacgttagaggacgcccagcgtaatagccctcagcttaaagtggcccaggcacagccagtggatcccacctgtcgcgtgttggtagtggtcgggcagttcgattctcccgagttccaccggcagagttgggaattctaccagaccctctgtcagggggaatggaaagctagctttgaagaactccatgacgtggaccacttcgagattgtggagaacctaacccagaaagacaatgttcttacgcagattatcctcaagacaatctttcagtag

SEQ ID NO: 29758 - DNA, 684 bp, Artificial Sequence
  Description of Artificial Sequence: Synthetic coding sequence
atggctctccacgacatggaggattttacctttgatggtacaaaaaggttatcggttaactatgtgaaagggatcctacagcccactgacacctgtgacatctgggacaaaatctggaacttccaagcgaagccggatgacctccttatttccacttaccctaaggctggcaccacttggacccaagagattgtagagctgatccagaatgagggcgatgtcgagaaatcaaagcgggcacccacgcaccagcgtttcccctttctggagatgaagattccctctctcggctctgtctgctggggtagttggcatgagcacgtcaaaggctggtgggaggccaaggacaaacatcgcattctgtacctgttctacgaagacatgaagaagaacccaaagcacgagatccagaaactggctgagttcatcggcaaaaagttagacgacaaggtactcgataagatcgtccactacacctcatttgatgtgatgaaacagaacccaatggcaaactatagttccatcccagccgaaatcatggatcacagcatctcccctttcatgcgcaagggagccgtcggcgactggaaaaaacattttaccgtagcccaaaatgagcggttcgatgaggactacaaaaagaagatgacagacacgcgcttaacctttcacttccagttctag

SEQ ID NO: 29759 - DNA, 366 bp, Artificial Sequence
  Description of Artificial Sequence: Synthetic coding sequence
atggcacccgctaagaaaggcggagagaagaagaaaggcagatctgccattaacgaggtggtaacgcgggaatacacaataaatattcataagcgaattcacggagtcggttttaagaaacgagctcccagggctctgaaagagatcagaaaatttgcaatgaaagagatggggactcctgacgttcgaatagatacaagactgaataaagccgtgtgggccaagggaattcggaacgtaccgtacaggatccgagtgagactgtcaagaaaaaggaatgaggacgaggactctcccaacaagctatatactctcgtgacctacgtgccagttactacatttaagtccaagttttccattccttag

SEQ ID NO: 29760 - DNA, 267 bp, Artificial Sequence
  Description of Artificial Sequence: Synthetic coding sequence
ctgagctttcgggctgattccgcacacgccagcatggtcaacgtgcccaagacaaggcgaacgttctgcaaaaaatgcggcaaacaccagccgcacaaagttacacagtacaaaaaaggtaaagatagtctgtacgcacaagggaagagaaggtacgatagaaaacagtccggctacgggggacagaccaagcccatcttccggaagaagcttcatcaaaattgcattgaaccgaaccttccgcctagagcccagcaatctccctag

SEQ ID NO: 29761 - DNA, 582 bp, Artificial Sequence
  Description of Artificial Sequence: Synthetic coding sequence
atggattcgaccttggcagtgcagcaatatatccagcagaacatcagagcagattgctcgaatattgataagatcctcgagcccccagagggccaagacgaaggagtatggaagtatgagcatctcaggcaattctgcctcgaacttaacggacttgcagtgaagctccagtctgagtgtcaccctgacacgtgcacgcagatgaccgctactgagcagtggatattcctgtgtgccgctcataagactccgaaggagtgccccgctatcgactacacccgacacactctggatggagccgcttgcctgctcaactctaataagtacttcccctccagagttagcatcaaagaaagttctgtggctaagctgggctcagtttgtagaagaatttatcgaatcttctcccacgcatactttcaccacagacagatctttgatgagtatgagaacgaaacattcttatgccacaggtttaccaagttcgtcatgaagtacaacctgatgagtaaggataatctgattgtcccaattctggaagaggaggttcagaactctgtctcgggcgagtctgaggcctag

SEQ ID NO: 29762 - DNA, 4137 bp, Artificial Sequence
  Description of Artificial Sequence: Synthetic coding sequence
atgtctctggaacgggagctgcgccagctcagcaaggcgaaagccaaggcccagagagctggacaaagacgcgaagaggcggcactctgtcaccaactcggagagctgttggctgggcatggacgttacgcggaagctctcgagcaacactggcaggaactccaacttcgcgagagagctgacgaccctctggggtgtgccgtggcacatagaaaaattggggaaaggttagctgaaatggaggactacccagccgctctgcaacaccaacatcagtatctggaactggcccactccctgagaaaccacaccgagctacagcgtgcttgggcaacgattggacgcactcacttggatatatatgaccactgtcagtcgcgcgacgcactcctgcaagcccaggccgcttttgaaaagtctctggccattgtagacgaagagcttgaagggaccctggcacaaggagagctgaatgaaatgaggacacggctttacctcaatctgggacttacattcgaaagccttcaacaaaccgctctttgcaacgattacttccggaagtctatattcctggcagagcagaatcatctctacgaagacctttttcgggctaggtacaacctcggtaccattcactggagggccggacagcacagtcaagccatgcgatgcctcgagggtgcacgggaatgtgcacatactatgaggaagcgattcatggagagtgagtgctgcgtggttattgcacaagtcctacaggacctgggcgacttcttggccgcaaagcgggcactgaagaaagcataccgcttggggagtcagaagcccgtccaaagggcagccatatgccaaaacctacagcacgtcctcgcagtcgtccgcctccagcaacaactcgaggaggcagaaggccgagatccccagggcgctatggtcatttgtgagcagctgggggacctgttttccaaggcaggtgacttcccaagggctgccgaggcttaccaaaaacaactgaggtttgctgagttactcgacaggcctggggctgagcgagctatcatccatgtgagtctggccaccacgcttggcgatatgaaggatcatcatggagccgtccggcattatgaggaagaactgagattaaggtctggtaacgttttggaagaggcgaaaacatggctgaacatcgcacttagtcgcgaggaagcaggagacgcttatgaactgttagccccttgttttcagaaggcgctgagctgtgcgcaacaggcgcaaaggccacagctacagcgtcaggtcctccaacacttgcacaccgtacagctgagactccaaccccaggaggcaccagaaaccgagactcggctccgggagttatccgtcgctgaagatgaggacgaggaggaagaagcagaggaagctgctgctactgctgagtcggaagctttagaggcaggggaggtcgagttgagtgagggggaggatgataccgacgggcttacaccccagttagaggaggacgaagagctacagggacacctcgggaggaggaagggatccaaatggaaccgcaggaacgacatgggcgaaactctgctgcaccgagcctgtatcgaaggacagttgaggcgtgtccaggacctggttagacagggtcatcctctgaacccccgtgactactgcgggtggactcccctgcacgaggcgtgtaactatggccacctggagatcgtgagattcttactggatcacggtgccgcagtggacgatcctggaggtcagggctgtgaaggaatcactcctctccatgatgcattgaactgcgggcacttcgaggtggccgaactgctattggagcgaggtgcgtccgtgacactgcggaccaggaaaggcctgtccccactggaaactttgcagcagtgggtcaagctttatcgcagggatctggatttggaaacccgtcaaaaagcaagagcaatggaaatgctcctgcaggccgctgccagtggccaggaccctcacagcagtcaagcatttcacacacccagcagcctcctttttgacccagaaacaagtcctcctctgagcccatgtcccgagccgcctagcaactcaactcgcctgcctgaggcttcgcaggcccatgttagagtgagtccaggacaggccgctcccgctatggcacgtcctcgtcgctcccggcatggacccgcatcttccagcagcagcagtgagggggaggatagtgctggacccgcacgaccctcccagaagcggccacgctgctccgccacagcacagagagttgcagcttggaccccaggtccagctagtaaccgcgaggccgcaacagcatcgacaagccgggctgcttaccaagccgctatcagaggggttggtagcgctcagagccggctcggaccaggtccgcctagaggtcactccaaagccctggccccacaggctgcccttatacccgaggaggaatgcctagctggggactggcttgaactggacatgccgctgactaggtctcgaagaccacggcctcggggaacaggcgacaatagaaggccgtccagcacaagcggatctgactccgaagagtctcgcccacgcgcacgggcaaagcaggttcgtctcacttgcatgcagtcctgttccgcacccgtcaacgctgggccatcttcattggctagcgagccgccaggcagcccaagcacccctagagtgtcggagccctctggtgacagttccgcagctggccaacctctgggacctgccccacctccccctatccgtgtgagagtgcaagtgcaggaccatctgttcttaatccccgtgcctcactcttctgacacacatagtgtggcctggctggctgagcaggcggcacagagatactatcagacatgcggcttactccctcgactgacactccgcaaggagggggcactgctggccccacaagatctgattcccgacgtgctgcagtcgaatgatgaggtcctggcagaggtgacttcctgggatctgccacccctgacagaccggtatcggcgagcctgtcagtccctgggtcagggcgagcatcagcaggtgctacaagctgtcgagctgcaggggttaggcctctcattcagcgcttgctccttggctttagatcaggcacagctgacacccctgttgcgagctctgaaactccataccgccctgagggaactgaggctagccggtaaccggctcggcgataaatgcgtggccgagctcgtggctgcacttggcacaatgccttccctggctcttctagacctcagctccaaccatttaggcccagagggattacgacagctagccatggggcttcccggacaagctacgttgcagtccctcgaggaactcgatctatccatgaacccacttggggacgggtgcggacagtcactcgcctccctcctccatgcatgccccctgctttccacattgagattacaggcttgtggctttggtccaagcttttttctcagccaccagactgccctggggtctgccttccaggatgctgagcacttaaaaaccctttctcttagctacaatgccctcggcgcaccggctctggctcggacactccagagcttgccggcaggcacattgctgcacttggagctgagtagtgtggctgccggaaaaggggacagcgacttgatggagccagtgtttagatacctcgcaaaggaaggttgcgcccttgcgcacctcactcttagcgcaaatcacctgggcgacaaagccgtgcgcgacctctgtagatgcttaagcttgtgtccttctctgataagtctcgatttatcagccaatcctgagatctcatgcgccagcctggaagagttgctaagcactttgcaaaaacggccacaaggcctgagtttcctgggcctcagtgggtgtgcagtgcaaggccctttaggtctgggcctatgggataaaattgccgcacagttacgggaattgcaactctgtagtaggaggctatgcgctgaggatagagacgccctgcgacagctccaaccttctagacctggtcctggcgagtgtacacttgatcacggctctaaactgttcttcaggaggctctag

SEQ ID NO: 29763 - DNA, 1218 bp, Artificial Sequence
  Description of Artificial Sequence: Synthetic coding sequence
atgaattaccaacaacaactcgcgaacagtgctgccattagggccgagatacagcgttttgagtctgttcaccccaatatttactccatatacgaactgttagaaagggtcgaggagccagttctgcagaaccagattagagagcatgtcatcgccatagaagacgccttcgtgaacagccaggagtggacgctctccagatcagtgcccgaactgaaggtagggattgtaggaaacctagcctcgggtaagtccgccctggtccaccggtatctgaccggcacatacgtgcaggaggaatctccagaaggtgggcgattcaagaaagaaattgtcgttgacggacaaagttatctactgctgataagggatgaaggaggaccgccagaagctcagtttgcgatgtgggtggatgcagtcatattcgtattctctctagaagatgaaatctcctttcagactgtgtaccactattactctcggatggctaactaccgaaataccagcgagatccctctcgtacttgtgggcactcaggacgctatttcatccgctaacccgagagttattgacgatgctagagctcgcaagctgtcaaacgacttgaaaagatgcacctattacgaaacatgcgcaacttatggtctcaatgtggaacgcgtgttccaggatgtcgcccagaaaattgtggctacccggaaaaagcagcagctgtcaataggcccatgtaagtctttgcccaattctccctctcacagctccgtgtgcagcgcgcaggtgtctgccgtgcatatctcccagacctctaacggcggagggtcactgtctgattatagttcttccgtgcctagcaccccatcaacttctcaaaaggaattgaggatcgatgtcccccctaccgcaaatacacccacccccgtgagaaaacagagtaaacgcagatccaacctcttcacctctcggaaaggatcagaccccgacaaggagaagaaaggcctggaaagccgggctgactctatcggatcaggccgagctattcccatcaagcagggcctgccattctttgttctcgccttaactgcttcaacttacttgcgccctgcaggagccagggccagacagtcctctccctggcctggtccgaggggaggccaaactagcccacactgtgcggagggccctcagagcgcacagctgagtggagcaatgatgaactag

SEQ ID NO: 29764 - DNA, 1245 bp, Artificial Sequence
  Description of Artificial Sequence: Synthetic coding sequence
atggctgccgctcctccctcctattgttttgtcgcctttcctcctagggccaaggatgggctcgtggtcttcgggaaaaattccgccaggcctcgggatgaagtgcaggaggtagtttacttttccgcagcagatcacgaacccgaaagcaaagtggagtgtacatacatatctattgaccaggttcctaggacctatgcaataatgatttctcggccagcatggttatggggcgctgagatgggagccaatgagcatggcgtgtgtatagccaatgaggccataaacactcgagagcctgcggcagagatcgaggccctactgggaatggatttggtccgcctgggcctggaacgtggcgaaacagccaaagaggccttagatgtaattgtgtcactgttggaagagcatggacagggcggaaattatttcgaggatgccaattcctgtcacagctttcaaagtgcatatctaatcgtggatcgcgatgaggcttgggtgcttgagacgataggcaagtattgggcggctgaaaaagtaactgaaggagtgcggtgcatctgttctcaactgtcactaaccactaagatggacgccgagcaccccgagttgcgatcttatgcacaatcccaaggatggtggaccggcgagggcgagttcaacttctccgaggtgttcagccctgtggaggatcacctggattgtggtgctggaaaagactcccttgagaagcaggaagaatcgatcactgttcaaacaatgatgaataccttgcgcgacaaagctagcggggtgtgcatagacagcgaattctttcttactactgcctccggagtgtccgtgctacctcagaaccggtcctccccttgcattcactacttcacagggacacctgatccctccaggagcattttcaaacctttcatctttgtagatgatgttaagttggtgcctaaaactcagagcccgtgttttggtgacgacgatcccgctaaaaaagagcctcggtttcaggagaagcccgaccgcaggcacgaactttacaaagctcacgaatgggccagagccatcattgagagtgatcaagaacaagggcgaaagctgcgatcaaccatgttggagttggagaagcagggcctagaggctatggaggaaattcttactagcagcgaacctcttgatcctgcagaggtcggcgacctgttttatgattgtgtcgatacagaaatcaaattcttcaagtag

SEQ ID NO: 29765 - DNA, 645 bp, Artificial Sequence
  Description of Artificial Sequence: Synthetic coding sequence
atgggacccttgccaaggactgtcgaactattctatgacgtcctttccccatactcttggttgggattcgagattctgtgccggtaccaaaatatttggaacataaacctgcaactgcggccttccctgatcacgggcatcatgaaagattcagggaataagccccctgggctgctgcctagaaagggactgtacatggcaaacgatctcaagctcctgcgccaccacctccagatccctattcatttccccaaggacttcctgtccgtgatgttggagaaggggtcactgagcgctatgcgatttctgactgctgtaaatctggagcacccagaaatgctggaaaaggctagtcgagaactgtggatgagggtgtggtcccgggcagcagaaaaagcagggatgtctgcagagcaggcgcagggattgctggagaaaatagcgacgcctaaggtgaagaaccagctgaaagagaccactgaggcggcatgccgatacggtgcatttggcctcccaattactgtcgcgcacgttgacgggcagacgcacatgctgttcggaagtgacaggatggagcttctagcacacctcctcggggagaaatggatgggcccaattcctcccgctgtgaatgccaggctttag

SEQ ID NO: 29766 - DNA, 4206 bp, Artificial Sequence
  Description of Artificial Sequence: Synthetic coding sequence
atggccgataccgatcttttcatggagtgtgaggaggaagaactggagccttggcagaagatctccgacgtcatagaggattcagtcgtggaggattataattccgtagacaaaacgaccacggtttcagtctctcagcaaccagtttccgcacctgtgcctattgccgcacatgcatctgtggctggccatctgtccacgtcaaccactgtcagctccagcggcgctcagaattccgatagtactaagaaaaccctggtgacccttattgccaacaataacgctgggaacccactcgtacagcagggcggacaacccttgattctaacccaaaacccggcacctggtctgggcaccatggtgacacaaccagtgcttagaccagtacaggtgatgcagaacgccaatcatgtaacctctagcccggttgcctcgcagccaatattcatcacaacacaaggattccccgtgcggaacgtccgtccagtgcagaacgctatgaaccaagtgggtatcgtgctgaatgtccagcagggccagacagtgaggcctattacactcgtgcccgcacctgggactcagtttgtaaagccgactgttggagttccacaagttttttcacagatgactccagtaaggcccggatctacgatgcccgttagacctactacaaatacctttacaactgtcatccccgcaactcttaccatccgatctacggtgccccaaagccagtcccagcagacaaaatcaaccccctccactagcacaacccccaccgcgacccagcctacctctctggggcagctggccgtccagagccccggtcagtctaaccaaacaactaatcctaaacttgtctctatagcctccttcgtgaccgtcaagcgtccaggagtcacgggagaaaattccaacgaggtcgccaaattggttaataccctcaatacaattcccagcctgggccaatctccagggcctgtggtcgtgagcaataactcctccgcccatggatctcagagaacttctggtcccgaatcatccatgaaggttaccagttcaatcccagtgtttgacttgcaagacggcggaagaaagatctgcccccgatgtaatgcccaattccgagtgacggaggccctgcggggacatatgtgctactgctgtcccgagatggtcgagtaccaaaagaagggaaaatctctggactcagagccttccgtgccctccgccgctaagccaccctctcccgagaagacggcgcctgtcgccagcactccctcttctactccaatcccagcattgtctcctcccaccaaagtgccagagccaaacgaaaatgtcggggatgccgtccagacaaagcttataatgctggtagatgatttttattacggcagagatggaggaaaggttgcccagctcaccaactttcccaaggtggccactagctttcggtgccctcactgtaccaagcgactgaaaaacaacattcgcttcatgaaccacatgaagcatcacgtcgaactagatcaacaaaacggcgaggtcgacggtcacaccatctgtcaacactgctatagacagttctcgacccctttccagctccagtgccatcttgagaatgttcactcaccctatgagtccacgactaagtgcaagatatgcgagtgggcttttgaatctgagcccctcttcctccagcatatgaaggatacacacaaacctggtgaaatgccctacgtctgccaggtttgccagtataggtcatccctgtattcggaggtagatgtccactttcggatgatccacgaggatacgcggcacctcctctgtccctactgcctcaaggtgttcaagaatggcaacgctttccagcagcattacatgagacatcagaagcgcaacgtctatcactgcaataagtgccggctgcagttcctgtttgccaaggacaaaattgaacataagctccagcaccacaagactttcagaaagcccaagcagctggaggggctaaaaccaggtaccaaggtgactatcagagcctctcgcggacagccccgaacagttccagtgagctcaaatgacactcctccctcagctctgcaagaggctgcccctctcactagcagtatggatccactacccgtgtttttgtatcctcctgtgcagcggtccattcagaaaagggccgtgcgaaaaatgagcgtgatgggcaggcagacctgtttggaatgctctttcgagatacccgattttcctaaccacttccctacatatgtccattgcagtctgtgcagatacagcacatgctgctctagagcttacgcaaatcacatgatcaacaatcacgtgcccaggaagtccccgaaatatctggcgttgttcaagaactccgtgtcgggcataaagttggcttgtaccagctgcactttcgtcacaagcgtgggagatgccatggcaaagcatcttgtctttaacccaagccatcgctcctcctctatcttaccccgtggattaacttggatcgctcactctagacatgggcagacccgcgaccgcgtccatgaccgaaacgtcaagaatatgtaccctccacccagcttccccaccaacaaggccgcaacagtgaaatctgccggagccacgccagccgagcccgaagagttgctgacaccgttagcacctgctcttccgtctcccgctagcaccgccactcccccacccactcccacccacccccaagcactggccctccccccactcgcaaccgaaggggctgaatgtctcaatgtagatgaccaggacgagggtagcccagttacccaggagcccgagctggcatctgggggtggaggaagcggaggtgttggaaagaaggaacagctcagcgtgaaaaaactgagagtcgtcctgttcgccctctgctgcaatacagagcaagccgctgagcattttaggaacccacaacgtcgcatacgccgttggctacgacgcttccaggccagccagggcgaaaatctggaaggtaaatacctttcctttgaggctgaggaaaagctggcagagtgggtgttgactcagcgggagcaacaattgcctgtgaacgaggaaactcttttccagaaggccaccaagatcggtcgttctctagagggcggtttcaaaattagctatgagtgggccgtgcgctttatgctgcgccaccacttgactccacatgctcggagagccgttgcacacacgctgcccaaggacgtggccgaaaacgctggcctgttcatagatttcgtgcaaagacagatacataatcaggatttaccgcttagtatgatagtcgcaattgacgaaatttctctgttcctggacaccgaggttctgagctctgatgatcggaaggagaacgcccttcagaccgtgggcacaggagagccctggtgcgacgtggtgctcgccatcctcgccgatgggacagtgcttccgactctggtgttctaccggggtcagatggaccagcccgctaatatgcccgatagcatccttctggaagcaaaggagagcggatatagtgatgatgagatcatggagctttggtctaccagggtctggcaaaagcataccgcgtgccaacggtctaagggtatgctggtcatggattgccatcggacgcacctttctgaggaagttctggccatgctgagtgcgtccagcacactgcccgcagttgttcccgctggatgttcgagtaaaattcagcctttagatgtgtgtataaaacggacggtgaagaactttctccacaagaaatggaaagaacaggccagggagatggccgataccgcctgcgatagcgacgtgctcctccaacttgtgctggtgtggttaggggaagttctgggggtgatcggcgattgccccgagttggtacagagatcctttctcgttgcctccgtactacccggacctgatggtaatatcaattcaccaacgagaaatgcagatatgcaggaagagttgatcgcaagtctggaagagcaactgaagctaagcggtgagcatagtgaatcctccactccacggccacgaagcagtcccgaggaaacaattgaacctgagagtctccatcaactgtttgagggagagtctgaaactgagtccttttacggatttgaagaagccgacctcgacctgatggagatttag

SEQ ID NO: 29767 - DNA, 1398 bp, Artificial Sequence
  Description of Artificial Sequence: Synthetic coding sequence
atggaaccttccagtctggagctcccagcagacaccgtgcagcgcatcgctgctgaattgaaatgtcaccccacagacgagagagtggcccttcatctggacgaggaggacaaactgagacacttccgcgagtgtttttatataccgaaaattcaggatttacctccagtggatctgagcctagttaataaggacgagaacgccatatactttttaggcaattccctaggcctgcaaccaaagatggttaagacttacctcgaagaagagcttgacaaatgggcaaaaatagcagcatatggtcacgaggtcggtaaacgcccttggattacaggtgacgaatcaatcgtgggactcatgaaagatattgtcggagccaatgagaaagaaatcgctctgatgaatgctctcacggtcaacttgcatttgctcatgctgtcattctttaagcccacacctaagagatataagattctgctggaggccaaggccttcccctccgaccattatgcaatcgaaagtcagcttcagttgcacggacttaacattgaagaatccatgcgcatgatcaaaccgagagagggagaagagactcttcgaattgaggatatcctagaagtaatagaaaaagagggcgactcaatcgctgtgatactgttctcgggcgttcatttttacacgggacagcacttcaacattcctgccataactaaagccggacaagcaaagggttgctatgttggtttcgacctggcccatgccgtgggaaatgtcgagctctatctgcatgattggggcgtcgactttgcgtgctggtgttcatacaagtatcttaacgcaggggctggagggattgcgggtgcatttatacacgagaaacatgctcataccatcaagcccgctctagtcggctggtttgggcatgaactttcaacccgatttaaaatggataataaattgcagctgattcccggtgtgtgcgggtttcgaatctcgaatccacctattctgttggtctgctccctccacgcatcactagagatttttaagcaagccactatgaaggcactgagaaagaaatctgtcttactaacaggatacctggaatatctcatcaagcacaactacggaaaggataaagctgctaccaagaaacctgtcgtgaatattatcacaccaagccatgtggaagagcgaggatgccaacttacaatcacgtttagtgttccgaacaaggatgtctttcaggaattagaaaagagaggggtggtgtgtgacaagaggaatcctaacggcatacgggtcgcacccgttccactttataatagctttcatgacgtctataagttcacaaacctcctgacatccatccttgatagtgctgaaacaaagaattag

SEQ ID NO: 29768 - DNA, 3210 bp, Artificial Sequence
  Description of Artificial Sequence: Synthetic coding sequence
atgtacctccttgatgggagcggtgagcccgcttcgcccccagcggacgccatgccacgcggaactcccccaaggaaaacagtatatcgcatcagcgtcaccatggtgcggaaagagcagttagctgctcccggaagtgggggacccgacccccgacccgtcaggagacctaggcccgctcggtctccagatgcaccaggcagactagaggaagaggctgaagaggcagagggtgctgaggaacccgaagggccacggcctcgagcatgggactttagaacctttcggacccggagtacagggcagctcgaactcggaagattacggccttgtgccaggggtctggagccagccgacctggccggttctgccccagccgaagaggaaggcagaggatctccggcaagtggatcccctgatgtggaaggagcgagagctgctcctcttaggcgatctctcagtttccgacactggtccggccctgaggccccacaaggacgcactctgggtggaggcaggaggcattccagctctggctcactggcttgggctccttgcgatgaagccgcagccggtacaacactggaacctgccactgcaacccagccagctagcgaaaagagaaataccttggatgtgggcgaggtgctttcgaagaatgatgcactgagcgatctggaaagatgggagcgctctaagagcaaaaatcgcacgctggataattcggatttacagcggcttgaacgcgctcgggcagcggctggagccggagctgcttctgaacacaggttgctgcgatttttctcaggtatatttgccaggcgggacgggggtcccggtggtgggcctagccccagatcaggtgcctcacggccacgtggttatttctctctgaggagggctccagccgaggcgcacagcagttctgcggaaagcattgacggttctcctaggagagacgcgttcgtgaattctcaagaatggacgctttctcgctccgtgcctgagttgaaagtcggaattgtgggcaaccttgcctcagggaagagcgctcttgtgcataggtatctcaccggtacatatgtgcaggaagagtctccagaaggtgggcgattcaaaaaggaaattgtagttgatgggcaatcatatttgcttctaattcgagatgaggggggtcctccagaggctcagttcgctatgtgggtcgatgcggtaatttttgtgtttagcctggaggatgagatctcatttcagaccgtatatcattactacagtcgaatggcgaattacaggaacacctccgagatcccgcttgtgctggtcgggacacaggatgcaattagcagtgcgaatccacgggttatcgacgatgcgagggcacgcaagctttctaatgacctgaaaaggtgcacatattatgagacctgcgccacttacggtctgaacgtggagagagtcttccaggacgttgcccagaagatcgttgctactcgaaaaaaacagcagttgtcaattggcccttgcaagagcctgcccaacagtccgtcgcacagctctgtttgtagtgctcaggtctcagcggttcacattagccaaaccagtaacggaggcggaagtctgagcgattactcatcatcagtgccgtctacccctagcacgtctcaaaaagaactccgcatcgacgtccctccgactgcaaacaccccaaccccagtgaggaagcaatccaagcgtcgcagcaatctctttacaagcagaaaagggtcagatcctgataaagaaaaaaagggcctagagtcacgggctgactccatcggcagcggtagggctatccctatcaagcagggcatgctgcttaagaggagcggaaaatcccttaacaaggagtggaagaagaaatatgttacattgtgtgataatggagtcctgacctatcatcctagcttacatgactatatgcagaacgtacacgggaaagagattgatctgctccggaccactgtgaaggtgcctgggaaacgcccaccacgagccacctccgcctgcgctccgatttcttccccgaaaactaatgggctgagcaaagatatgagctcccttcacattagccccaactcggatactggactaggagattccgtatgcagctcaccatcaatcagcagcaccacatccccaaaactcgacccccctccgtcacctcacgccaatcgcaaaaaacaccgacggaagaagtctacttcaaactttaaggcagatggactgagcggcactgctgaggaacaggaagaaaatttcgagtttattatcgtctctctgacaggccaaacttggcattttgaagcaaccacatatgaggagagagacgcttgggttcaggccatcgagtcacagattctggcatcccttcagtcctgtgaatccagcaaaaacaaatctcgacttacctctcaaagtgaggcgatggcgttacagagtatcaggaacatgagagggaactctcactgcgtggactgtgagacacagaatccaaactgggcaagtctgaatctgggcgctctgatgtgtatagaatgtagcggaattcatcgcaatttaggcacccatctgagcagagttaggagtctggatctggacgactggccggtcgagctgatcaaggtcatgtctagtatcggtaatgagcttgcaaacagtgtctgggaggaatcaagccaggggaggacaaagccttccgtggattccacacgggaggagaaagagcgctggatccgtgctaaatatgagcagaagcttttcctggccccactgccctgtactgaattatccctcggacagcacttgctccgagcaacagccgatgaggacttgagaactgcaattttactgctcgctcacggctctcgcgacgaggtgaacgagacatgcggtgagggtgacggccgaaccgcactgcacttggcctgcaggaaaggcaatgtggtgctagcgcagttgctgatctggtatggcgtggatgtcactgcgagggacgctcatggtaacacggctctcgcatacgcacgacaggcatctagccaggaatgtattgacgtgttgctgcagtacggctgcccagacgaacgatttgttctgatggcaactcctaatctgtctcgacgtaataacaatcgcaacaacagttcaggccgagtgccaaccataatatag

SEQ ID NO: 29769 - DNA, 1260 bp, Artificial Sequence
  Description of Artificial Sequence: Synthetic coding sequence
atgaacaatcagaaacagcagaaaccgacactgtcagggcagagatttaagaccaggaagagggatgagaaggaacgtttcgaccctactcagtttcaggactgtataattcagggtctgacagaaaccggcactgacttggaagctgtggctaaattcctggatgccagtggagcaaagttagattataggagatatgctgagacgctgtttgatattctcgtggccggagggatgctggccccaggtggcactctggctgacgacatgatgcggacagatgtttgtgttttcgcggctcaggaagatctggaaactatgcaggcgttcgcacaagtatttaacaagcttattcgccgttacaaatacttggagaagggattcgaggacgaagtgaagaagttattattatttcttaagggctttagcgaaagtgagaggaacaagctggccatgctcaccggagtgctactcgccaatggcactctgaacgccagcatcctcaacagcctgtacaacgagaacctcgttaaggagggggtcagtgctgcgttcgccgtcaagttatttaagagttggatcaacgagaaggatatcaacgcggtggccgcaagtctgaggaaggtctctatggacaaccggcttatggagctctttccggcaaacaaacagtctgtagagcacttcaccaaatacttcaccgaggctggtctcaaggaactgtccgagtatgtgcgcaatcagcaaactatcggtgctcgaaaagaactacagaaagaacttcaagagcaaatgtcccggggtgaccctttcaaagacataatcctctacgtgaaggaagagatgaagaaaaataacatccctgagccggttgtcatcggaattgtgtggtcgagcgtaatgtccacagtggagtggaacaagaaggaggagttggtggcagagcaggcaatcaaacacctaaagcagtacagccccctcttggcggcattcactactcagggccagagcgagttgaccttgttgctgaagattcaggagtattgctatgataatattcactttatgaaagcattccaaaagatcgtcgttcttttctacaaggccgaagtgctgtctgaagagcctattttgaagtggtataaagatgcccatgtggccaagggcaagtctgtttttctggagcagatgaaaaaatttgtggagtggctgaaaaatgccgaagaggaaagcgaatccgaggctgaagaaggtgattag

SEQ ID NO: 29770 - DNA, 2769 bp, Artificial Sequence
  Description of Artificial Sequence: Synthetic coding sequence
atgatcacttcagcagccggaataatctcattgttagatgaagatgagccccagttgaaagaattcgcgctccacaagctgaatgcagttgtgaacgatttctgggcagaaatatccgagagcgttgataagattgaggtgctttacgaggatgaggggttccgaagcagacagttcgccgctttggttgcctcaaaggtgttctaccatctcggagctttcgaggagtcgctgaactacgcccttggtgctggcgatttgttcaacgtgaacgataactccgagtatgtggaaaccatcatcgctaagtgtatcgatcattataccaagcagtgcgtggaaaatgcagacttgcctgaaggcgagaagaaacccattgatcagcgattggaaggaatcgtgaacaaaatgttccagcggtgcctggacgatcataagtataagcaggccattgggatcgccttggaaacacgtagactggatgtattcgagaagaccatattagagtcaaatgacgtccctggaatgcttgcatactcccttaaactttgtatgtctctcatgcaaaataaacagttccggaacaaagtcttgcgtgttctggtcaaaatctatatgaacctggaaaaacctgatttcataaacgtatgccaatgccttattttcctcgacgatccacaggctgtgtctgacattctggaaaagctggtcaaggaggataacctcttgatggcataccagatttgcttcgacttgtatgagtccgccagccaacagtttctgtctagcgtgatccagaatcttaggacagtgggcacccccatcgcatccgtgcccggatccacaaacaccggaaccgtacctggatcagagaaagactctgattccatggagacggaagagaagacgagctctgccttcgtcggcaagacccctgaggccagcccagaacccaaagaccaaacactgaagatgattaaaatacttagcggtgaaatggccatcgaactccatcttcagtttctaatccgcaacaataacactgatctcatgatcctgaagaacactaaggacgcagtgaggaacagtgtatgccacacagctacagttatagcgaattcttttatgcactgcggcaccacatccgaccagttcctccgcgacaacctggaatggctggccagggcgaccaactgggcgaagtttaccgctactgccagcctgggagttattcacaaaggccacgaaaaggaagccctgcagctgatggccacgtacctgcctaaagatacgtcacctgggagtgcttaccaagaaggcggaggcttgtacgcgctggggctaatccacgcgaaccatggaggcgacatcattgattatctgctcaaccagctgaagaatgccagtaatgacatcgtgcgacatggcggttctttggggttgggcttggctgctatgggcacggcccgacaggatgtctatgacttgctaaagacaaacctctaccaggatgatgccgtgaccggcgaagctgctggactcgcactaggcttagtcatgctggggagcaagaatgctcaggcaatcgaggatatggttggctatgcacaagagacgcagcacgaaaagattttacgtgggcttgccgtcggcatcgccctcgtcatgtatgggcgtatggaagaggccgatgccctgattgaatccctgtgtagagacaaggatccaatcctgcggcgttcaggaatgtatacagtagcaatggcctactgcgggtctgggaataacaaggccataagacggctgttgcatgtggccgtctcagacgtgaatgatgacgtgcgccgagccgcagtggaatccctcggctttattttatttcgaacaccagaacagtgcccaagtgttgtgagcctactatcagaatcttataatccacacgtgcggtatggtgcagccatggcgctcgggatctgttgcgcgggaacaggcaacaaagaagctataaatctcctggagcccatgacaaatgaccccgtgaattacgtgagacagggtgctctgattgccagtgcgctgatcatgatccagcagaccgagattacatgccctaaggttaatcagttccgccagctgtactcaaaagtcatcaacgataagcatgatgacgtcatggcaaaattcggcgcaatcttggcgcagggcatccttgacgccggtgggcataacgttacaatttccctacaatctcgtactggacatacccacatgccctccgtcgttggcgtacttgtctttacacagttctggttctggtttcccctctctcacttcctgtcattggcctataccccaacctgcgtgatcggtctgaataaagacttaaaagtgtctactgcagtcctgtccatcaccgctaaggcgaaaaagaaggaaaaggagaaagagaagaaggaagaggagaaaatggaggtggacgaggccgagaaaaaggaagaaaaagaaaaaaagaaagagcccgaacctaactttcagctgttagataatcccgctagagttatgcctgcacagctcaaggttctgacgatgcctgagacctgccgttatcagccttttaagcccctctccatagggggaatcattattctgaaagatacatcggaggatattgaagaactggtggagccagtggccgcacatggccctaaaatcgaagaggaggaacaggaacctgagccgccagaaccattcgaatatatagatgactag

SEQ ID NO: 29771 - DNA, 363 bp, Artificial Sequence
  Description of Artificial Sequence: Synthetic coding sequence
atggcccctgccaaaaagggaggggaaaaaaagaaaggacgcagcgccatcaatgaggtagtgacgcgggagtatactataaacatacacaagcgtattcatggcgtggggtttaagaaaagagcccctcgcgctttaaaagagatcaggaagttcgcaatgaaagaaatgggcaccccagacgttagaatcgataccagactaaacaaagcagtgtgggccaaaggcatccggaatgtgccttataggattcgtgtgcgcctgagtagaaagcggaatgaggatgaagattcccctaacaaactctataccttagtgacctatgtgccagtgaccacttttaaaaattgccaccatcagtag

SEQ ID NO: 29772 - DNA, 378 bp, Artificial Sequence
  Description of Artificial Sequence: Synthetic coding sequence
atgagttctacccttgggaagctttctaaccaggtggaggaaacacttcccctattaaagaaggtgccagccaattatttccacatctgtagtgccatcttgatgggtttcagcctgagtaagtccgccacccaagtcagcgctattcacatggactcaaaagtggacgatcacttgatacgaggtactgaaaaatccagactggaaccagccacacagttgttccagaatacaaaaaagatcaggcttgaagatacaaatcaggagaatttcaccaggatcgaaggaactgggaccggatcgctgagcggcaaagccttgggatcagttgtgtatgtaaaggagtccgacgggttggagatgacagacgtcgagtag

SEQ ID NO: 29773 - DNA, 1500 bp, Artificial Sequence
  Description of Artificial Sequence: Synthetic coding sequence
atgagcaccccgagcgggatttccacatggctgtctctgccagtgtcaacccccgctagtatcactagcatcagagtaacccaaaagagttctgggccttgggccttttcctcatgcacctacgtttccggacctggagtgtgtatttcttcgctgtcctgttcacgagtaggctcctcatcttttagagggggtttagggggtgggtacggcggagcgagtggcatgggcggaataatcgccatcatggtgaatcagagcctactgagtcccctgaacctggaagtggacccaaatatccaggctgtctgcactcaagaaaaagaacagattaaaacactgaataacaagttcgcctcgtttatcgacaaggtttggtttctggaacagcagaacaaggttctggagacaaagtggagcctacttcaacagcagaaaatggcacgctctaacatggataatatgctggagtcctatattaacaatttgaggcgtcagctggagaccttaggccaggaaaaattgaaactggaagcagagttaggaaacatgcaaggtctgggtgaagacttcaagaataagtacgaagatgagattaataaacatacggaggtggaaaacgaattcgtgctgatcaaaaaggacgtggacgaggcctatatgaacaaagccgaactggagtctcttctggaagggctgacagatgagattaatttcctaagacagctctatgaagaggaaattcgggaactgcagagtcagatctctgacatgagtatggtcctttccatggactattcctgttctagggacatggactccattattcccgaggtgaaagtccaatacgaggagattgcaaactgctccagggccgaggcggagtcgatgtaccagattaagtatgaagagttgcagactctggctgggaagtacggggatgatctctcaaggacaaaaactgaaatcagcgaaatgaatagaaacatcagttggctccaggccgaaactgagggtttgaaagggcagagggccagcctggaagcagccattaccgacgctgagcagcggggtgagttagccgtcaaagatgctaatgccaagttaagtgagctggaggctgcccttcagcgagccaaacaggacatgatgggccagcttcgggaataccaagaactgatgaacgtcggactgacactggacatcgagatagcaacctatcgcaagctattagagggagaagagagcaggctggagtcaggcatgcagaacgtgtcaatccataccaaaactactagctcctacgcaggagggctctcatctgcatacggcggattgaccagtccgggaattatttacagattaggcagcagctttgggtcagccgctggttctagtagcttctccaggacctcatctacgagggccgtagtagtgcgcaaaatcgaaacacatgatggaaaacttgagtccgaatccagcgatgtcctgagcaagtag

SEQ ID NO: 29774 - DNA, 504 bp, Artificial Sequence
  Description of Artificial Sequence: Synthetic coding sequence
atgtacatgggaatgatgtgcaccgcaaagaagtgcgggatccggtttcaaccccctgcaatcatcctgatctatgagagtgagatcaagggcaagattaggcagcggataatgcctgtccgcaacttttccaaattctcagactgtaccagggcggcagaacaactgaagaataacccgaggcacaaaagctatttagaacaggtaagcctaaggcagctggaaaagctgttctcatttctgagagggtacctttcaggacagtccttggctgaaacgatggaacagatccaaagggagactacgatcgaccctgaggaggacttgaacaagctcgacgataaggaacttgccaaacgcaaatccatcatggacgagctgttcgaaaagaatcagaagaagaaggatgaccccaactttgtatacgacatcgaagtggagtttccacaagatgatcagctgcagagctgtgggtgggacacagagagtgccgatgaattctag

SEQ ID NO: 29775 - DNA, 378 bp, Artificial Sequence
  Description of Artificial Sequence: Synthetic coding sequence
atggcccctgcaaagaagggaggggagaagaagaagggccgtagcgccattaacgaggtagtgacgcgggagtacaccattaacattcacaagcgcatacacggggtcggctttaaaaaacgagctccccgagcccttaaggagatccgcaaatttgcaatgaaggagatgggcacaccggacgtgaggatcgacactaggctgaataaagccgtctgggccaaaggtattcggaatgtgccatatcgcatcagggtgcggctgtcccgaaaaaggaacgaggatgaggatagtccaaataagttatatactctcgtgacttatgtgcctgttacgacatttaaaaatctgcaaacagtgaacgttgatgagaactag

SEQ ID NO: 29776 - DNA, 1005 bp, Artificial Sequence
  Description of Artificial Sequence: Synthetic coding sequence
atgacacgaagtcttttcaaaggtaatttctggtccgcggatattctcagcaccatcggttatgataacatcattcaacacctcaacaacgggaggaagaattgcaaggaatttgaagatttcttgaaagagcgcgctgccatcgaagaaagatatggaaaggatcttctgaatctgagtcgaaaaaagccgtgcgggcagtcagagatcaataccttgaaaagagctctggaagtctttaagcagcaggttgataacgtggcccagtgtcatatccagctggctcagtctctccgcgaagaagccagaaaaatggaagagttccgggagaaacaaaagctgcagaggaaaaaaacagagctaatcatggatgcaattcacaaacagaagtccctacagttcaaaaagacgatggacgctaagaaaaattatgagcagaagtgtcgcgacaaggatgaggctgagcaagcagtctctcgaagcgcaaacctggttaatccgaaacagcaagagaagttgtttgtcaaactggctacatccaagacagcagtggaagactcagacaaagcctatatgcttcatatcggtaccctcgacaaggtgcgcgaggagtggcagagcgagcacatcaaggcctgtgaggctttcgaagctcaggagtgtgaaagaattaatttttttagaaatgccctgtggctgcacgtaaatcagctgtctcagcagtgtgtgacttctgacgagatgtatgagcaggttcgtaagtctctggagatgtgctccattcagagagacatagaatactttgtgaatcagcggaagactggccagataccacctgcgcctatcatgtacgagaatttttattcaagccagaagaacgccgttcctgctgggaaggccacagggccaaatctggcccgacgcggacctctgcctattcccaaatcctcccccgacgatcccaattactctttagtcgacgattattccttgctgtaccaatag

SEQ ID NO: 29777 - DNA, 597 bp, Artificial Sequence
  Description of Artificial Sequence: Synthetic coding sequence
atgaagaaggtccggctgaaagagcttgagtcccgactgcagcaagttgatgggttcgagaaacctaaacttcttctggaacagtacccgacccgtcctcatatcgcagcctgtatgctatacacaatccataatacatatgacgatattgaaaacaaagtcgtggccgacctcgggtgcgggtgcggagttctgtcaatcgggactgccatgttgggagccggactgtgtgtaggatttgatattgatgaggacgctctagagatttttaatcgaaatgcagaggagtttgaactgaccaacattgacatggtccagtgcgacgtttgcttactgagcaatcggatgtccaaaagcttcgacaccgtgattatgaacccccctttcgggaccaagaacaataaaggcactgacatggccttcctcaagaccgcgctggagatggcacgaacggccgtgtatagcctacacaagagtagcacccgggagcacgtgcagaaaaaggcggctgaatggaagattaagatcgacattatcgccgaactgcggtacgacttgcctgcatcctacaagttccacaaaaagaaaagcgtgtag

SEQ ID NO: 29778 - DNA, 1125 bp, Artificial Sequence
  Description of Artificial Sequence: Synthetic coding sequence
atgttggccccagggtgtgaactcgacccagatcaagaggtcgtcagaacccgccctgaggatgttcctgcgtcaccttcaacatcgaccatgattgtgtccgttctgcgtccgccttctcacgctagttgcacagcatgtggaaccgtaactttccacattgtcgagcgcatggcaagcgtgattcccgcaagcaatcggagtatgaggagtgaccgcaatacttacgtggggaagagatttgttcacgtcaagaacccttatctggatctcatggacgaagatatcctttatcacctggatcttgggacaaaaacacataacctgcccgcaatgtttggggatgtcaagtttgtttgtgtggggggtagtccaaatagaatgaaagcattcgctttgttcatgcacaaagagcttggttttgaagaggcggaggaggacatcaaagatatatgtgccggtaccgatcggtattgcatgtataaaactggcccagtgctggcaatctcccacggcatgggaattccttctatctccattatgctgcacgagttaattaagctgctccaccatgcgcgttgctgtgacgtgacaatcatccgtatcggcactagcggaggaatcggtatcgctccgggaacagtcgtaattacagatattgcagtagatagtttctttaagccaagatttgagcaggtgattcttgataacatagtgacgagaagcactgagttagataaggagctttccgaagagctgttcaactgttctaaggaaattcctaattttcccacactcgtcggccacacaatgtgcacctatgacttttacgagggtcaaggacgtttggatggggcactctgctccttcagtcgcgagaagaagctcgattacctgaaacgagcgttcaaggcgggtgtaagaaacattgagatggaatcgacagtgttcgctgctatgtgcggcctatgtggtctcaaggcagcagtcgtgtgcgtgaccctcctcgataggttggattgtgaccagatcaatctgccgcatgacgtactcgtggagtaccaacagagaccccagctcctgataagcaattttattcggcgacggctggggctgtgcgactag

SEQ ID NO: 29779 - DNA, 4149 bp, Artificial Sequence
  Description of Artificial Sequence: Synthetic coding sequence
atgctgcgcaagctgacaatcgagcagatcaacgattggtttacaatcgggaagacggtgactaacgtcgaactcctcggagctccgccagctttccccgcaggagctgcgagggaagaagtgcagagacaggacgttgctcctggagcaggccctgctgcacaggctcccgctcttgctcaggcccctgcaaggcccgctgccgcatttgagcggagtctcagtcagaggtctagcgaagtggaatacataaataagtacaggcagttggaagcccaggaattagatgtctgtcgaagcgtgcagccaacttcaggcccagggcctcgcccatccctcgctaaactctctagtgtcacctgcattccgggtaccacttataaatatccagacctgccaatatccaggtataaagaggaggtagtgtccttgatagaatctaattccgtggttataatccacggagctaccggttcaggcaaatcaacccagctgcctcagtatattctcgaccactatgtccaaagatctgcatactgcagcattgtcgtgacccagccacggaagattggggctagctcaattgccaggtggatcagcaaagagagagcttggactctgggcggagtggtgggttatcaagttggcttggaaaaaatagccacagaagacactcggctgatttacatgaccacaggcgtgctactccaaaaaattgtgtctgccaaaagcttgatggagttcacccatattatcatcgatgaagtccacgaacgcactgaggagatggactttctgctgcttgtggttagaaagctgctcagaactaactcccgttttgtcaaggtggtgctaatgtcggcaactatttcttgcaaggagtttgcagactatttcgcagttccggtccagaacaaaatgaatccggcatacattttcgaagtggagggcaagccacactccgtcgaagaatactatctgaatgacttggaacacatccatcattccaagctgtcaccccatctgcttgaagaaccagtgattacaaaagacatttacgaggtcgccgttagtctgatccagatgtttgacgatctggatatgaaggagagcgggaacaaggcttggtctggtgcacagttcgtcctcgagcggtcctccgtcctagtctttttacctggcttaggcgaaattaattacatgcacgagctgctcacatcgctggtgcataagaggctccaggtgtatcctctacactctagtgtggcactcgaggaacaaaacaatgtctttctgtcccccgtgcccggttaccgcaagattattctgtctactaacatcgccgaaagctcagtgaccgtcccagatgtaaaatatgttatagatttctgccttactagaactttggtctgcgacgaggatacaaactatcaatcgctgcggctgtcttgggcaagtaaaacatcctgcaaccagcggaaggggcgtgcaggtagagtgtcgaggggctattgttatcgactggtgcataaagatttctgggataactctatcccagatcatgtagtgccagagatgttacgttgtcccttgggctccacaattctgaaggttaagctcttggacatgggagaacctcgagcattactggcgactgcactgagcccgccaggtttatccgatatagagcgtactatcttactgctcaaggaagttggcgctctggctgtctcaggccagcgagaagacgaaaatccccacgacggcgagctgacttttttgggcagggttctagcacagctgccagtgaaccagcaactaggaaaactcatcgtgctcggacacgtgtttggctgtctggacgagtgcctgattatcgctgccgcactgagccttaagaatttttttgcgatgccttttcgccagcaccttgatggttaccgaaacaaggtgaacttttccggcagcagcaagtctgattgcatagctttagtagaagcctttaaaacttggaaggcttgtcgccagaccggtgaactgcgttatcctaaagacgagttaaactggggcaggcttaactatatccagattaagagaattcgagaggttgctgaactgtacgaggaattgaaaacccggatatctcagtttaacatgcatgttgacagtagaagaccggtgatggatcaggagtatatttacaaacagcggttcattttacaggtcgtgttggctggcgctttctacccaaattatttcacctttggccagcctgatgaggaaatggccgtgagagaattggccggaaaagaccccaagaccacagtggtgctgaaacacattccaccttacgggttcctgtactataaacagctgcagagcctgttcagacagtgcgggcaggtcaagtcaattgttttcgatggtgccaaagcttttgtcgaattttctagaaatccaactgagagattcaaaaccctgcccgctgtatacatggctatcaagatgtctcagctgaaggtgagtctggagctgtcagtacattccgccgaggagatagaagggaaggttcaaggaatgaatgtgtccaaactaagaaacactcgcgttaatgtagacttccagaagcagaccgtcgacccaatgcaagtgtcgtttaacacatccgatcgaagccagaccgtaactgatcttttactgacaattgacgtaacagaggttgtggaggttggacacttttggggttaccgtatagatgagaacaacagcgagatactgaagaagttgacagctgaaataaatcagctgacgcttgtcccgctcccaacgcatccacatcccgatctggtctgccttgcccctttcgctgactttgataaacagagatattttagggcacaggttctctatgtgtcgggcaattctgccgaagtgttttttgtggactatgggaataagtcgcacgtggacctccatctcttaatggaaatcccatgtcagtttttggaactgccttttcaagctctagaatttaaaatctgtaagatgcgcccaagtgctaagtcattggtttgtggcaagcactggtcagatggcgcaagccaatggtttgcttccctcgtttccgggtgcacacttctggtcaaagtcttcagcgttgtgcactcagttctacacgtagatgtttatcagtacagcggagttcaggatgccattaacatcagggacgttctcatccagcagggctatgctgaactcaccgaggaaagctacgagagtaagcagtctcacgaggtgctgaagggtctatttagcaaaagcgttgaaaatatgactgacggctccgtgccatttcccatgaaagacgatgagaagtatttgatcaggattctgttagagtctttttctaccaataaactgggtacgccgaactgcaaggctgagctgcatggtcccttcaacccttatgagctgaagtgtcatagcttaactcgcatttccaaatttaggtgcgtgtggattgagaaggagtctatcaattccgtgattatatctgacgccccagaagatctccaccagaggatgctagtcgctgcctctcttagcattaacgctactggtagcaccatgctgcttagggagacctccctcatgccccatatccccggactcccagccctactctcaatgctctttgcccctgtgatagaactgaggattgatcagaatggaaaatattacaccggggtcctgtgtggattgggatggaatcccgctaccggcgcttcgatcctccccgagcacgacatggagctggcattcgatgtccaattcagcgtagaagatgtggtcgaggtgaacattctgcgcgcagccattaacaaactcgtctgtgacgggcctaatgggtgtaagtgtttgggccctgaaagggttgcccagctgcaggatatcgccaggcaaaaattattggggctgttctgtcagagtaagcctagggagaagatcgttcccaaatggcatgaaaaaccatatgagtggaaccaggttgatcctaagttagttatggaacaggcagaccgggagagtagcagagggaagaatacgttcctgtaccagttgcacaagttagtcgtgctgggcacctag

SEQ ID NO: 29780 - DNA, 357 bp, Artificial Sequence
  Description of Artificial Sequence: Synthetic coding sequence
atggatgtgttcttgatgatcaggagacacaagactaccatatttacagatgccaaagagagttccacagtgttcgagctgaagcgaattgtggagggaatcctcaaaaggcctcccgacgagcagcgactgtacaaagacgaccagttacttgacgacggcaagactctgggagaatgtggcttcaccagtcaaacagcccgacctcaggcacctgcgacagtagggttggctttcagagccgatgacacatttgaagccttgtgcattgagcccttctcttccccacctgagctcccagacgttatgaagccacaggattcggggagcagtgctaacgaacaggccgtccagtag

SEQ ID NO: 29781 - DNA, 3228 bp, Artificial Sequence
  Description of Artificial Sequence: Synthetic coding sequence
atggtcgtagaggttgactcgatgcctgccgcttcctccgtaaaaaaaccattcggccttcgatcgaaaatgggtaaatggtgttgtcgctgtttcccttgctgcagggagtccggaaagtcaaatgtggggacgtccggggatcacgatgatagcgccatgaagacgttaaggtcgaagatgggtaaatggtgtcgccactgcttcccttgttgccggggtagtggaaaatctaatgttggggcatctggggaccatgatgattccgcaatgaagacactgcgcaataaaatgggcaagtggtgctgtcactgctttccatgctgcagaggctcatccaaaagtaaggtaggcgcttggggcgattacgacgactccgctttcatggagcccaggtatcacgtcagaggggaggacctcgataaacttcaccgcgcagcttggtggggtaaggtgccgaggaaggacttgattgtgatgctgcgcgatactgacgttaacaagcaggacaagcagaaaaggacagcccttcaccttgctagtgccaacgggaatagtgaggtggtgaaattattgctggacaggcggtgccagcttaacgtcctagacaacaagaaaagaactgcattgattaaggccgtccagtgtcaggaagacgaatgtgctcttatgctgctagagcacggtacagatccgaatattccagacgaatacggcaacaccactctccactatgcaatatacaacgaagacaaactgatggctaaagctcttctgctgtatggcgctgacatcgagtcaaagaataaacacggtctgacaccattgctgttgggggtccatgagcagaaacagcaggtcgtgaaattcctgattaaaaaaaaagctaatcttaacgcgctggaccggtacggccgtaccgctcttatcctggccgtttgttgcggcagtgcttccatagtctctctgctcttagagcagaatattgatgtctcttctcaggacctgtctggacagacggccagagagtacgccgtgtcaagtcaccaccatgtcatctgccaacttctcagtgattataaggagaagcaaatgttaaagattagcagcgagaatagcaatcccgagcaggatctgaagttgactagcgaagaagagtcccagaggttcaaggggagtgagaactcacagcccgagaagatgagccaggaacctgaaataaataaggacggcgatcgggaggtggaggaagagatgaaaaaacacgagagtaacaatgtcggacttctcgaaaacctgaccaatggggttacagctgggaacggggacaacggtcttatccctcagcgcaagtcacgtactccagaaaaccagcaatttcccgacaacgagtcagaggagtatcacagaatctgtgaactgttatccgactataaggagaagcagatgccaaaatacagcagtgagaactctaacccagagcaggacctcaagcttacctccgaggaagaaagccaaaggttaaagggctccgaaaacggccagcccgaaaagagatctcaagagcctgagattaacaaggatggggatcgcgaacttgaaaacttcatggctatagaggaaatgaaaaagcatcgcagcacccatgtcggctttcctgagaacctgactaacggggctaccgctggcaacggcgatgatggtctcattccacctaggaagagcaggacacctgagtctcaacagttccctgatacagaaaacgaggagtaccactctgacgagcagaacgatacacaaaagcagttttgtgaggaacaaaacaccggcatcctgcatgacgagattctgattcacgaagaaaagcagatagaggttgttgagaaaatgaactcggagctaagtttgtcatgcaaaaaggagaaggacatcttgcacgagaacagcacacttagagaggaaatagctatgttaaggctggaattggacaccatgaagcaccagagtcagttacgcgagaagaagtacctggaggatattgagagtgtgaaaaagagaaacgataacctgctcaaagccctgcagttgaacgagcttactatggatgatgacactgccgtgctggtgattgacaacggttccggcatgtgcaaggccggttttgccggagacgacgccccacgagccgtgtttccgagcattgtgggacggcctaggcaacaaggcatgatggggggaatgcaccaaaaggagtcctatgtggggaaggaagctcagtctaaaaggggcattttaacgctcaagtaccccatggagcacggtattattaccaattgggatgacatggaaaaaatctggcaccacacgttttataacgagctcagggtggcgcctgaggagcaccctgtgctcctcacagaggctacacttaatccgaaggcaaatcgtgaaaagatgacacagatcatgtttgagacattcaatacgcctgcgatgtatgtcgccatccaggctgttctgtcgttgtacacctccggcagaactacaggcatcgtgatggattccggcgacggagtgacgcacactgtgccaatttacgagggtaacgccctgccccatgccactcttcgactggacctggcaggacgagagctgcctgattacttaatgaagatacttactgagcatggctatagatttactactatggcagaacgcgagattgtgagagatattaaggagaagttgtgctacgtagctttggactttgagcaggagatggccacagtggctagtagctccagcctcgaaaagtcctacgaactgccagacggacaagtcataaccattggaaacgagaggtttcggtgtccggaggccctgtttcagccgtgcttcctaggcatggaatcttgtggcatccacgagaccacatttaattccattatgaaatccgacgtggatataaggaaagacttgtacaccaacacagtgctgagcggcggtaccacaatgtaccctggaatggcccatcgcatgcagaaggagatcgctgccctcgccccttccatgatgaaaattcgcataatcgccccacctaagcgcaaatattccgtttgggtggggggatccatactcgcctctctgtcaaccttccagcagatgtggatctcaaaacaggaatatgatgagagtggcccttccatcgtgcatcggaaatgcctgtag

SEQ ID NO: 29782 - DNA, 381 bp, Artificial Sequence
  Description of Artificial Sequence: Synthetic coding sequence
atgacagcaaccgagcagtggatattcctttgtgccgctcataaaaccccaaaggaatgccctgctatcgattacacaaggcacaccctggatggcgctgcatgcctattaaatagcaacaagtattttcctagtcgagtgtcaatcaaagaaagttcagtggcaaaattaggtagcgtgtgcaggagaatttatagaattttttcgcacgcatatttccaccataggcagatatttgacgagtacgaaaatgagacattcctttgccaccgctttactaagtttgtgatgaagtacaatctgatgagtaaggataatctaattgtcccaatcctggaggaagaagtccagaattcagtctcgggagaaagcgaagcctag

SEQ ID NO: 29783 - DNA, 2811 bp, Artificial Sequence
  Description of Artificial Sequence: Synthetic coding sequence
atggagcccgacatcatcaggatgtatagcagtagcccaccaccactggacaacggagcggaggacgacgacgatgacgagttcggggagtttggcggattctctgaggtttcgccttccggggtggggtttgtcgactttgacacccccgattacacgcgtcctaaggaggagtttgtaccaagcaaccactttatgcctatacacgaattctctgaaaacgtagatagcctgacgagttttaagtccattaagaatggcaatgacaaggacattaccgccgaactgtctgccccagtgaagggtcaatccgatgtcctcttatccaccacttctaaagagatcatctccagcgagatgctggccacaagcattgacggaatggaacgaccagggaacctcaataaggtagtcgagcaaagacagaatgtcggtacacttgagtcttttagtcctggcgactttaggactaacatgaatgtggtgcaccagaacaagcagctggaaagttgcaatggcgaaaaaccaccctgcctggagattctgactaacgggtttgcagtgctggaaaccgtgaatccacagggcaccgatgacctcgacaacgtggccgacagcaaaggaaggaagccgctcagcacacacagtacagagtacaacttagacagtgtgccaagccctgcagaggagtttgcagacttcgcaacattcagtaagaaggagagaattcagctggaagaaattgaatgtgccgttctgaacgaccgagaggcccttaccatccgcgaaaacaacaaaatcaacagagttaacgagttgaacagcgtaaaggaggtggctctggggcgtagtttggataataagggggacaccgatggggaagaccaggtttgcgtgtcggagatctctattgtgacaaatcgcggattttccgtggagaaacaggggttgcccacacttcaacaggatgagttcctgcagtccggagttcagagcaaggcctggagcctggtggatagcgcagataactctgaagccatcaggcgggaacagtgtaaaacagaggaaaagctcgatctgctgacgagcaaatgcgcccatttatgcatggacagcgttaaaacaagcgatgatgaggttggatctccgaaggaggagtctcgcaagtttaccaactttcaaagtccaaacattgatccaacggaagagaacgatctagatgatagcctgtctgtaaagaacggcgacagttccaacgacttcgtgacatgcaatgacatcaacgaagacgattttggcgatttcggggatttcggcagtgctagcggctccaccccaccattcgtcactggaactcaagactccatgagcgacgccaccttcgaggaaagttctgaacacttcccacactttagtgagccaggagatgactttggcgaattcggggatattaacgccgtctcatgccaggaggaaacgatcctgaccaaaagcgatttaaagcaaacatccgataacttgtcagaggagtgccagctggcgaggaaaagctcgggcacgggcaccgagcccgtagctaagctcaagaatggtcaagaaggagaaataggacacttcgattccgtgccaaacatacaggatgactgcaatggttttcaggattccgatgatttcgccgatttctcatcggcaggccctagccaagtggtggactggaatgccttcgaagacgagcagaaggactcctgcagttgggcggcatttggagaccagcaggcgacagaaagtcatcaccggaaagaggcatggcaatcgcatcgcacggatgaaaacatagacaccccaggtacacctaagactcatagtgtacctagcgccaccagtaaaggggctgtcgccagcgggcatctacaagagtctgctacgtcagtgcagacggctctgctgaaccggctggaacgcatctttgaagcctgctttccgtccatcctggtaccagatgccgaagaagaggtgacgtcattaaaacacttgctggagacctcaacattgcctattaagactcgcgaggcacttccagaaagcggggaattgctggacgtttggacagaacttcaggacatacatgacgcgcatgggcttcgctatcagtggggcggatcacactccaataagaaattgctgagttccttgggaatcgacacgaggaatattcttttcacaggtaacaaaaagcaacctgtgattgtacctatgtatgctgccggtctggggatgctggaacctaccaaagaaccgttgaaacccctaagcgccgctgagaagatcgccagcatcgggcagactgctacgatgtcccctgacatgaacacctgcacatcagaccagtttcaggaaagtctgcctcccgtccagttcgattggagctccagcggcctgaccaacccattggacgccagtggaggctccaccctgttgaatctggactttttcggaccagtggacgactccagcagtagcagctcaaccaccatccccggagtcgaccccgaactgtatgagttgacaacatccaaactagaaatctctacttcctcgctgaaagtgaccgacgcattcgctcgcttgatgagcaccgttgaaaagacctccacttccacacgcaagcctaaaagggaagagcatctgtcagaagaagccatcaaggtgatcgctgggctccccgacctcacattcatgcatgctaaggtgttaatgtttccagcaactctgactccttcgacatcatcacaagagaaagcggacgggtag

SEQ ID NO: 29784 - DNA, 1860 bp, Artificial Sequence
  Description of Artificial Sequence: Synthetic coding sequence
atggacgatcagcaggccctgaatagtatcatgcaagatttggccgttttgcataaagcctcccggcctgctctgtcgcttcaggaaaccaggaaggccaagtctagcagcccaaaaaagcagaatgacgtaagagtcaagtttgagcacaggggggagaaacgcatcctgcagttccctagacccgtgaagctcgaagatctccgcagtaaagccaagattgcatttggccagtctatggatctacactacacgaataatgaactagtgattccattaaccactcaagacgatctagacaaagccgtggaattgctagatagatccattcacatgaagagcctgaagattctcctcgttataaacggcagtacccaggccacaaatctggagcctctgccttcacttgaggacctggacaacaccgtgttcggggcagagcgcaaaaaacggctgagcattatcggtccaacatcccgcgaccgatcctctcctccccctggttatattcccgacgagctgcatcaggtggcacgtaatggctctttcacatcaataaacagtgaaggtgagttcatccctgagtccatggaccagatgctggaccccttgtccttgagttcaccggagaactctggaagcgggagctgtcctagtctggactccccattggatggtgagagttaccctaagtccagaatgccgagagcacagtcttacccagataatcaccaggagttttccgactatgataacccaatcttcgagaagtttgggaaaggcggaacctaccccagaagataccacgtgagctaccaccaccaggagtacaacgacgggagaaagacattcccaagagcgcgaagaacacagggtaccagcctgcggtctcccgtgtctttctcacccacggaccattctttgagcacatcgagcggttcttccattttcaccccagagtatgacgattcacgaattagacggcgagggagcgacatagacaaccccacgctgaccgtgatggatatttctcccccatccagaagtccacgcgctcccaccaattggagactcggtaagcttcttgggcaaggagctttcgggagagtttatctgtgttacgatgtggatacaggcagagaacttgccgtcaaacaggtgcaattcgacccagattcacccgagacttctaaggaggtgaacgcattggaatgtgaaatccagcttctgaagaatttgctgcatgagcggattgtccaatactatggttgcctgagggatcctcaagaaaaaaccctatcaatctttatggaatacatgcccggtgggagcatcaaggaccaacttaaagcttacggtgccctgaccgaaaatgtaacaagaaagtatacccgacagattcttgagggtgtgcattacctccattccaacatgattgtgcaccgagacataaagggcgctaatatcttgcgcgacagcactggaaatgtgaagttgggggacttcggagccagcaaacgactgcagacgatctgtctgtcaggcacaggtatgaagtctgtcaccggaacaccatactggatgagtcctgaggtgatttcaggcgaaggatatggcagaaaggccgatatttggagcgtggcctgtaccgtcgtcgagatgctgactgagaaacccccatgggccgaattcgaggccatggccgctattttcaagattgccacccaacccacgaatccgaaacttcccccacatgtgagcgattacactcgtgattttttgaagagaatatttgtggaggccaaactccgcccatccgcagatgaactgctgcgccatatgtttgtccactaccattag

SEQ ID NO: 29785 - DNA, 513 bp, Artificial Sequence
  Description of Artificial Sequence: Synthetic coding sequence
atgacccgcggtaaccaacgagaactcgcgaggcagaagaacatgaaaaaacaaagcgattccgtaaaaggcaagcgaagggacgacggactgtcagctgccgctaggaaacagagggtaggtgtgcagcagccgaacgccgaactgtcgcccattcacttccacctgatcctatgcgcgcttcatccccctgcatcatgtcctttctgtcctcttgtacccccaagcgctccctccagcctcccgcctggtacacgcaggtcttgtagccggtcccgcaagcgccagactagacgcaggagaaatccctctagcttcgtggcctcatgcccaactttgctacctttcgcctgcgtcccaggcgcatctcccacaaccctggccttccccccagtggttttgaccggccctagcacagacggaatcccgttcgctctgtctttgcagagagttcccttcgtattgccgtcaccccaagtggccagtctcccgctcggacattcccggggttag

SEQ ID NO: 29786 - DNA, 630 bp, Artificial Sequence
  Description of Artificial Sequence: Synthetic coding sequence
atgaagaaggtccggctaaaagagctggagagccggttgcagcaggtcgatggtttcgagaagcccaagctcctgcttgagcagtaccccaccagaccacacatcgctgcctgtatgctctacaccatacacaacacttatgatgatatcgaaaacaaggtggtagccgatctggggtgtggttgtggtgtcctgagtattgggaccgccatgctcggagccggtctctgtgttggctttgacatagatgaagatgccctcgagattttcaatagaaacgctgaagagttcgaactcacaaatattgacatggtgcaatgtgacgtctgcctgctcagtaaccgtatgagcaaatcatttgacaccgtaattatgaatccgcctttcggaaccaaaaataacaagggtacagacatggcatttctcaagacggcccttgagatggccaggacagccgtttactccctccataaatcctccacaagggaacacgttcaaaagaaagcagccgagtggaagatcaagatcgatattatagcagagctcaggtacgacctccccgcttcatataagttccacaagaaaaagagtgtggatatcgaggtggaccttattaggtttagcttctag

SEQ ID NO: 29787 - DNA, 1755 bp, Artificial Sequence
  Description of Artificial Sequence: Synthetic coding sequence
atggctgccagtgcaaagaggaaacaggaggagaaacacctgaagatgctcagagacatgaccggtctcccccacaaccgcaagtgtttcgattgtgaccagcgaggacctacatacgtgaatatgaccgtggggagtttcgtgtgcacatcctgcagtggatcattgcgaggattgaatcccccacatagagttaagagtattagcatgactacgttcacccagcaggaaatcgagttcctccagaagcatggtaatgaagtgtgcaaacagatttggctgggtctttttgatgatcgaagttctgccataccagacttccgtgatccacaaaaagtgaaggaattcctccaggagaaatatgaaaagaaaaggtggtatgttccgcctgagcaggccaaggtggtggctagcgtgcacgcatcgatcagcggcagctccgcttcgtccacatcaagcacccctgaggtgaaaccactgaaatcattgttgggggattccgcaccaaccctgcacctcaataagggaactccaagccagtcgcccgtggtgggccgttctcagggccagcagcaggagaaaaagcagtttgacctgttatctgatcttggatcggacattttcgccgctcccgctccccagtctacggccacagccaacttcgccaatttcgcgcactttaacagtcatgcggctcagaactccgccaacgcagattttgccaacttcgatgcttttggccagagtagcggatctagcaatttcggtggcttccctacagcgtctcactcaccctttcaacctcagactacagcattccggatgttatcaagctcctgcagcttcggggagtttacatctgcctttcctctgcaggcaacccactccggatcagccgcaagtgtgaatgctaatttcgcccacttcgacaatttccctaaaagcagtagcgcggattttggtactttcaacacttcccagagccatcagaccgcgtcagccgtgtcaaaagttagtaccaacaaggctggcctgcagactgccgataaatatgccgcactcgctaatctggataatatatttagtgccggacagggcggagaccagggatccgggttcggcacaacagggaaggcccctgtgggttctgtggtgagcgtcccctctcagtcctccgcctcttctgacaagtacgccgcactggctgagctggatagtgtgttttcatccgccgctaccagctctaacgcctacacttcaacctctaatgctagctcaaacgtctttgggaccgtgcccgtggtggccagtgcacaaacgcagcctgcatcatctagcgtgccggctcccttcggcgctaccccaagtaccaatccatttgttgctgccgctgggccatccgtggcatcctctaccaatccttttcagaccaacgctcggggagctacagcagcaaccttcggaacagcctcaatgagtatgcccactggattcggcacacctgcgccatactcactgccgacatctttctctggctctttccagcagcccgcattccccgcacaggctgccttcccccaacagactgccttctctcagcagcctaacggattcgctgcattcgggcagacaaaaccagtggtaacaccatttgggcaggtcgctgccgcaggcgtctcctccaatccctttatgactggagctcctaccggtcagtttcccactggttcctcctctaccaatcccttcctctag

SEQ ID NO: 29788 - DNA, 795 bp, Artificial Sequence
  Description of Artificial Sequence: Synthetic coding sequence
atggctggcgagcagaaaccatctagtaaccttctagagcaatttatcctcttagcgaaaggaacaagtgggtccgcgctgactgctctgatttcgcaggtgctggaagctcccggtgtttatgtgtttggggaactgctcgaattagccaacgtccaggaattagctgaaggagcgaacgctgcatacctccaactcttgaacctcttcgcatatggaacatatccagactatatcgccaataaagaatcactgcccgagctgtcaactgcacaacagaacaaactgaagcatctgactatcgtctctttggcgtctagaatgaagtgcataccctactccgtgttgctgaaggacctggagatgagaaacctgcgggaactcgaggatctcatcatcgaggcggtgtataccgatatcatccagggcaagctggaccaaagaaatcagctgctcgaggtggatttttgcataggacgtgacatccggaagaaggacattaacaacatcgtcaagaccctccatgagtggtgtgacggctgtgaggctgtattgctgggaattgagcagcaggtcctacgtgccaaccagtataaagaaaaccacaaccggacccagcagcaggtcgaggccgaggtgaccaatattaagaagacacttaaggctaccgcctcatcttccgcccaagaaatggaacagcagctggccgaaagggaatgtccccctcacgctgagcagaggcagcccactaaaaagatgagcaaggtaaagggattggtctctagccggcattag

SEQ ID NO: 29789 - DNA, 1506 bp, Artificial Sequence
  Description of Artificial Sequence: Synthetic coding sequence
atgtccagcgagcaggataagagcgcttcaaaagaaaagagcaaaaaacctgttagatttcttccccagctaagtatggagaaacttgccagcaaggagaaattcaaagcaccggcaagagcgcttcctcaactctctatggtctccacaaagccccattggcagcaggcagccccatcttttcatctgtccgtcaagcaggatgacgagagtcccgagccattttccgtcaaaaacgaacagtctcatgctgagtatatggagcgcttcggaaaaaaggggaagttgccccatcaagtcgatgactcttacgtgggccctagcacgagtaagtctaagggaaaatccccgcacaaggagcgtgaaaacttccggtccacactggtcaacgtaattatgcagcaagacgctgatctcgacagcgctgtgccagacggatctacaatccctaagccaaccgcttccgccatcgagaaagacatccttcgctattactattatatccatcatggcattgacactgaccacgtagcccctatggaggactcttggctcgaacatgtgctagacctagtaccccagcatctgaaggttttcaccgactccatcgtgaccctgtcagacgaaatgcgagaagattacctgcttagtgtcagaaagtcaatcgtggattttgtcttaaaagaccctagagagaaaggcgatgataaaaagaccgacgaattgcctgctcaccgagctgagatggaaattcttcccaagccctggcgaaaatcgttcctggcagcgagtagctacatacgggaccacctgaacgccatgaaccctacgatgcttgccgtcctggatctgtggcacacaaatttcaagaagttgcgattggttgacataaaggaattccacaactgccaggatgcgctagaactcagctcattccaaaatattataatgcggcacatggactcggccaaagagacactgttgaaaatgtggttccctgaggtccaaaacatctactaccagggaaataagaaaaaacaactgccgacaggcgactcttctgccaagctcgagagcttcttcaattgcgccgcagctctgatgacattgcaactgcaggacctgacgctggtgtctatgcaggacttcaccgatctgatcgcgcagcctcccgacagcgtgcgtgctttcgagcaccctgggtttattatgcgcctcatactggacaatgacaccattaagttcgagccagagctcagcgactacatagatattttcctcaacgtgtatgacgtgatgatcaaagctgtttcctttgtccccagggtcgagaccaaattgtattcaaaatggcgaaataaggccaaacctggacacttttactttagtcatattcagcgcagtgttacttttcaacactccgaagtgagctcgccgcaaaattcgcactttaagatcgtcagcccattctcggttttagggtttacttggagatgccagctgtag

SEQ ID NO: 29790 - DNA, 855 bp, Artificial Sequence
  Description of Artificial Sequence: Synthetic coding sequence
atgactgatgttccagccacgttcactcaggccgaatgtaatggcgacaaacccccagaaaatggacagcagacaatcacaaaaatcagtgaagagcttactgatgttgactcaccgctgccacattacagagtagagccctctctggaaggggcactgacaaaaggatcacaggaggaaagacgcaagctccagggaaacatgctgttgaattcatccatggaggacaagatgctaaaggagaacccggaggagaagctgttcatagttcacaaagctataaccgacctgtccctacaggaaacatctgctgacgaaatgactttcagagagggacatcagtgggaaaaaatccccctatcaggcagcaaccaggaaattcgcagacagaaggagcggatcactgagcagcctcttaaggaggaggaggacgaggaccgcaaaaataagggccaccaggccgctgaaatcgagtggctgggattcagaaagccatcacaggctgacatgctccattcaaagcacgacgaagaacaaaaggtgtgggacgaagagatcgatgacgatgatgatgataattgcaacaacgatgaagacgaggtccgggttatcgaatttaaaaagaaacacgaggaagtttcccagtttaaagaagaaggggacgcttcagaggactctccgctatctagcgcaagctcccaggcagtaacccctgatgagcagcccacgctgggcaagaaatctgatataagtcgcaatgcgtactcccggtacaacacaatctcctacagaaaaatacggaagggcaataccaagcagagaattgatgaatttgagtccatgatgcacctatag

SEQ ID NO: 29791 - DNA, 735 bp, Artificial Sequence
  Description of Artificial Sequence: Synthetic coding sequence
atgaaaaaagtgcggctgaaggagcttgagtcgaggctgcaacaggttgacggttttgagaagcccaaactcctcctggagcagtatcccaccaggcctcatatcgccgcttgcatgttgtacaccatccataatacatatgatgacattgagaataaggttgtcgcagacctggggtgtggttgcggagtcttatccattgggacagccatgctgggcgctggcctgtgcgtgggatttgacatcgacgaagacgccctggaaatattcaacaggaatgccgaggaatttgaattgactaatatcgacatggtgcagtgtgacgtgtgcctgctaagtaaccggatgagcaagtcttttgatactgtaatcatgaatcctccctttggaacgaagaacaacaaggggacagatatggctttcttgaaaacagccctcgagatggcgagaaccgcagtttacagccttcacaagtcctctacgagagagcatgtccagaaaaaggccgctgagtggaagatcaaaatcgatatcattgcagagctccgctacgatctgcccgctagctacaagttccacaagaagaaaagcgtgagccttttgattctggctgggctccactccgtgctgaagagctttctcggcaggatgtggtggtttatgccagtcatccccgcaaccagagaggctgaagctagggagtccctggaactccgacgccaacgcttacagtag

SEQ ID NO: 29792 - DNA, 885 bp, Artificial Sequence
  Description of Artificial Sequence: Synthetic coding sequence
atgaataatcagaagcaacaaaaaccaacattgagtggccaacgtttcaaaacccgcaaacgcgacgaaaaggagaggttcgatcccacccagtttcaggactgcatcatacagggtcttacggagactgggacagatcttgaagcggtcgccaagttcttagatgcttccggggctaaattagattataggagatatgctgagacccttttcgacattctcgttgcgggaggcatgcttgccccagggggtaccctggctgacgacatgatgcgcacagatgtatgcgtgttcgcagctcaagaggaccttgagacaatgcaagccttcgctcaggtgtttaacaagctcattcgacgctacaagtacttggagaaaggttttgaggatgaggttaagaagctgcttctgtttctcaagggattctctgagtccgaaaggaacaaattggcgatgctgactggcgtcctgctcgcaaatgggacgctaaatgcgagcatcctgaactctctttacaatgaaaacctggttaaagagggagtttctgccgcatttgcagtaaaattatttaaaagctggattaatgagaaagacatcaatgccgtggcagcttccctgcggaaggtatcaatggacaatcgtctcatggagctcttcccggcaaacaagcagtctgtggaacatttcactaagtacttcacagaagcagggctaaaagagctgagcgagtatgtgcgcaaccagcaaacgattggggctcggaaggaactgcaaaaggagctgcaggaacagatgagtagaggcgatcccttcaaggacataattttatatgttaaggaagaaatgaaaaaaaataatatccccgaacctgtggtgatcggctag

SEQ ID NO: 29793 - DNA, 1374 bp, Artificial Sequence
  Description of Artificial Sequence: Synthetic coding sequence
atgaatcaaccgtgtaattcaatggaacctcgggttatggatgatgatatgctgaagctggctgtcggcgaccagggccctcaggaagaggcaggacagcttgcaaagcaggagggtatcctgtttaaagacgtactgtccctgcagctggactttaggaatattctaagaatagacaacctgtggcaattcgaaaacctgaggaagctgcagctggataataacattatagaaaaaatagagggactcgaaaacctggcgcatttggtgtggctcgacctctcttttaacaacattgagacaatcgaaggcttggacacacttgtgaatcttgaagatctctcgctctttaataacagaataagtaaaatagattccttagatgcattagtcaagctgcaggtgctgtcactcggaaacaaccggatcgataacatgatgaatattatttatctccggcgatttaaatgcctgagaacactttcactgagcagaaaccccatttctgaggcagaagattacaaaatgtttatttgcgcctatttgcccgatctgatgtacttggactacagaaggatcgacgatcacaccaagaagctggccgaagctaagcaccagtattctatcgacgagctgaaacaccaagagaacctgatgcaggcgcagctcgaagatgaacaggcacagcgggaggagctggaaaagcacaagacggcttttgtggaacacctgaatgggtccttcctgtttgactctatgtacgccgaggactctgagggtaataatctgtcctacttgccgggtgtgggggagctgcttgaaacatataaggataaattcgtgattatttgcgtcaacattttcgaatacggtctgaagcagcaggagaagagaaagactgagctggatacattcagtgagtgtgtgagggaggctatccaggagaatcaagaacaagggaaaaggaaaatcgccaaatttgaagagaagcatctttcgagtttaagcgcaataagggaagagctggagttacccaatattgagaaaatgatcctcgagtgtagtgccgatatctctgagttgttcgacgctcttatgacacttgagatgcagttagtagaacagctcgaggaaaccatcaacatgtttgaaagaaatattgttgatatggtcggactgttcattgaaaatgtgcagtcactcatggctcaatgtcgcgatctggaaaatcatcatcatgaaaaactgctggaaatttctatcagtactttagagaaaattgtagaaggagacctcgatgaggaccttccaaacgacctgcgagcgggacgcttccagaagttcaactatgtggaagctagcggaaccttctag

SEQ ID NO: 29794 - DNA, 1638 bp, Artificial Sequence
  Description of Artificial Sequence: Synthetic coding sequence
atgtccagtagtgggtatccgcctaatcaaggcgctttcagcacagagcaatcccgctaccctccccactccgtgcagtacactttccccaacacccgccatcaacaggagtttgcggtgcccgactacagatcatctcacctggaggtgagtcaggcctctcaactcctgcagcagcagcaacagcagcagctccggcgtcggccaagcctgctgagcgagtttcatcctggctcagatcgccctcaagagagaagaacaagttacgagccattccatcctgggccatcaccagttgatcatgatagtttggagagtaaacggcctcggctggagcaggtgtctgacagccacttccaaagagtctctgctgccgtgcttccgctggtgcaccccctgcccgaggggcttagggcctcagctgatgctaagaaggatcccgcttttggaggaaaacacgaggcaccttctagtcccatctctgggcaaccctgtggggatgaccagaatgctagtccttctaagcttagcaaggaggagctgatccaatcaatggaccgcgtagaccgcgaaattgctaaagtggaacagcagatccttaagctgaaaaagaaacagcagcagctggaggaagaagcggctaagccacccgaacccgagaaacctgtcagcccaccgcctgtggaacagaaacaccggtctatcgtgcagattatatacgatgaaaaccgtaagaaagccgaagaagcccataaaattttcgaggggttaggacctaaggtggaattgccactgtacaatcaaccctccgacaccaaggtgtaccacgagaatattaaaactaaccaagtgatgagaaagaagttaattctgttctttaagagacgcaatcacgcccgtaaacaaagggagcagaagatctgccagcgatatgaccagctgatggaggcgtgggagaaaaaagtagacagaattgagaacaatccgagacgaaaggctaaagagtcaaagacacgagagtactacgaaaagcaattccccgaaatccggaagcagcgagaacagcaggaaagattccaacgggtgggtcaacggggagccggactgtcggccactattgcacggagtgaacacgagatctccgagataatcgacgggctgtccgagcaggaaaacaacgagaagcagatgagacaattgtctgtcatcccacctatgatgttcgatgccgaacagcgaagggtcaagtttatcaatatgaacggactcatggaggatccaatgaaggtttataaagacaggcaatttatgaacgtgtggacagatcacgaaaaggagatctttaaagacaaattcatccagcatccgaaaaattttggcttgattgcgagttatctggagagaaagtctgtacctgactgtgtgttatattattacctgaccaagaagaatgagaactataaagccttggtccggcgtaactacggaaagagacgcggtaggaaccagcagcaaatcgccaggccctctcaggaagagaaagttgaggaaaaagaagaggacaaggctgagaagactgagaagaaagaggaagagaaaaaagacgaagaagaaaaagacgagaaggaggatagttag

SEQ ID NO: 29795 - DNA, 480 bp, Artificial Sequence
  Description of Artificial Sequence: Synthetic coding sequence
atgacccattgctgcagcccgtgttgccagccaacttgctgcagaacaacatgttggcagccaactaccgtgactacctgctcaagcacaccttgttgtcagcctagctgttgtgtatccagctgctgccagccttgctgtcaccccacctgctgccagaatacttgctgcagaaccacttgttgtcagccaatttgtgttacgtcttgctgccagccaagttgttgttccacaccctgctgccagccaacttgctgtgggtcctcttgtggccagagcagctcgtgcgcccctgtctactgcagacgcacctgttaccatccaactagcgtttgcctgccgggatgtctgaaccaatcttgtggctcgaattgttgccaaccatgttgccggccagcctgctgcgaaactacgtgttgcaggacaacctgctttcagccaacctgcgtgtactcctgttgtcagcccagctgttgctag

SEQ ID NO: 29796 - DNA, 1071 bp, Artificial Sequence
  Description of Artificial Sequence: Synthetic coding sequence
atggagggccacgacccaaaagaacccgagcagttacgaaagctatttatcggaggtctgtccttcgagacaactgatgactcactgcgggagcattttgaaaagtggggcaccctgactgactgcgtggttatgcgtgatcctcagaccaagcggtcaaggggtttcggctttgttacatatagctgcgttgaagaggtagacgccgcaatgtgtgcccgtccacacaaggtggatgggagggtggtggaaccaaagagggccgtgtcgcgggaagactccgtgaagcctggggcacaccttaccgtaaagaagattttcgtggggggaatcaaagaggacactgaagaatataacctgcgggattatttcgagaagtatggcaagatcgaaactatcgaggtaatggaggaccgacagtccgggaaaaaacgaggctttgcgtttgtgactttcgacgatcatgacaccgtcgacaagattgtcgtgcagaagtatcacactataaacgggcacaattgtgaagtcaagaaggctctgagcaaacaggagatgcaaagcgccggttcacagcgcggtcgcggtggtgggtctggcaactttatgggcagagggggaaatttcggcggtggaggcggaaactttggaagggggggaaactttggcggtaggggcggttatgggggagggggtggcggttcccgcggatcttacgggggtggtgatggcggatacaatggatttggaggtgacggcggaaattatggtggcggaccgggttattccagcaggggcggttacggaggtggaggacctggctacgggaaccagggtggcggatacggcggaggcggaggatatgacggctataatgaaggtggtaattttggcggtggcaattacggtgggggtggtaattataacgattttggcaactattctggccagcagcagtccaactatggccctatgaagggcggatcttttggcggacggagctcaggaagcccatatggaggagggtacggctctggcggaggctctggcggttatgggtctagacgtttctag

SEQ ID NO: 29797 - DNA, 186 bp, Artificial Sequence
  Description of Artificial Sequence: Synthetic coding sequence
atgccctttttcggcaatactttttccccaaagaaaactcccccacgcaaatctgccagcctgtccaacctacattccctggacaggagcaccagagaggttgaactggggttggaatatgggtctcccaccatgaacctggccggtcagtctcttaagtttgagaatggacagtggattgcctag

SEQ ID NO: 29798 - DNA, 981 bp, Artificial Sequence
  Description of Artificial Sequence: Synthetic coding sequence
atgccgcaccttcctcttgcttcattccggcctcccttctggggcctacgacactcgcgcggactgcccagattccactcagtttctacccagtctgagcctcatggatcacctatttcacggagaaacagggaagctaagcaaaaaagactgagagaaaagcaggctacccttgaggcggagattgcaggagaatcgaagagcccagccgaatctattaaggcgtggaggcctaaagagctcgtgctgtatgaaatccccaccaaaccgggtgagaagaaggacgtctctggcccacttcctcccgcatatagccccagatatgtggaagcagcatggtatccatggtgggtaagggaaggcttcttcaaacctgaatatcaggctagactacctcaagcaactggagagacattttcgatgtgcattcctcccccaaacgtaaccgggtctcttcacatagggcatgcactgaccgtcgcaatccaggacgcgctggttcgttggcatcggatgaggggtgatcaggtgctctgggtccctgggtcggatcatgctggaatcgctacacaagccgtcgtggagaagcagctatggaaagagcgcggagtacgccgacacgagctcagccgcgaagccttcttacgggaagtgtggcaatggaaagaggctaagggtggtgaaatttgcgagcagcttcgggcactcggcgctagtctggactgggaccgcgagtgtttcaccatggatgtcggtagtagcgtggctgtcacagaagcctttgtgagactttacaaagctggcctgctttaccgtaaccaccagctcgttaattggtcttgtgccctgaggtcagcgatctctgacatcgaggtggagaaccgacccttgccaggccacacccagctgaggttacctgggtgccccacccctgtgagttttggcctcctgttttccgtggcttttcctgtcgacgggtag

SEQ ID NO: 29799 - DNA, 2031 bp, Artificial Sequence
  Description of Artificial Sequence: Synthetic coding sequence
atgatcccccctcaagaggcttctgctagacgcagggaaatcgaggacaagttaaagcaggaagaggagaccctaagttttatacgcgattccctcgaaaagtctgaccagctcaccaaaaacatggtgtcgatcttgtcaagctttgagtcaaggctgatgaaactcgaaaactcaattatccctgtgcataaacagaccgagaatctgcagagactgcaggaaaatgtggaaaaaacattgtcatgtctggaccacgtgatctcctactatcatgttgccagtgacacagaaaaaatcatcagggagggacctacagggcgactcgaggaatacttggggtctatggccaagatccagaaagccgtggagtacttccaagataacagcccagacagcccagagttaaacaaagttaaactgctgtttgaaagaggcaaagaggcactggagagtgaattccgatccctgatgactagacactccaaggtcgtttcacccgtcctgatcctggacttgatttcgggcgacgatgatttagaggcgcaagaggacgtgacccttgaacacctaccagagagtgtgcttcaagatgtgatccgcattagccgctggttggtagagtatggcagaaatcaggactttatgaatgtgtactaccagatcaggtcctcacaactggaccgcagcataaaaggactgaaggaacatttccacaagagctcctctagtagcggcgttccatattcacctgctatcccgaacaagcggaaggacacaccaactaaaaagccagtgaagcgccctggccacgagcatgatttcagagtgaagcatctgtccgaggctctaaacgacaaacacgggcctttggccggtcgggatgatatgcttgacgtggagaccgacgcatatattcactgtgtctctgctttcgtcaagttggctcagtccgagtaccagcttctagctgatattattcccgagcaccatcagaaaaaaacctttgattcattgatccaagacgctttggacgggctgatgttagagggcgaaaatattgtgtctgctgccagaaaggccatcgtaaggcacgatttctcgaccgtattgactgtgtttccaatactcagacacttgaagcagaccaaacctgagttcgaccaggtactgcagggtacagcagcctcgaccaagaacaagttgcctggtttgatcacttctatggagaccatcggagctaaagcactcgaagatttcgcggacaatatcaaaaacgacccagacaaagagtataatatgcccaaagacggcactgttcacgaactgaccagcaatgcgattctgttcttgcagcagctgctcgatttccaggaaactgcaggagcaatgctcgcctcccaggagacttcctcttctgctacgagctatagttccgagttctctaagagactgctgagcacatacatttgcaaggtactgggtaatctgcaacttaacttattgtccaaatccaaagtgtacgaggacccagcactcagtgccatcttcctgcacaataattacaattacatattgaaatccctcgagaaatctgaactcatccaactagtggccgttactcaaaagaccgcagagcgctcgtaccgggaacatatcgagcagcagattcaaacgtatcaacgatcctggcttaaagttacggattacatcgctgagaagaaccttccagtgttccaacctggagtcaaactgcgggacaaagagaggcagatcatcaaagaacggtttaaaggctttaacgacgggcttgaagagctatgcaaaattcagaaggcttgggcaattcctgatactgaacaacgggacagaattcggcaggctcagaaaacaattgtaaaagagacttacggagccttcttgcaaaagttcggttcagtcccattcacaaaaaatccagagaagtacattaagtacggcgttgagcaggtcggggacatgatcgatcggctattcgatacatcggcttag

SEQ ID NO: 29800 - DNA, 459 bp, Artificial Sequence
  Description of Artificial Sequence: Synthetic coding sequence
atgacagacgttcccgctacattcacccaggccgaatgtaatggagacaaacccccagaaaatggacagcagacgattacaaaaataagcgaagagcttaccgacgtggactcccccttaccgcattatagagtggagccaagcctggagggggctctcaccaagggcagccaagaggagcgccgtaaactgcagggcaacatgttattgaacagtagcatggaggataagatgctgaaagaaaatcccgaggagaagctgtttattgtacacaaagcaattactgatctgagcctgcaggagacaagtgccgacgagatgacatttagggagggacaccagtgggagaagattcctctgtcagggagtaaccaggaaattaggcggcagaaagaacggattacagagcagcctctcaaggaagaggaagacgaggaccggaagaacaagggccattag

SEQ ID NO: 29801 - DNA, 768 bp, Artificial Sequence
  Description of Artificial Sequence: Synthetic coding sequence
atgtggcctttccccagcaggtcactcttccctccacccacacaggcctggctccagactgtcagctccgacccggaggcacaaggttggggcgcatggaacgagactaaggagatccttggaccagagggtggcgagggcaaagaagagaaggaggaagaggaagacgctgaagaggaccaggacggcgacgcaggcttcctcctgtctctgttagaacaagaaaacctcgcggagtgccctctgcctgatcaagagctggaggcaataaaaatgaaggtctgtgctatggagcaagccgagggaacgccacgcccaccaggagtccagcagcaggctgaggaggaggagggaaccgccgcaggtcagcttcttagtcccgagaccgtggggtgtccgctgagcggaacgcccgaggaaaaggttgaagctgatcacagaagcgtgtatgtcgggaacgtcgattatgggggatcagcggaagaactggaggctcactttagcagatgcggtgaagtgcatcgggtgactattctttgcgacaagtttagtgggcaccccaaaggatgctgccgtaaggagcccacctccctcggctcagccccacagaccgctggggcattcgaagatacacaggccccaggcggacacccatcacccacggccgcttcccgagccggaccgggttctgaccacaaagggaggaccggccctgtagagaacagccaccatggatttcacagaatcaaaggtaagactaggttctag

SEQ ID NO: 29802 - DNA, 3561 bp, Artificial Sequence
  Description of Artificial Sequence: Synthetic coding sequence
atggaaaaggctaccgtccccgtagctgcggcaaccgctgccgagggtgagggatcgcctccagctgttgccgcagtggccggtcctcccgcagcagcagaagttggcggaggtgtgggcggttccagtcgtgcgaggtccgctagctcaccgagaggcatggtccgcgtctgcgacctgcttctgaagaaaaagcccccacaacagcagcatcacaaagctaagaggaaccgcacctgcagacccccatcaagctccgagtctagcagcgactccgacaactccggtggcggaggcggaggtggcggagggggaggcggaggcggtggcacaagttccaacaactccgaggaggaggaggacgatgatgatgaggaggaggaagtaagcgaggtggaaagcttcattctggatcaggacgacctggagaaccccatgttggaaaccgcatctaagctgttgctgtcaggcaccgccgatggtgctgacctcagaactgtcgatcctgagactcaggccagactggaggccttgctcgaggctgcaggaattgggaaattatccacggcagatgggaaagccttcgctgacccggaggtgctgcgcaggctcacctcatccgttagttgtgcacttgatgaagctgccgcagccctcacaagaatgcgcgctgaatcaacggctaatgccggacaatctgataacaggagcctggcggaagcatgcagtgagggggatgtaaatgcggtccgcaagctgttgatagaagggcgttctgttaacgaacacactgaagagggtgagtctctgctttgcctcgcatgcagcgccggatactatgagctggcccaggtgctcctggctatgcacgctaatgtggaggacaggggaataaagggcgacatcactcctctgatggccgcagcaaatggtggacacgtgaaaatcgtgaagctactgctggcccacaaggctgatgtgaacgcacagagctcaacaggcaacacagccttgacatacgcatgtgccggaggctatgtcgacgtggtaaaggttcttttagaatccggtgcttcaatagaggaccacaacgagaacgggcacacacccttaatggaagcaggcagcgctggccatgtggaggtggctcggctcctgttggaaaacggtgccggaatcaacactcactcgaatgagttcaaggagtccgcccttacactcgcctgctacaaaggacatctggagatggtgcgcttcttgctggaggcgggagcagatcaggagcacaaaactgacgaaatgcataccgcgctcatggaggcctgcatggatggccatgtggaagtggccaggttgctgctggactcaggggcacaagtgaacatgcccgcagattccttcgagtcccccctcactttggcagcttgtggaggacacgtggagcttgcagccctgctcatcgagagaggggcatccttggaagaagtgaacgatgagggatacacacccctgatggaagcggctagagaagggcatgaagaaatggtggccctcctgttgggtcagggggctaacatcaatgctcagacagaggaaacacaagagacagccctgaccctggcttgttgcggagggtttctcgaggtggccgacttcttaatcaaagccggagcagacatagagctggggtgttctacacctttgatggaagccgcacaagaagggcacctggagttggtcaagtaccttctggcagccggagctaacgtgcatgctactaccgctacaggagacactgccttaacctatgcctgtgagaatggacatactgatgtggcagatgtgctgctccaggcaggcgctgatctggagcacgagtccgagggtgggaggacccccctgatgaaggccgcaagagcaggtcatgtgtgtacagttcagttcctgatcagcaaaggtgccaacgttaaccgaacgactgcaaataatgaccacaccgtgctctctcttgcatgcgccggtgggcacctcgcagtggtggaactgcttctggctcacggggcagacccaacgcaccgcttgaaggacggtagtaccatgcttatcgaagctgccaaaggaggacatacaagtgtcgtatgttacctgctggattatccgaataatctcctctccgcccctccacccgatgttacacagctcactcccccaagtcacgatctgaatagagctccgcgagtcccggtgcaggcactgccaatggttgtaccccctcaggagccagataagcctccagctaacgtggcaaccacactacccatacgcaacaaggccgcatccaaacagaaatcctcttctcacttacctgccaactcacaggatgtgcagggttacattacaaatcagtcaccggagtccattgtggaagaggcccaagggaagttaaccgaactggagcagcggattaaggaagctatagagaaaaacgctcagctgcagtccctcgagttggctcatgccgatcagctgaccaaagagaagatcgaagaactgaacaagactcgagaagaacagatccagaagaagcagaagatactagaggagctgcagaaagtggagagagaactgcagttgaaaacccagcagcagctgaagaagcaatacctggaagtgaaagcgcagcgtattcagcttcagcaacaacagcaacagtcatgtcagcatctgggtttactgacaccggtgggtgtcggcgagcaactaagtgagggagactatgcacgtctgcagcaggtagatccagtgttgcttaaggacgagccccagcagaccgcggcacagatgggcttcgccccaatccaacctcttgccatgccccaggctctgccactggcagccggtcccctgccccctggctcaatagcaaacttaaccgaactgcaaggagtaattgttggacagccggtcttgggtcaggctcagttggccggtcttggccagggtatcctgactgagacacagcagggattaatggtcgctagtccagcccagacactcaacgatacacttgacgacattatggctgctgttagcggcagggcctcagctatgtcaaacactcccacacactccattgccgctagcatctcccagccacagacccccactccttctcccatcattagcccttcggcaatgctgcctatctatcctgctatcgatattgatgcgcagaccgagagcaatcacgataccgctctgaccctggcctgcgccggaggccacgaggagttagtacagactttgctggagaggggcgcatccattgaacatcgagataagaagggtttcacgccactgattctagctgcaaccgccggacacgtaggagtggtagaaatccttctcgataatggtgccgacattgaagcccagtccgagagaaccaaggacaccccgctgtcactcgcctgttccgggggtcgtcaggaggtggtggaacttctgctggctagaggcgctaataaaagcacgggcatgtttctcattacccatctgtag

SEQ ID NO: 29803 - DNA, 2682 bp, Artificial Sequence
  Description of Artificial Sequence: Synthetic coding sequence
atggctgcaaccgtggagggtcccgaacttgaagccgcagccgctgccggagatgcctccgaagattcagatgcagggagccgtgctctaccttttctcgggggtaacagactatccttagacttatatccaggtggatgtcagcagctccttcatttatgcgtacagcagcctctccagctgcttcaagtcgagttcttgcgcctcagcactcacgaagaccctcagctactggaagccactctggcccaactaccccagtctctaagctgcctcagaagcctagtgctgaaaggtggccaaaggagagataccctaggagcatgtctgaggggagcactgacaaatttgccggctggactgagcgggctcgctcacctggctcacctcgatctaagcttcaactcacttgaaaccctccctgcctgtgtgctacaaatgcggggactgggtgcacttctgctgtcccataactgcctaagtgagttgccggaagctctcggagccctgccagccctaacctttcttactgtcacacataatagactccagaccctccctccggctctgggcgcattatcaacactgcagcggctggacctgtcccaaaatctcctggacaccttgcctccagaaatcggagggctcggatccctgctggagctcaaccttgcctcaaatagactgcagagtttgccggcatccttggcaggcttacgatcacttaggctcctcgttctgcattcaaatttgctagcctctgtgcctgctgatttggcgagactgcctctgctgacaagactcgatttgcgggacaatcagctgcgcgacttgccccctgaactgctcgacgccccatttgtgaggctccagggtaaccccttgggagaagcaagcccagacgcaccatccagcccagtggcagccctgattccggaaatgccgagactgttcctaacctccgatctcgacagctttccagtgacccctcaaggctgttcagtgacccttgcctgcggcgttcgactgcaatttccggcaggcgctaccgccactccgatcactataagataccgacttcttctccccgaacccggactagtaccactcggtccacacgacgcgctactgtcccacgtcctggaactgcagccacacggggtggcattccagcaagacgtcggactatggttactttttacaccccctcaggctcgcagatgtcgtgaagtggtcgtacgcacccgaaacgataacagttggggcgatctcgagacgtatctggaggaggaggccccacagagactgtgggcccactgccaggtcccccatttctcttggtttctggtcgtctctcgcccagtgtctaacgcatgcctcgtgcctcctgagggtacattactgtgctcctcggggcacccgggtgttaaggtaatcttccctccaggagctactgaggaaccacgtagagtaagcatgcaagtagttcggatggctggaagagaattgcaagcccttttgggtgagcccgaagccgctgtcagcccactcctctgtttgtctcaaagcgggccaccctccttccttcagcccgtgaccgtgcagcttcccctgccaagcgggatcaccggccttagcctcgaccggagtcgcctgcaccttctttattgggctcccccagccgctacctgggacgacatcactgcacaggtggttttagagttaacgcacttatacgctaggtttcaagtcacgcattttagttggtactggctgtggtatacaaccaaaaactgtgtcggcggtttagctaggaaggcgtgggaacgactgcgtttgcacagggtgaatctcatcgcgcttcaacggcgtagagatccagaacaagtgctcctgcaatgtttacccaggaacaaagtcgatgccactctccgaaggctgctggagaggtacaggggccctgaacccagtgatactgtagaaatgtttgagggcgaagaatttttcgccgcattcgaacggggaattgatgtggacgccgacaggcccgattgcgttgaaggaaggatctgtttcgtgttctactcccacctgaaaaacgtgaaggaggtttcattttacagaggcgctgtcccggtgcgggtccctgaggaggctgaagccgctagacagagaaagggggcagatgccctttggatggccacccttcctattaagctacctcgtttgcgaggatccgaaggtccacggagaggcgctggcctgagcctcgcgcctctcaaccttggagatgcagagactggttttcttactcagtcaaatttgttaagtgtggctggcaggttgggattggattggcctgcagtggccctccacctgggtgtctcctaccgcgaagtgcaaagaattaggcacgaattcagggacgatttggacgagcaaatacgccatatgctgttttcctgggcagaaagacaagcgggacagcctggcgcagttgggcttttggtacaagcactggagcagagcgatagacaggacgtggccgaggaggttcgggctgtgttggaactcggccgtaggaaatatcaggactcaattagacgtatggggctagcgccaaaggaccccgctttacccggttccagcgccccacagcctccagagcccgcacaagcgtag

SEQ ID NO: 29804 - DNA, 1482 bp, Artificial Sequence
  Description of Artificial Sequence: Synthetic coding sequence
atggattttctgcttggaaatcccttttcatcccctgtgggccagcgcattgaaaaggccactgacggatctctgcagagcgaagattgggccctcaatatggaaatatgcgatatcattaacgagacagaagagggccctaaggacgctctgcgggcagtgaaaaagcggatcgtgggcaataaaaactttcacgaggtgatgctggccttaaccgtgttggaaacgtgtgtgaagaactgcgggcaccgttttcacgtcttggtcgcctcccaggactttgttgagagtgtgctggtgcggacgatcctccccaaaaacaacccgccaaccatagtgcacgacaaagttctgaacctaatacagtcatgggccgacgcattcagatcctctccggacttaaccggcgtggtgacgatttatgaggatctgcgtagaaagggcctggagttcccaatgacagatctcgatatgcttagtccgattcacacgcctcaacgaactgtctttaacagtgaaacgcagtccggccaggattccgttggaaccgacagttcgcagcaggaggactcggggcagcacgctgctcccctaccagcccctcctattctgtcaggggacacaccgatcgcaccaacgccagagcaaataggcaaactgcgatctgagttagagatggtgagcggtaacgtccgggtcatgtcggaaatgctcaccgagcttgtgcctactcaagctgagccggcagatcttgagttactgcaggagttaaatagaacatgtcgggctatgcaacagagagtgctggagctgatcccccaaatagccaacgaacagctcacggaagagctgcttatcgttaacgacaatctgaataacgttttcctgcgccatgagaggtttgaacgattccggaccggacagacaaccaaggcaccatccgaggccgaacccgctgcggatctcattgatatgggaccagatcccgcagctacgggcaatctgtcctctcaactggcgggaatgaatctgggctcctcgtctgttcgagccggactccaaagcctcgaggcctcaggacgcttggaagacgagttcgatatgtttgcgttgacccgcggtagctcacttgccgaccaacgcaaggaggttaaatatgaagccccacaagccactgacggcctagccggtgccctggacgccaggcagcaatccactggggctatccccgttactcaagcctgcctgatggaagacatagagcagtggctgagtactgacgtcgggaacgacgcagaagagccaaaaggcgtcacatcagagggcaagtttgataagtttctggaagaacgggctaaggccgctgacaggttgccgaatctgtcctctccaagcgctgaaggtccaccgggacctccatcaggcccagcaccacgaaagaagactcaggaaaaagatgatgacatgttattcgcactatag

SEQ ID NO: 29805 - DNA, 663 bp, Artificial Sequence
  Description of Artificial Sequence: Synthetic coding sequence
atgaactctcaacctcagaccaggtcccccccaagcaggacagttccaattcactgtaccgacaattggaagcggcgaaaggtgctggagcagacccccgtatacaggagccttgccggacgaggttggatcaagtactgtatttttttccagcggccacagatacaacccccaagggctacaatacccaacagctcaccaagcattcgccctggcgctcagacccctacggccgtctaccaggcgaaccagcacatcatgatggtgaatcatctccccatgccctacccagtgccccaggggcctcaatactgcataccccagtatcgacactcaggtcccccatacgtaggcccacctcagcagtacccagtgcaacccccaggacctggcccattctatccagggcctggacccggtgacttcccaaatgcttacggcactccattctacccatcacagcccgtctaccagagtgcaccgattatagtgccaacacagcaacagcctcctccagcaaagcgggagaagaagaccattcgtattagggaccctaatcagggcggaaaagatattacggaggaaattatgtctggcggtggaagtcggaatcctacccctcctattgggagacccaccagcacgccaacaccaccgcagtag

SEQ ID NO: 29806 - DNA, 414 bp, Artificial Sequence
  Description of Artificial Sequence: Synthetic coding sequence
atgagtctctttgggaccacttcaggcttcggcacttctggtacttcgatgttcggttccgcaaccacagataaccataaccctatgaaggacatagaagttactagctcccccgacgatagtattgggtgcctatcattttcacctcccactctccctggaaactttctcatcgcaggatcctgggccaatgacgtgcgctgctgggaggtgcaggacagtggacagacgatcccgaaagcccaacaaatgcataccggcccagtcttggatgtgtgttggtccgacgatgggagcaaggtgtttaccgcttcttgcgataaaaccgcaaaaatgtgggacctatctagtaaccaggcgatccagatcgcccagcacgacgcaccagtaaagaccattcactggatcaagtag

SEQ ID NO: 29807 - DNA, 7808 bp, Artificial Sequence
  Description of Artificial Sequence: Synthetic coding sequence
atgaagaggaaagttgtcaatactcacaagctccggctttcgcccaacgaggaggcctttatccttaaggaggattacgagcgaagacgtaagctgcggttgctgcaggtgcgagagcaggagagggacatcgccctacaaatccgcgaggatattaagcagaggcgcaaccagcagttcacccgcctggcggaagagcttagggccgagtgggaggaaagccagacgcagaaaatccagaacctggagaagctttacctagcatcattgcggagtatgggagagggccatagacaggcgaaggagaatgaacctgatttggacgcattggcccaacgagccgcagagagaaaaagaaaggcagacctacggcataaagaggcattaaaggttcagaagaaccagaaggagatccttctaaaacagaagacctggcacatcaaggctcggaaagaagccttgttggtcgaaaaggaaagatccgcaaaaatcacgtccttgcccccacctcctccgactctgttcgaaaatattgaggtcaagaggatttccgcagtcaagactaattcttctacttatcatcacctgcacacctttgttaaccgagagaccgacactaagcggccagatgccaggctcgctgcagaagaagaagcaaaaagactggaggagctccagaaacaggccgcacaggaaaggatggaacgctttgagaaggctcatgtgagaggattccaggccatgaaaaagatccatctggcgcagaatcaggagaaattaatgaaagagttgaagcagctgcagcaggaagacctcgctcggcgaagacaaacggttgcccagatgcctccgcaattggtggagttgccctataagagatcagagatgaaggaagactggcagcgcgagctggagttcgcgttcgaggatatgtacaatgctgatagaaaagtgaagggcaacctgattttacatctggaacctgagccccttcctaccgtgacaaatcaaattcaagacgaggagctggatctatccatggaacaagaaaatctcggagcggctgaggacctgccagttactgaagcagagatctgctcatcggaaacagatgtgcccctcgtgatgaagactcaacaaatacctagtaaagtgctgttcaaaaagcttctgaataaaatacgatcacaaaagtctctctggaccatcaaatctatgtctgaggacgagagcgagatgattaccacagtcagcgagatcgaatctaaggcgccaacggtggaatcaggtacaatcgcttccaaagagcgcaccttgagcagcggccaggagcaagtggtcgagtcagatacacttacaattgagagcggtccactggccagtgaagacaagccgctgtcatgtgggacgaactccgggaaagaacaggagataaacgaaaccttgcccatcacaactgtcgcccaatctagcgtgttgttacatccgcaggaagcagctgccagaattcgaatgtcggccagacagaagcagatcatggagattgaggaacaaaagcagaagcagcttgaattgctggagcaaatcgagcagcagaagttgcggttagagactgactgtttcagagcccagttggaggaggaaaagagaaaaaagacgcagcccacaggcgtcggaattgcacctgcgtcctgtccagtgatctcggacgaagacagccatagacagatgatcagaaattaccaacaccagctgctgcaacaaaatagactacaccggcaatcggtagaaaccgcccgaaaacaactgctcgaatatcagactatgctcaagggtcggtgcccatctgtgagtgccccaagcctgattacagattcagtgattagcgttccctcgtggaagtctgagaggcccacagccatctccgagcactgggaccaagggcagaggctgaagctcagcccgaacaagtaccagcccatccaaccgatccagactagcaaattagaacaggatcatttccaggttgctagacagaatcattttcctcagcgacaggtcgagaccaccgagacactcagggctagcgatatactcaccaaccaggctctcgagtcccaagagcacttgaggcagttctcccagactgagacccaacaacgcgactataagctggtgcctaaagacagcgagactctctctagagctcttagccacgatcgccagctcatcagccaggacgccagaaagatctcagagacttttggagccacaactttccagagtttagagtcacaacaattatttagtgaaaatagtgagaacatctcttatcacctcactgaaccatcaagcttcgtgccattagtcccccagcatagcttttcctccctgcctgtgaaggtagaaagtgggaagatccaggaaccattctcagcaatgagcaagtctactgtctcaacgagccactctatcatctcacagatgcacgatcgaccacttctgccgtctgaaaatattactgcacagcagggaaacatgaaggctcttcaggaacaactggatctgcagaagaaggtgctccaagcgacacaagaagctcaggaacagctcctattgtgcaagcagaaggaggtagagcagcaaaccgggctctccgtctttctcccactggttacgcccgatagctctgctcttctgcccagtgcaaaggccgacttgggcagaattcaggaatccagtcccacgaagaacaacatagccgtcagttccgaccaccacgtgatttcacagctgcaggacaagcgcttaagcttgagtcagcccattttgagccagcaaaacaattttaaattcttacaggagcagctgaatatacagaaggacagtctacaggcgaggcgtgaagcacaggaggtgttgtacgtccacaagcaaagcgagctcgaccgtcgcgtgtgttctgagcaggcggaaccatccttcccatttcaggtggcccagcacacgttcacctcacttccaagtgcggataccaagtctgggaagatccaggaacagcactcctctaagtccgagaagggacttgtgtcctgccagagcgatattcccatcagtcaggacggctctctgtccttcctgcagcagttcttgcccctgcacgatagcctaaagctgctccaagaacagttgacaaaacagagggacacattgcaggccagacatgaggctcaggttgagctgctactgcaccgccagagagaccttggtgatagcaagtccggactggtttcttcaagttcctctcctgttgtggtccagcattccgtggccagtcaggcttccgcaaaagctgaaccacggaggatacaggagctgtatctgagtgaaaaagagaatgttggcccatcttgtcacctgataataccgacattccaagataaaagtttgtcttttccacaacactctctggcccagcaggagaacctgaccattctccaagagcaatctcagatacagagagtgatcctgggggcaaaagaggggacccaggagtttgttcacacagagtctgagctggaaaagagaatttcttctgagcagaccggtacctcctcaagcctttcccaagttgatgagagcgaacgttttcaggagtgtattagtatcaaatccgattctactatccctctcagtcatccaaaaataccacgctgtcaggagagacttttacgggtctcacaacacatgcttccccttcaggataacctggaagaacaccaggcctggttggacaccgagaaggaggcatttcacttctcccaaaagacacaggaaaatacatcctccgagcagactggcagcagtagctttattccccaactagttcagctgtcatttactagtctggcttcggctgaaagtgggactattctggagcctttgtttacagaaagtgagtcgaaaatattttcctcacacctgcaaatcccacaattacaggaccggctgctgcgtatcagtcagctgatccagccacagcaagacaacctgaaagctttgcaagagcagctcgcaacacagcgcgaagcaattatcctggccaggcaggaagcgagggaagagctgctgcttcaccagagcgagtgggaggggaggataagccccgagcaggtggataccagcagccttcccctggttccccagcattctttcgccagcctgcccttaaatgaaagtgagcggaaccaggagccgtgttctatcaatagcgacaacatcgtttcttccggacacagcgaaattccgacattacctgatgggctgctgggcctgtcccatctggtgcttccccagcaggataatctgattgcactggaggagcaccttcacgcccagactgacttccttccctctatcgagaagacccaaaaagagctcgttcttagtaagccttgcaaattcgaagaaaaggtgagttccgagcattttattcaatctcaccacggcgacttacaggcactgcagcagcagctggacacacagaagaaggcaataagatctatccaagaagtacaggaggagctgctgttgcagaggttgagcgaactggagaaacgggtgtcgtcggaacaggtttgctctagctcctttgtctcgcaggttcccgtagctgactcagagcgcactcagaagagttttccaaccaagtcgaacgacaccctcccatcctctcaccgagagattcccagacttcaggaccgactgttgagcctctccaagcccattctgccgcagcaggacaacatgactgcccaattggatgcgcaaagggaggtgatgtactcttatgagaagccacaggaagagctgtcgctgaataagcaaagaaagcttaataagagcgagagcgccgaacacacaatcccttccctgttcctgcccaaggagacagagcactcgttcatccccttgccattcgcggaggccaaacctaagtctacatgtgagttgtattcgtcccagaatgaacacgctgctcccccatctaaccctgtgattcccggttttcaggatcggctactgagtttctcccaaagcgtgctcactcaacaggataacctcggactccagaagcagttggacttgcagcgagaagtgctccactactcacagaaagctcaagaaaaactgctcgtacagaggcagacagcccttcagcagcagatccagaagcacgaggagacattgaaggacttctttaaagattcccagataagcaaaccaacagtcgagaatgatctgaagacccagaagatgggccagttgcgagactggttccctaacacacaggatctggcgggtaatgatcaggagaacattcgacatgctgatagaaataactctgatgataaccacctggccagtgaggacaccagtgccaagcagtcaggagagcaccttgaaaaggacctcggcagaaggtcatccaagcctcccgtggctaaagtgaaatgcggtctggacctgaatcaacacgaactttccgccatccaggaggttgaatctcctgccatcgggcgtacatccatactggggaagcctgggatttacgaggatcgggaccctctcagggtttccatctcacgtgagcagtccttttttggcagtccgctcgcccacgatcccttttcttgtctccagctagtaggacaggaaaacgtctgcggggacgattatgacgaggccgtgaaattgaaggagtctgtggtggagaaccatgctgttctgtcctacgctgtggaggaggagcatgcctatctggggcctaccgtaaagccggacgacaaggccaagaccttgagctatgagccactgtcttcagcaactgtatccacagggtccttgctatcctacgagaacacggacctgtccctgaccgatccagaaagtttttctgagcacatggatgattcaaaacaggaatccacaacatccaaggaggaagagacaaacataataagttccatagtgccatctacccaagatatttaccagcgccagaacagttctgatgtccacaagtcactcctcccagcagtggatgagacgacctgcggccacactcactttcagcagatgatcgacaaatacatcaacgaagccaacctcatcccggaaaagacagacctgcaagaactggagcacattttccccaacctgcaccatcagctgtttaaaccactagagcctcatccggattttgacctgtcatcttcatcgtctggtatctccccggataatcgggacttttatcaaagatccgacagctcaagtgaatcccactgcgctaccgggctcagcaagagcacggtgtattttacagctctgagacgtacgagtatgcattcctcgcttaacacatctccgaaccagcagcctgatacaaacctagcccacgtgggggctcactctttcgcgaccgaaaatattataggcggttccgagcagtgttttgagcagttacaacccgagtacagttctcaagaggaaagtcaacacgccgatctcccctccatcttttcaatcgaagctcgcgattcctcacagggcatgaaaaaccagaattatccttctgaagaacatacagagattctgcagaacaaaaagaagatcgttcatttccagctgagtataggaaatttgagcagtgtttattcctcaagtgatgaagctaatgttttcgaccagctgaacgttcagcactcaacaccttgcgggagtaactcctcagaatgcagcaccaaacaccagcttgagagccgcaaagagtccatgggattcgaagaactttccaaacggggagtggtgacaatgttgcaaagccaaggactgatcgaagacaataagaatgagacttgcagggtgctggacattaacccacaggttgaggaaactgattctaggctatgtgtccgtactgttgagatggggacttcgattcaggccccttatagtctcacaactcaaaatgaaaagtacttcgaaaacagtgcggaaacagacatccccaaaattacaaagaaactgtcccaactcggtgaaagtgagctgtttgcctcctccggatccttctcccttcaaagcagtattcccgtgtgggaaactgagaccggccacggcatcatggaggaacccgagctgactttgatctccactacagacacctctatcgcagaaatggattttgccaacctgacacttgaggagaagtccgaaaatgaagccaagtgcttttttcaggtttctgagttcttgcctttggtgagcgccacggaggcctcagattaccccgcagtttcagagctctccatcgaaaaacccagaactgcttctacagcagaaactccccgaaggttaacaccagtgcccggaagcctgcaggaagcctttatcaagcgtaagaagagtttcatggagagatctcaccagaggcagaaggaaatccgcaataagatacatgtgagcgaaaattcccagataaagaccgtgaaggagaagccctcaatttcctcctccgtttcaaggttgaagggcgtgaataaggtgcgggcttctttcccagaggatagaaaaaccactcaggcattgaggcatcagaggggtctgagactatacaatcagcttgctgaggtgaagcagcagaaagaggaaaaaactaaacaggaagcatacgcacagaacagagctagggccaaagaatttcataagaaaaccttagagaagctccgagcaaaaaacacttgtta

SEQ ID NO: 29808 - DNA, 1602 bp, Artificial Sequence
  Description of Artificial Sequence: Synthetic coding sequence
tccgccccatccgttgggaatgatatggggaacgacgacgccattggcggtaacgtcagtaaatacatcgtcctccctaccgggtattgtggccagcccaaaaagggccaccttatttttgacgcttgcttcgagagtgggaacctcggaagggtagatcaggtctccgaattcgaatatgacctcttcatcaggcctgatacgtgtaacccgcgattccgtgtgtggttcaatttcacagttgagaatgttaaggagtcacagcgcgtgatctttaatatcgtgaacttttctaaaacaaaatcattataccgtgatggcatggctcccatggtgaagtctacttcacgtcctaagtggcagcggttgcctccaaagaacgtctattactatcggtgccctgatcacagaaaaaactacgtgatgtccttcgccttctgcttcgaccgggaggaagatatctaccagttcgcctattgttatccctatacttacaccagatttcagcactacttggacagcctccagaagagaaacatggactatttttttcgggaacagctcggacagtcagtacagcaaagaaaactagacttgcttacaattacatcccctgataatcttagggagggcgctgaacagaaagtcgtgtttattactggcagagtgcaccctggcgaaacgccgtcgagtttcgtgtgccagggtattattgattttcttgtatcccagcaccccatcgcatgtgtgctgcgagaatatctggttttcaagattgccccaatgctgaatccagacggagtataccttggcaactaccgttgtagtctcatgggtttcgacttaaatagacattggctcgatccatccccctgggtccatccaaccctgcacggcgtcaaacaactgattgtgcagatgtataacgacccaaagacatcacttgaattctatattgacatccacgcccactccacaatgatgaatggttttatgtacggcaatatcttcgaagatgaggaaagattccagcgacaagcaatttttccaaagcttctgtgtcaaaatgccgaggactttagctactcatcaacgagttttaatagagatgcagttaaggcgggaacaggacgccgatttcttggagggctgctggaccatacctcctactgctacactctcgaagtgagcttttacagctatatcatctctgggacaacagccgcagtcccatacaccgaggaagcttatatgaagctgggccgaaacgtggcacgcacattcctggattattacagattaaaccctgtggtcgaaaaggtcgccatccccatgccaaggctccgcaacaaagagatagaggttcaaagacggaaagaaaagagccccccttataaacatcccctgctgcgtggacctgcaagcaactaccccaacagcaaaggagataagaagagctccgtgaatcacaaggatccctctaccccatttaaaacaaggtccccgggacgcagttatggagacagaagcatgcattttctgctgggaaatgaaatcaaccacagctcattagccagtaaggatctttggattaacgcttag

SEQ ID NO: 29809 - DNA, 1509 bp, Artificial Sequence
  Description of Artificial Sequence: Synthetic coding sequence
atgcccgagattagagtcacgccactcggggcatgccctgtgttaagttggaatctggtcctcccccctgggaggggtagtcgggctccttcatccacagatacaagaactgggtttcacgtgctgccacatggcgtggatgacgagttggaaataaaagcctattatgcagggcatgttttaggcgcagcaatgtttcagattaaggtgggcagcgaatccgttgtctacactggggattacaatatgacgcccgatcgccatctgggtgccgcatggatcgacaaatgccgaccgaatctgctcattaccgagtcaacttacgcgacgaccattagggacagtaaacggtgtcgcgagagggacttcctgaagaaagttcacgaaactgttgagcggggagggaaagtgttaatcccagtttttgctctggggagggcacaggagttatgtatcctgctggaaactttctgggaaagaatgaatctgaaggttcccatttacttcagtaccggcctaacagagaaagccaatcattattacaaactctttatcccctggaccaatcagaaaataagaaagacctttgtgcaacggaacatgttcgagtttaaacatattaaggcctttgacagggccttcgccgataacccaggtcccatggtggttttcgccacgcctgggatgttacatgcagggcagtcgctccagatcttcagaaagtgggccggtaatgaaaagaatatggtgatcatgcctgggtactgcgttcagggtacagttggccacaaaattttgtctgggcagaggaagctggagatggaggggaggcaagtgctagaggtgaagatgcaagtcgagtacatgagcttcagcgcacacgccgacgcgaaggggatcatgcaactagtgggccaagccgaaccggagtctgtcctcctggtccatggggaagccaagaagatggaatttctgaaacagaaaattgagcaagagctacgggtgaattgctacatgcctgcaaacggggagacagtcaccttgccaacctccccaagtattccagtcgggatttctctcggtctgttaaagcgggaaatggcgcagggccttctcccagaagccaaaaaacctcgcttacttcacgggacccttataatgaaagattcaaacttcagactagtctccagcgagcaggcccttaaagagttaggcctggccgagcatcagctgagatttacctgtagggtgcatctgcacgatacaaggaaggaacaagaaactgccctgcgcgtttacagccatcttaaatctgtgctgaaggaccactgcgtacagcacttgcccgatggcagtgtgaccgtggaaagtgtgctgctacaggcggctgcaccgtccgaagatcccggaaccaaagtgcttctggtttcatggacatatcaggacgaagagcttggctcttttctcacctccttgctgaagaagggtctgccccaagcgccaagttag

SEQ ID NO: 29810 - DNA, 1371 bp, Artificial Sequence
  Description of Artificial Sequence: Synthetic coding sequence
atggccgattctctggaaagcactcccctgcccagtcctgaggataggcttgctaagctgcatccctctaaggaattactggagtactaccagaaaaagatggccgaatgcgaagcagaaaatgaagatctgttgaaaaagctggagctctataaggaggcctgcgagggccaacataaacttgaatgcgacctccaacaacgcgaagaagagatcgcagaactgcagaaggcgctgagcgatatgcaggtgtgcctttttcaagagagagaacatgttctgcggctgtattcagagaacgatcgactacggattagggagctagaagacaaaaagaaaattcagaatcttttagctctggtgggtaccgacgctggggaggttacatacttctgtaaagagcctccacacaaagtgacaatcctgcagaagacaattcaggccgtcggggagtgcgagcagtctgaaagcagcgcctttaaggcagacccgaaaatcagtaaacgccgtccctcaagagagcggaaggagtcaagtgagcactatcagcgtgatattcaaacactgatccttcaggtggaggctctgcaggcccagctgggggagcagaccaagctgtcacgggagcagattgaagggttgattgaagatcgacgtatccacctcgaggagatacaggtccagcatcagcggaatcaaaacaagatcaaagagttgacaaagaacctccatcatacacaagaacttctgtacgagtcaaccaaggattttttgcaactgaggtctgaaaaccagaataaggagaaaagctggatgctggaaaaagataaccttatgtcaaaaatcaagcagtatcgggtgcagtgtaagaagaaagaagacaagatagggaaggtgctgccggttatgcacgagtcacatcacgcccaatcggaatacattaaaagcctgaaagataagttggttcaggaaaaaaaactgagtaatatgtatcaggaacagtgtatctcactagaggaagagttggctcggatacgggaggaggagggcatgcggagagaaatcttcaaagacagaacaaacaaaatgggtaagagactgcagataatgacaaaaagatacgaagcgttggaaaggcgcagaattctggaagttgaggggttcaagacagacatcaaagtgctaagacagaagcttaaggatctggaacagatgctttataaagccacagtcaatgcaagggctaaccaggacctggccctgctttgcgaggtgcgggattctaatcggcgagcacacaagattcagggcgaactgaaaaatctcaaatctaaagtttttggtctcgaaaacgagcttcgcctgtgctag

SEQ ID NO: 29811 - DNA, 270 bp, Artificial Sequence
  Description of Artificial Sequence: Synthetic coding sequence
atgagcgagcagggagacctgaatcaggcgatagctgaggaaggcggtacagagcaagaaacagcaacccccgagaatggaatcgtgaaatcggagagtctagacgaggaggagaagttggaattgcagaggcgtttggaggcacaaaaccaagaacggcgaaaatcaaagtcaggggcaggcaaagggaagttgacccggagcttggcagtttgcgaggaatccagtgccaggccaggcggagagtcactccaggaccagacgctctag

SEQ ID NO: 29812 - DNA, 453 bp, Artificial Sequence
  Description of Artificial Sequence: Synthetic coding sequence
atgcaccccgaggacagcgtcgtgagctcaaaagtgctcggatgttcacacttccccgtcgccagcagacccgctggatcccacgacccccagccgggacaccggggacgggtgcttggccctgcgagggctccaggctgggttcggtatgcagaacgagtgttgggacggcctattaccgctcatctctgtactgctaagagtccccagcaggtgatgggctccctcgtcaaggattactttgcaagacaacagaacctgagccctgaaaaaatcttccacgtgattgtcgccccttgctacgataagaagttggaagcactgcaggaaagcctcccgccagcattgcacgggtcccgcggagctgattgtgtgctaactagcggggaaattgctcagatcatggagcagggagatctgagtgtcagggacgctgctgtggatacactctag

SEQ ID NO: 29813 - DNA, 534 bp, Artificial Sequence
  Description of Artificial Sequence: Synthetic coding sequence
atgggctgctgcgggtgtagtcggggatgtgggagtgggtgtggcggatgcggcagctcctgcgggggttgtggctctggatgtggcggttgtggttctgggcgagggggttgtgggtctggttgtgggggttgttcctcctcctgcgggggttgtggttctagatgctatgtcccagtttgttgctgcaaaccagtgtgttcctgggtccctgcttgcagctgcacctcatgtggatcttgtgggggaagcaaagggggatgcggctcttgcggaggcagcaaagggggttgtggctcttgtggcggttcaaagggtgggtgcggaagctgtgggtgttctcagtcatcttgctgcaagccttgttgttgttcctctggttgtggatcctcctgctgtcagtcttcttgttgcaagccttgctgttgccaatcttcgtgctgtgtcccggtgtgctgccagtcgagctgttgcaagccgtgttgctgccaatcaaattgttgcgtgccggtgtgctgccagtgtaaaatctag

SEQ ID NO: 29814 - DNA, 294 bp, Artificial Sequence
  Description of Artificial Sequence: Synthetic coding sequence
atgccggctgaattgtggttaacatcatatggtgtgcgggaggtggatcaagttaagcggcttacagggccaggcctgtctgaggggcctgagccctccataagcgtgatggttaccggagggccttggccaactaggcttagccggacgtgtcttcactatctcggtgagttcggggaggaccagatctacgaagcccatcaacaaggccgaggtgcactagaggccctgctgtgcggcggtccgcaaggtgcgtgcagtgagaaagtgtcagctacccgtgaagaactgtag

SEQ ID NO: 29815 - DNA, 264 bp, Artificial Sequence
  Description of Artificial Sequence: Synthetic coding sequence
atggagaaccagctggccaagtccacggaagagaggactttccagtatcaggactccttgccaagcttgccagtgccatcactggaggaatccttgaaaaagtatttagagagcgtgaagcctttcgctaatcaggaggagtacaagaagaccgaagagatcgttcaaaaatttcagtctgggatcggcgaaaagttgcaccaaaagctactggagcgcgctaaaggtaaacgcaattgggtctttgttgtgatcatcgaatag

SEQ ID NO: 29816 - DNA, 1881 bp, Artificial Sequence
  Description of Artificial Sequence: Synthetic coding sequence
atgtgcagcactctgaagaagtgcggaacctaccggaccgaggttgcagagtgccatgaccatggatcaaccttccagggacgcaagaaaggcggttctagcttccgagataatttcgacaaacgcagttgccactacgaacacgggggttacgagcgtccgccaagccattgtcaagagaatgatgggtcagtggagatgcgtgacgtgcacaaggatcagcagctaagacacacaccctatagcatcaggtgtgagagaaggatgaagtggcactctgaagatgagattcggataactacctggcggaaccgaaaacccccagagagaaaaatgtctcaaaatacacaggacggctacacccggaactggttcaaggtgaccattccatacgggataaagtacgataaagcgtggctaatgaactccattcagtcacactgttcagatcgctttacacccgtcgactttcattatgtgcggaaccgagcgtgcttcttcgttcaggatgcctccgccgctagcgccttgaaggatgtgtcatataaaatttatgacgatgagaatcagaagatttgcattttcgttaatcatagcacagccccttattcagtcaagaacaagttgaaacctggacagatggagatgttgaaactgaccatgaacaaacggtataatgtgtcgcagcaggccctggatctccagaacctccgattcgacccagatctaatgggacgtgatatcgatataatcttgaaccgtcgcaactgcatggccgctacgctgaaaattattgaacggaactttcccgagctactgtctctcaatctgtgcaacaataagctttatcagcttgacggcctctctgatattactgaaaaggcaccaaaagtgaagactctgaatctgtctaagaacaaacttgagagtgcatgggagctggggaaggttaaggggttgaagctggaggagttatggctcgaaggtaatccactatgttccactttttccgatcagtctgcgtacgtctcagccatcagagactgctttccaaaactgctgagattggacgggagagaactgagcgcacctgtcattgtcgacattgattccagcgagacaatgaaaccgtgcaaagagaacttcacaggtagtgaaactctaaagcaccttgtactgcagttcttgcagcagtactatagtatctacgacagtggcgatcggcaaggactgctcggcgcttaccacgacgaggcctgtttctcgctggcgatcccttttgatcccaaagacagcgccccaagttccctgtgcaaatatttcgaagacagccggaacatgaagaccctgaaagacccatatctcaaaggcgagctgcttcggagaactaaaagggacatagttgactcactgtccgctctccccaagacccaacatgacttgagttcaattttggtcgacgtatggtgccagactgaacggatgctgtgtttttctgttaatggtgtgtttaaagaggtggaaggacagtcccagggctccgtgcttgcattcactaggacatttattgctactcccggttccagtagctctctgtgcattgtaaacgacgagctctttgtccgcgacgcttcccctcaggagacccagagtgcattttccattcctgtaagtaccctgagttcttcttccgagcccagtctgagtcaggagcagcaggagatggtccaagcattctctgctcagagcggcatgaaattggaatggagccagaagtgcctgcaggacaacgagtggaactacactcgtgcaggtcaggctttcacaatgctgcagacagagggaaaaatccctgcagaggcattcaagcagatttcttag

SEQ ID NO: 29817 - DNA, 2940 bp, Artificial Sequence
  Description of Artificial Sequence: Synthetic coding sequence
atgttatgctggggtaatgcctctttcgggcagttaggccttggcggtatcgatgaagaaatcgttcttgaaccgaggaaaagtgacttcttcattaacaagcgcgttcgggatgtgggttgcggtcttcgccatacagtgtttgtgctggatgacgggacggtatatacgtgtgggtgtaacgatctagggcagttgggccatgagaagtcccgaaagaaacctgagcaagtggtggctctggacgcccagaatatcgtcgctgtctcatgtggcgaggcccataccttagctctcaatgataagggacaggtctatgcatggggactcgattctgatggacaactggggctggtaggctcagaggaatgtataagagttccgagaaatattaaaagtttatccgacatacagatcgttcaggtggcatgcgggtactaccacagcctggctctgagcaaggcaagcgaggttttctgctgggggcaaaacaagtatgggcagctgggtctgggcactgattgcaagaagcagacctctccgcagttgctgaagagtttgctcggcattcctttcatgcaggttgccgcaggcggagctcactcgttcgtgcttacactgtcaggcgcaatttttggctggggaaggaataagttcggtcagctgggcctgaatgatgagaacgatcggtatgtgccaaacctgttgaagtctctacggagtcagaagattgtttatatctgttgcggggaggaccacacagcagccttgacgaaggaaggaggagtgttcacatttggcgctggaggatacggacaattgggccataatagtacaagccatgaaatcaacccgaggaaggtctttgagctaatgggcagcattgtcaccgagattgcctgcggcaggcagcacactagtgcgttcgtgccctctagcggccgaatctattcattcggactcggcggaaatggtcagttgggcactggatcaacttccaaccgaaaaagccccttcactgtgaaggggaactggtatccctataatgggcagtgtctccctgacattgatagtgaggagtacttctgtgtaaagaggatcttttcaggcggtgaccaatctttctcgcactactctagcccgcagaattgcggccctcctgacgactttcggtgtccaaaccccactaagcagatctggactgtgaatgaggccttaatacagaaatggctgtcctacccttccggtaggttcccggtggaaatagccaatgagatagatggcacattcagctcaagtggctgtttgaacggctcgttcctcgctgtttccaatgatgaccattatagaacaggcaccaggttcagtggcgtggatatgaacgctgcccgtctcctgttccataagctgatccagccagaccatccacagatctcgcagcaggtggcagcctcgctggagaaaaatcttattcctaaattgacaagcagcttgcctgacgttgaagccttgaggttttacctgacgctgcccgaatgtccactgatgtcagatagtaataatttcacgacaatagctatcccgtttgggacagccctggtgaacctcgagaaagcccctctcaaggtcctggaaaactggtggtccgttttggaacctccattgttcctcaaaattgtggaacttttcaaggaagtggtggtgcaccttcttaagctgtataaaattggcatcccccctagtgagagacggatcttcaacagttttctccacactgccttaaaagtgctcgagatactgcatcgggtaaatgaaaaaatgggacaaattattcagtatgataaattttatattcatgaagtccaggagcttatcgacattaggaatgactacatcaactgggtccagcagcaagcctatgggatggacgtgaatcacgggctgacagaactggctgacatccccgtgaccatatgcacttacccatttgtctttgacgctcaggcaaagactaccctcctgcaaacagatgcagtcctgcagatgcagatggctatcgatcaggcacaccgacagaacgtgagcagtctgtttttgcctgtcatcgaatcagtcaatccatgcctgattctggtggtgcgcagagagaacattgtgggcgatgcaatggaggtgctgagaaaaacaaaaaacattgactacaaaaagcccctgaaggtcatatttgtgggcgaagacgccgtggacgcaggaggcgttagaaaggagttctttctgctcatcatgagggagctcctggaccccaagtatggaatgttcaggtactacgaggattctcggctcatatggttcagtgacaaaatcactgttgagaattttggagccacagaagtgaaggagctggtgctaaatggagccgacaccgcggttaataagcagaatcgccaggaatttgtggatgcttatgtggactacatctttaacaagtccgtggcctctctttttgacgcgttccatgccggattccataaggtctgcgggggtaaggttctgctgctcttccagccaaatgaactgcaggcaatggtcattggcaacactaattatgactggaaggagctggaaaaaaacacagaatataagggtgagtattgggcagaacacccaaccataaagatcttctgggaggtgtttcatgagctgccactagagaaaaagaaacagttccttcttttccttacagggtctgatcgcatacccattctcgggatgaaatccctgaagctagtcatccagagtaccggtggaggagaggaatatttgccagtgagccatacctgtttcaacctcttagatcttcctaaatatacagagaaagagacactgcggagcaagctgatacaggccattgaccataacgaaggcttctcactcatttag

SEQ ID NO: 29818 - DNA, 1020 bp, Artificial Sequence
  Description of Artificial Sequence: Synthetic coding sequence
atgaagattttcgtgggcaatgttgacggcgcagatactaccccagaagaattggccgcactgtttgccccttatggaaccgtcatgtcctgcgctgtgatgaagcagtttgcattcgtgcacatgcgcgagaacgctggcgcactgcgagccattgaagcactccatgggcatgagctgagacccggacgcgcactcgtggttgaaatgagccggcctagacccctgaacacttggaagatcttcgttggtaatgtttccgctgcctgcacatcacaggaactccgtagcctgtttgagcgcaggggacgagtgattgagtgcgatgtggtgaaagggaagcggatgcacgtgcaactcagtaccagcaggttgcgcaccgcccctggaatgggggaccagagtggttgctatcgatgcggcaaggaaggtcactggtctaaggagtgtcctatagatagaagtggcagagttgccgatttaaccgaacagtataatgagcagtatggagcagtgagaacaccatacaccatgagctacggcgattctttgtactacaacaatgcatacggtgccctggacgcctactacaagaggtgtcgggctgctagaagctatgaggccgtggccgctgcagctgcttcagtgtacaattatgccgagcagaccctttcccaattgcctcaggtccagaatacagcaatggcatcacacctcaccagtaccagcctggatccatacgatcggcatctcctgcctacatctggggctgccgctacggcggctgccgcagcagctgctgctgcggctgtcaccgcagccagcacatcctattatggacgtgatcgctcccctctacggcgtgctaccgcacctgtgccaactgttggcgaggggtatggttacggccatgagtccgaactgagccaagcgagcgcagcggctcgcaattccctttatgatatggctagatacgagcgggaacagtacgccgatcgtgccaggtacagcgcattttag

SEQ ID NO: 29819 - DNA, 390 bp, Artificial Sequence
  Description of Artificial Sequence: Synthetic coding sequence
atggcggaactcatccagaaaaaactgcagggcgaggtggagaagtatcaacagctccagaaagatttgtctaagagcatgtccggcagacagaagcttgaagcccagttgacagaaaataacatcgttaaagaggaactggctctgctcgacggctcaaacgtcgtgtttaagctgctaggcccagtgttagtgaagcaggagctcggcgaggcacgggctacagttggcaagcgtctcgattacatcacagcagagattaaaaggtatgagtcacagctacgagatctggaacgccagtcggagcagcaacgcgaaacccttgcccagttgcaacaagagtttcagcgtgctcaagcagcaaaggctggagctcctggaaaagcgtag

SEQ ID NO: 29820 - DNA, 1695 bp, Artificial Sequence
  Description of Artificial Sequence: Synthetic coding sequence
atgtcatatcccgctgacgattatgaatcggaggcagcttatgacccctacgcctatccctcagactacgatatgcacacgggtgaccccaagcaggaccttgcctacgaacgccaatatgaacaacagacctatcaggttatccccgaagtcatcaagaacttcatccagtattttcataagacagttagcgatttaattgatcagaaagtatacgagctgcaggcgtcaagagtgtcttcggatgtcatcgaccagaaggtgtatgagattcaggacatatacgaaaatagttggaccaaattaactgagagatttttcaaaaacacgccttggccggaggctgaggcaattgctccccaggtgggtaacgatgccgtgttcctcatcctatataaagagctgtactataggcacatctacgctaaggtctctgggggtcctagtttagagcagaggttcgaaagctactacaactattgcaatcttttcaattacatcctcaatgccgacgggcctgctcccctggagctacccaaccaatggctgtgggatatcattgacgagtttatctatcagtttcagtcattctcgcagtatagatgtaagactgccaagaaatccgaggaagagatcgattttttaagatcaaacccaaaaatctggaacgtgcattcagtgcttaatgtgttgcattctctggtcgataagagcaacattaatagacagctcgaagtgtatacttcaggcggagatcctgagtctgtcgccggtgagtacggccgacactctctatacaagatgctgggatatttctcactcgtcggcctgcttcgcttacactccctgctgggggattattatcaggcaattaaggtcctggaaaacatcgagttaaataagaaaagtatgtattctcgggtccctgaatgtcaggtaaccacctactattacgttggattcgcttatctgatgatgagaaggtatcaggatgcgattcgggtcttcgcaaatattcttctgtatatccagcgtacgaagtccatgtttcagaggacgacgtataagtatgaaatgattaacaagcagaacgagcagatgcatgcattgctggccattgccctgacaatgtatcccatgcgcattgatgagtcgattcacctgcaactccgcgagaaatacggagacaaaatgctgcgaatgcagaaaggcgacccacaagtatacgaagagctgttcagctacagctgtcccaaattcctatcgcctgtcgttcccaactacgataatgtccatccaaactatcataaggagccatttctgcaacaactcaaggtattctctgacgaggtgcagcagcaagcccagctgtccactataaggtcgttcctgaaattatatacgactatgccagttgcgaaactggcaggctttctggacttaaccgaacaagagttccgaatccaactactggtgttcaaacataagatgaaaaacttggtttggacgtccggaatcagcgcattggacggcgaattccagtcagcatcagaggtggacttttacattgacaaggatatgatccacattgccgataccaaagtcgccaggaggtacggggacttttttatccggcaaatccacaaattcgaagagctgaacaggacacttaagaaaatgggtcagagaccatag

SEQ ID NO: 29821 - DNA, 789 bp, Artificial Sequence
  Description of Artificial Sequence: Synthetic coding sequence
atggcactgtctctgggctggaaggcacacaggaaccactgtggtctcttacttcaggccttgagatcaagcgggcttctattgttcccttgcggacaatgtccttggaggggcgctgggagctttctggaccctgagataaaagcattcttggaagaaaacacagaggtcaccagtagcggtagtctgacccccgagatccagctgagactgctcacccccaggtgcaaattttggtgggaacgggcagatctgtggccgcattccgatccctattgggccatctactggcccggaggacaggctctatccagatacttgcttgacaaccctgatgtcgtgagaggcaagagcgttctggacctaggctctggttgcggagcgaccgcaattgccgctaaaatgagtggcgcatcccgcatccttgccaatgacattgaccccatcgccggaatggccattaccttaaattgcgagctcaacaggttaaacccctttcctattctgatacagaacatactcaatctggaacaggacaaatgggatttagtcgtcctgggggacatgttttacgacgaagatctggccgactccctgcatcaatggttaaagaaatgtttctggacataccgcacacgggtcctaataggcgaccctgggaggccacaattttctggtcattccatccaacaccaccttcataaggtcgtcgaatactctttgcttgagtctacccgtcaagagaactccggactgacgacttcaacggtatggggctttcaaccatag

SEQ ID NO: 29822 - DNA, 1626 bp, Artificial Sequence
  Description of Artificial Sequence: Synthetic coding sequence
atgtcctcttgcgtttcctcccagccatcgtcaaatcgtgcagcccctcaggatgagctaggcggacgcggatcctctagctctgagagtcagaagccgtgtgaagctttacgaggacttagttccctgagcatccacctgggaatggaatcttttatcgtggtaaccgagtgtgaaccaggctgcgctgtggatctcggactggcaagagatagaccgctcgaagccgacgggcaagaagtgcccctggacactagcggttctcaagccagacctcaccttagtggcaggaaactgagcctccaggaacgcagtcaggggggtcttgccgctggcggatccttggacatgaatggacggtgcatttgtccgagcctcccgtattcgcctgtgtctagcccccagagcagtcctcgtctcccccgaagacccacagtggaatctcaccatgtctccatcaccgggatgcaagattgtgtgcagctgaaccagtatacgcttaaggatgaaatcggcaaggggagctatggggtagtgaaactggcctataatgaaaacgataatacttactacgctatgaaagtactctccaaaaagaagctgatcagacaggccggatttccacgtagaccccctccgaggggcactagaccagctcccggaggatgcatccagcctaggggacctatcgagcaggtataccaggaaatcgctatcctcaagaaactggaccatcccaatgtcgtgaagctggtggaggtgcttgatgatcctaatgaagatcatttatacatggtcttcgaactagtcaaccagggaccagtcatggaagttccaacactgaaacccttgtcagaggatcaggcaagattctattttcaggacctgattaagggcattgagtacctccattatcaaaagattatccatcgtgacatcaaaccctctaacttactcgtcggcgaggacggccacattaagatcgccgatttcggggtaagcaatgaatttaaggggagcgatgctcttctgtcaaatacggtgggcacccccgcattcatggccccagagtccctttccgagactagaaagatttttagtggcaaggcactggatgtgtgggccatgggtgtaaccctgtattgtttcgtatttggccagtgtccctttatggatgagagaataatgtgcctgcactctaagattaaaagccaggccctggaattccccgaccagccagatattgcagaggacctaaaagacctcattacccggatgctggacaagaaccccgagagtaggattgttgttccggagatcaaactacatccatgggtgacacggcacggcgctgaaccccttcccagtgaagacgaaaactgcaccctcgtagaggtgacagaagaggaagtggagaactccgtgaagcacatcccctcactagcaactgtgatcctagtcaagaccatgatcagaaaacggtcatttggtaacccatttgagggctctaggcgcgaggagagatctctatcggctcctgggaatctactcaccaagcaggggagcgaggataacctgcagggaaccgatcctccccctgtgggggaggaggaagtcctcctgtag

SEQ ID NO: 29823 - DNA, 303 bp, Artificial Sequence
  Description of Artificial Sequence: Synthetic coding sequence
atgtccacgataggcagctttgagggattccaggcagtcagcctcaagcaagagggggatgatcaaccctcagagacagatcacctcagtatggaggaagaagatcccatgccccgacagattagccgtcagagcagcgtgacggagtccactctgtatccaaacccataccatcaaccctatataagccgcaagtattttgctactagacctggcgctattgagacagctatggaagacttaaagggccacgtcgctgaaacttcaggagagacaatccaagggttttggttgctcacttag

SEQ ID NO: 29824 - DNA, 1425 bp, Artificial Sequence
  Description of Artificial Sequence: Synthetic coding sequence
atggagcggtctggtcagcgtgtgaccacgtgggactgcgaccaagggaagcacagcgactctgactatagagaggacggcatggatttggggtctgacgccggatcatccagttcctcctctagggcgtcttcgcagagcaactctaccaaagtaaccccctgcagcgagtgcaagagttcgagcagcccgggtggctcactggatcttgtttccgcattagaggactacgaggagcctttcccagtgtaccagaagaaggtcatcgacgaatgggcccctgaggaagacggcgaggaagaagaggaagaggatgagcgggatcaaagaggatacagggacgatcgttcccccgctcgggagcctggggacgttagtgctagaaccaggtcgggtggcggtggcggaaggagcgctaccacagctatgcctccacccgttcctaatggcaatctacatcagcatgatccgcaggatctgagacataacgggaatgtcgtggtagccggaaggccatcttgttctcgcggtccacggagagcaatccagaaaccccagcccgcaggcggacggaggtccggacgcggtcctgccgctggcggactttgcctgcagcctccagacggcggaacttgcgtacctgaggagccgcctgtgcccccaatggactgggaagccctcgaaaagcacctggccggtctgcagtttcgcgaacaggaagcgcagaagaacgagcgagaatcaatccgacagaagctcgcactgggctctttttttgatgatggccctggtatctatacttcttgcagtaagtccggcaagccctctttatctagcaggctgcagagtggaatgaacctccaaatctgtttcgttaatgattcggggtcggacaaggatagcgacgctgacgactccaagactgaaacgtctctggacaccccactgagccccatgagtaaacaatcctcatcttattcagatcgagacactacagaggaggaatccgagagcctcgacgatatggacttcctcacccgtcagaaaaaattgcaggccgaggcaaagatggcgctggccatggctaaacctatggctaagatgcaggtggaggtggagaagcagaatcggaagaaatctccagtcgctgatctgctgccccatatgccacacatcagcgagtgcctcatgaagcggagtctgaagcccacagatttgagggacatgaccatcggacagctccaggtgatcgtcaatgacttgcactctcagatcgaatctcttaatgaagagttagtgcagctgctgttgattcgagatgagctacacaccgaacaggatgcgatgctcgtggatattgaggatctcacaaggcatgcagaatctcagcagaagcatatggctgagaaaatgcctgcaaagtag

SEQ ID NO: 29825 - DNA, 690 bp, Artificial Sequence
  Description of Artificial Sequence: Synthetic coding sequence
atgcagcagcgcgtgctggagctgattccacaaatcgccaacgagcaactgacagaagaacttctgatcgtcaacgacaacctcaacaacgtgttcttgcggcacgaacgcttcgaaaggttccgcacaggacagaccaccaaagcgccatccgaggctgagccagccgcagatttaattgacatggggccagatccggctgccacaggcaacctgtcctcgcagctcgctggaatgaacctgggcagcagctcagtgcgcgctgggctgcagtccctggaagcttccggcaggctagaggacgagttcgatatgttcgcactgaccagggggtcgagcctcgcagatcagcgaaaggaagttaaatacgaggcacctcaggctacggatggactggctggagcccttgacgccaggcagcagtccactggcgcaatccccgtcacacaggcctgtctgatggaagacatcgaacagtggttatctactgatgtgggcaatgatgctgaagagcccaaaggggtgacttcagaggaattcgacaaattcttagaggaaagggcaaaagcagccgaccgtttacctaacttgtctagcccgtctgcagaaggcccaccaggtcccccatcaggacctgcacctcgcaagaaaacacaggaaaaggacgatgacatgctgtttgccctgtag

SEQ ID NO: 29826 - DNA, 1650 bp, Artificial Sequence
  Description of Artificial Sequence: Synthetic coding sequence
atgtccagggtggcaaagtacaggcgccaagtctcagaggaccccgatatcgattcactgttagagacattgtcaccagaggaaatggaggaactcgagaaagagctggacgttgtggaccccgacggttcagtgcctgtggggctgcgacagcgcaaccagaccgagaaacagagcaccggggtatataacagagaggctatgctcaacttctgcgaaaaagagactaagaaacttatgcagcgcgagatgtctatggatgagagtaagcaggtagagaccaagacagatgcaaaggaagaaaaaattattagagggatcgacaaaggccgtgtcagggctgcagttgataagaaagaggcgggtaaggacggacgaggcgaggaacgagccgttgccacaaagaaagaagaggagaagaaaggctccgaccgaaatacaggcttgagtcgcgacaaggacaaaaagcgcgaggagatgaaagaggtagcaaaaaaggaagacgacgagaaggtgaagggagaacgcaggaataccgacacccgcaaggaaggcgagaaaatgaagcgggctgggggtaataccgatatgaaaaaggaagacgagaaggtgaaacgcggtacaggcaacaccgataccaaaaaagacgatgagaaggtgaagaaaaacgagcccctccacgagaaggaagctaaagatgactctaagactaagactccggagaagcagaccccctctggcccaacgaaaccctctgaagggccagcaaaggtagaggaagaggcggcaccttccatcttcgatgaacccctggagcgcgtaaaaaataacgacccggaaatgacagaggtgaacgtcaacaacagcgattgcattacaaatgagatactcgttagatttaccgaggcacttgagttcaacacagtcgttaagctgtttgctctagcaaacaccagggcagacgaccatgtggccttcgccatcgccattatgctgaaggcaaacaaaacaataacatcgcttaaccttgattctaaccatattactggcaagggtatcctggccatatttagagctttgctgcagaataacaccttaacagagctccgctttcacaatcagcgccacatttgtggagggaagacagagatggaaatagctaaactgctgaaggagaacaccactctgctgaagctcggctaccacttcgaactggcaggtcctcgaatgactgtaacaaacctgctgtctaggaacatggacaagcagaggcagaaacgtctgcaggagcagcggcaggctcaagaggccaagggtgaaaagaaggacctgctggaggtgcctaaggccggtgcagtagccaagggcagtccaaaaccctctccacagccctctcccaagcctagccccaagaactcaccaaagaagggcggagccccagccgcacctccccctcctcccccaccgctagccccacccctgataatggagaatttaaagaattctttgagtcccgcaacccagaggaaaatgggagacaaggtgctgccggcacaagagaagaatagcagggaccagctcctggccgctatccgcagctctaacctcaaacaattgaagaaggtggaagtgcccaaactgctgcagtag

SEQ ID NO: 29827 - DNA, 231 bp, Artificial Sequence
  Description of Artificial Sequence: Synthetic coding sequence
atgtccgcctcctgcgacggatgcgtgggttctcgtccccctgtgcacctcgccagcggttatagcctagcggacttgttagttctggagatggggatgggaacccaatgttggaccgaagatcagcgtaggtggagttctctttggccatggtcacacctgtcttctgaccctagtttgcccaatgtgcaagtcacacgtctaacacttctgtcggagcaggctccctag

SEQ ID NO: 29828 - DNA, 1416 bp, Artificial Sequence
  Description of Artificial Sequence: Synthetic coding sequence
atggctaacagcttcgcggctagaatctttaccaccctgtctgatttgcagaccaatatggctaatctgaaagtaattggaatagtgattgggaaaacagatgtcaaggggtttccagaccgtaagaatataggaagtgagcgatacacattttcattcacaattcgggattcccctgcccatttcgtcaatgccgcatcctgggggaacgaagattacataaagtccctgtccgacagtttccgcgtgggggactgcgtgataatcgagaaccctctaattcagagaaaggaaattgaacgggaggagaaattctcccccgctactccatctaactgcaaactccttctgagtgagaatcattctacagtcaaggtttgttcttcctacgaggtcgataccaaactgctttccctgatccaccttcctgtgaaggagtcacatgactattactctctgggggatatagtcgccaatggacactccctgaacggaagaatcatcaatgtgttggcagctgttaagagcgtgggtgagcctaaatatttcaccaccagtgacaggcggaaaggccaacgctgcgaggtcagactctatgatgaaacggagagcagctttgccatgacttgctgggataatgaatcaatcctcttagctcagtcttggatgccgcgagaaactgtgatttttgcgtctgatgtgagaattaattttgataagtttcgtaactgtatgacagcaacagtgatcagcaaaacaattattaccacaaacccagacattcctgaagccaatattctgcttaattttatccgagagaataaggagacaaacgtgcttgacgatgagatcgattcatattttaaggagtccattaacttgagtacgatcgtggatgtgtatacagtcgagcagcttaagggaaaagccctgaaaaacgaagggaaagcagatccctcttatggaatcctctatgcgtatatctctaccctcaacattgacgatgaaactacaaaagtggtgcggaaccggtgttccagctgtggatatattgtgaacgaagcctcaaatatgtgcactacatgcaacaagaattccctagattttaagtccgtctttctttccttccacgtgcttatcgacttgactgatcatactggaaccctgcattcatgtagccttaccgggagtgtagccgaggaaacgcttggatgcactgttcatgagttcctggctatgacggatgaacagaaaacagcattgaaatggcagttcctattggaacggtcaaagatctatctcaaatttgtcctgagccatagggctcgaagtggcctgaagatttccgttttatcttgcaagctggcagatcccacggaagctagtcgcaatctgtccggacagaagcacgtctag

SEQ ID NO: 29829 - DNA, 747 bp, Artificial Sequence
  Description of Artificial Sequence: Synthetic coding sequence
atggccacaagcgctccactgcgatcccttgaggaagaagtcacatgcagtatatgtcttgattatttaagagatcctgtaacaatcgattgtggacatgtgttttgtaggtcttgcactaccgacgtgcggccaattagtggcagccgacctgtctgtcccctgtgtaagaagcccttcaagaaagaaaacattaggcccgtgtggcagctggctagcttagtggagaatattgagcgactgaaagtggataaaggcagacagccaggcgaggtgactcgagagcagcaagatgcaaaactgtgtgaacgacacagagaaaagctccattactactgcgaagatgatggaaagcttctgtgtgtcatgtgcagagagagtagggagcaccgccctcacacagccgttctgatggagaaagccgcacagccccacagagaaaagattttaaatcacctgtcgacacttagacgggatagggacaagattcagggctttcaggctaaaggagaagctgatatcctggcagcccttaagaagctgcaggaccagcgccagtacatcgtcgcagaattcgagcagggccatcaatttctgagagaacgggaggagcatctactcgagcagcttgctaaactcgagcaggaattaacggaaggccgtgagaaatttaaatcccgcggagtgggcgagctcgctagactggccctggtcatctccgagcttgagggcaaagcgcagcagtag

SEQ ID NO: 29830 - DNA, 2646 bp, Artificial Sequence
  Description of Artificial Sequence: Synthetic coding sequence
atgttttggaagttcgacctgcacactagctcgcacctggatacactgctcgaacgcgaggatctgtcactccccgagctattggatgaggaggacgtattacaggaatgcaaggtggtgaacagaaagttgttggactttctgcttcagcctccacacctccaggccatggtcgcatgggttacacaagagccacccgatagcggcgaggaaagattgagatataagtatccaagcgtagcctgtgagatactaactagcgatgtaccacagatcaatgatgctctgggagccgacgaaagtctgctgaaccgtttgtatggatttctgcagtctaccggatctctgaatccgctccttgcctcatttttcagtaaagtaatgggtatcctgattaacagaaagaccgaccagttggtgtccttcttgaggaagaaagatgatttcgtggatctgctcctgcagcacattgggacctccgccatcatggatctgctcttgaggctcttgacatgtgtcgagagaccacagttgaggcaggacgtagtcaattggctgaatgaggaaaagatcgtccaacgcctgatagagcagatccacccaagtaaagacgagaatcaacacagtaacgcaagccaatccctgtgtgacattatcagactcagccgggagcaaatgattcaggtgcaggactctccagaaccagatcagctactcgcaaccctggagaaacaggagaccatagaacagctcttgtccaatatgttcgagggcgagcagagccaatcagtaatcgtcagtgggattcaggtgctgctcacgctattggagcccaggaggcctcgaagtgaatctgtgaccgtcaacagctttttctctagcgtcgatggccaactcgagctgctggctcaaggcgcactggagagcaccgttagttccgtgggtgcactgcacgccctcagaccaaggctgtcatgcttccaccagctcttgctggagccacccaaactagaacccctgcagatgacctggggtatgctggcccctcctctgggtaatactcgactacatgtggtcaagttgctggcatccgccctgagcgccaatgacgccgctctcacacatgagctcctggcccttgacgttcctaacacgatgctggatttgttttttcattatgtctttaataactttttacatgcacaggtggaggggtgcgtatcaacgatgctgtctctgggacccccacctgatagctctcctgagacgcccatacaaaacccagtggtgaagcacctgttgcagcagtgcaggctggtcgaacgtatcctcacttcatgggaagagaacgatcgagtgcaatgtgctggaggaccccgtaagggctacatgggacacctgacccgagtcgcaggtgccctggtgcagaacacggagaaagggccaaacgccgaacaactcaggcaattgctaaaggagctcccaagtgaacagcaggagcagtgggaagcctttgtgtcagggcctctggccgagactaacaagaaaaatatggtggacctggttaacacccatcatctgcattcctcaagtgatgatgaggacgaccgtctgaaggaattcaattttcctgaagaggcagtcctgcagcaagcattcatggatttccagatgcaacgtatgacctccgcctttatagaccacttcggcttcaacgacgaagaattcggcgaacaggaggagagtgtcaacgccccattcgacaagaccgcaaatattaccttcagtctgaacgcagacgacgagaacccgaacgcaaacttgctggaaatctgttacaaagatagaattcaacagtttgatgacgatgaggaggaagaggacgaggaggaggctcaaggctcgggcgagagcgacggtgaagacggcgcttggcaggggtcacagctcgccagaggtgccagattgggacaacctcccggtgtccgctctgggggaagtacagatagcgaggatgaggaggaggaggatgaggaagaggaagaggacgaggaagggatcggctgcgccgcacgaggaggagccacccccctgagctaccctagccccggaccacaaccaccaggcccttcctggactgcaaccttcgatcccgtccctaccgacgctcccactagccctagagtttcgggtgaggaggagttacacacgggtccccctgcaccacagggaccactgtcagttcctcagggccttcctacccaaagcctggcatcaccgcctgccagggatgctttgcagctccgctctcaggaccctacgcctccgagtgcccctcaggaggccaccgaaggctcaaaggtgactgagccctctgcaccctgccaagctctcgtttcgattggtgatttgcaggcaactttccacggaatacgctccgctccatcctcaagtgactcagcaacccgcgatccctcgacctcagtcccagcatcaggcgcacaccagcccccacagaccaccgaaggcgagaagtctcccgagcccctcggtcttccacaatcgcagtccgcccaagcgttgacaccccctcccattcctaatggtagcgctcctgagggtcctgcctctccgggaagtcagtag

SEQ ID NO: 29831 - DNA, 354 bp, Artificial Sequence
  Description of Artificial Sequence: Synthetic coding sequence
atgaagtttcaatacaaggaggtccacccctttgaatatcgcaagaaagagggagagaaaatccggaaaaaatatcccgatcgcgtccccttgatcgttgagaaggcccctaaagccagagttcctgatttggatcggagaaagtatctggtgccctccgatctgacagatggacagttttacttactgattagaaaacgcatccatcttagacctgaagatgctctgttcttcttcgtcaataataccataccccctacttccgcaacgatgggccagctttatgaagacagtcatgaggaggacgacttcctgtatgtcgcctattctaatgaatctgtatacggaaaatag

SEQ ID NO: 29832 - DNA, 1089 bp, Artificial Sequence
  Description of Artificial Sequence: Synthetic coding sequence
atgcgcgagatcgtacatttacaagccggacagtgtggtaaccagattggggctaagttctgggaggtcatctctgatgaacacggaattgacccaacaggcacctaccatggagattcagacctgcaactggagaggattaatgtttactataacgaggccaccggcggaaattatgtgccgcgtgctgtcttggtagatctggagccaggaaccatggatagcgttaggagtggacccttcggtcagattttccgccctgataatttcgtgtttggtcagtctggtgctggcaacaactgggccaaggggcactatacagagggcgcagagctggtggatgctgtgcttgatgtggtgagaaaggaggcggaaagctgcgattgtctccaaggctttcagctgactactcccacgtatggggacctgaaccacctggtctctgctaccatgagcggagtcactacctgtttgcgattccctggccagctgaacgcggacctcaggaagctcgccgttaacatggtgcctttcccacgtctgcatttctttatgcctggctttgctccgctgacatcacggggttcccagcagtatcgggctctgaccgtgcctgagttgacacagcagatgttcgatgccaagaatatgatggctgcgtgcgatccacggcacggcaggtatttgaccgtggcagctgtcttccgaggcaggatgtctatgaaagaagtggatgaacagatgctgtccgtgcagtcaaagaattcttcttacttcgtggagtggattccaaacaatgtcaaaaccgcggtctgtgacatcccccctcgaggactgaagatggctgcaaccttcatcggcaactctacagctatacaggagctatttaaacgtatcagcgaacaattcaccgctatgttccgtaggaaagcttttctgcactggtacacaggcgagggaatggacgaaatggagtttacagaggcagagtcaaatatgaatgaccttgtcagcgaataccagcagtaccaggatgctaccgccgaggaaggcgaattcgaagaggaagcagaggaagaagtggcttag

SEQ ID NO: 29833 - DNA, 654 bp, Artificial Sequence
  Description of Artificial Sequence: Synthetic coding sequence
atggaggagacaatgaagctggctactatggaggatactgtagagtactgtttattcctgatcccagacgaatctcgcgatagtgacaagcacaaggagatcctgcagaagtacatagaacgtataatcacccgcttcgcaccaatgctcgtgccctatatctggcagaaccaaccctttaacctcaagtataaaccaggcaaggggggagtgccagcacacatgtttggggtgaccaagtttggggacaacattgaggatgaatggttcatagtatatgtcattaagcagataacaaaggagttcccagaactggtcgcttctaccaaccgggtgttcttttgccacggcgaactgtgtatcatcccggctcccagaaagagcggtgctgaaagttggctgccgacgacacccccaaccattccccaagccctcaatataattacggctcacagcgagaaaatcctcgctagcgaatccatacgggctgcagttaatagacgtatccgtggttaccccgaaaaaatacaagcttcactgcatagggcccactgcttcctgccggctggcatagtggcggttctgaaacaacgtccccgactggtggccgctgcagtacaggccttctatctgcgggatcccattgacctttag

SEQ ID NO: 29834 - DNA, 1188 bp, Artificial Sequence
  Description of Artificial Sequence: Synthetic coding sequence
atggcatctgctgctagcgtcaccagcttagcagatgaagtcaactgcccaatctgccaaggaaccctgagagagccggtgacaatcgactgcgggcacaacttttgtcgagcatgtctaaccaggtattgcgagatcccagggccagacctcgaagaaagcccgacgtgtcctttgtgcaaggaacctttccgcccaggcagctttagacccaactggcagctcgccaacgtggtcgagaacatcgagagactgcagctggtaagtaccctagggttaggagaggaagacgtgtgccaggaacacggtgaaaagatatactttttttgtgaggacgatgagatgcagctgtgcgtcgtttgtcgagaagcgggagagcacgccactcacacaatgaggttcctcgaggatgctgccgcaccataccgcgagcagatccacaagtgtctgaagtgcctgagaaaagagcgagaagagattcaagaaattcagagccgtgagaataagcgcatgcaggtgctcctgacacaagtgtcaacaaaaaggcagcaggtaatttccgagttcgctcacctgcgcaagtttctggaagagcagcagagcatactgctggcccagctcgaaagccaggatggcgacattctcagacagcgtgatgagtttgatctgctagtggccggagagatctgccgcttttccgcactcatcgaggagcttgaagaaaagaacgaacgacctgcccgtgaattgcttacagacataaggtcgactcttattaggtgtgaaacaaggaaatgcaggaaaccagtcgccgtgtctcctgaactgggccagcgaattagagattttccccagcaggcactgcctttgcagagggagatgaagatgtttctagagaagctctgctttgagctggactatgagccggcacatatatcactcgacccacaaacctcacatcctaagctgctactgagcgaggaccatcagagggcacaattcagctataaatggcaaaatagccccgacaatccccaacgattcgatagggcgacttgcgtgctggcccataccggtattaccggagggaggcatacatgggtttggatggctcgggtgccaggtgacagtggatgttgccagttttgtagtcctcctagtgtgctcggaacggaagtcgcagcttag

SEQ ID NO: 29835 - DNA, 102 bp, Artificial Sequence
  Description of Artificial Sequence: Synthetic coding sequence
atgagcatatcttcggacgaagtgaacttcctagtgtaccggtatttacaggagtccggattcagccacagtgccttcaccttcggaatagaatctcactag

SEQ ID NO: 29836 - DNA, 1242 bp, Artificial Sequence
  Description of Artificial Sequence: Synthetic coding sequence
atgttcgcctctgatttgctccgtgccctggactgctgcccaggtgccggaagcagcggcctgctccctcagttggggccacgccaactgcttgctttcaccgtgaactgtctgggaaaccacaggtatttaggattcttcgaagatctagagcaacgacacaaggctcaagtgctcgttgaagatatttcggatatcctggaagagcacgctgaaaaacatttccacccatacatcgcctattgttccaacgaagtgtaccagcaacggaccctacaaaaactgatcagctcgaatgcggctttccgggaggccttgcgagagattgaaaggcgtccagcctgcgggggacttcctatgctgagtttcttaattctaccgatgcagcgcgtgacacgactgcccttgttgatggatacgctctgcctcaagactcagggtcatagcgagcggtacaaggctgccagtagagctctcaaagctatcagtaagcttgtccgacaatgtaacgagggtgctcacagaatggaacggatggaacagatgtatactcttcatacacaactggattttagtaaggtaaaatcattacctcttataagtgcttccagatggctgctgaagcgcggtgagctcttcctggttgaggagacgggcttgtttcgaaagattgccagtagacccacgtgttacttgttcctctttaacgatgtgttagttgtaacgaagaaaaagagcgaagagtcatacatggtgcaagattacgcccaaatgaaccatatccaggtggaaaaaatcgaacccagcgaattgccacttcccggtgggggtaatcgatctagttctgtgccccaccctttccaggtcaccttactgaggaattccgagggtcgtcaggagcaattactgttgagtagcgatagcgcttcagaccgagccaggtggatagtggccctgactcactctgagcggcagtggcagggtctttcttcgaagggagatcttccacaggtagaaatcacaaaggctttctttgccaagcaggctgatgaagtcacgctccagcaggcggatgtggtgttagtcttacagcaggaggatggatggctgtatggtgagcgcctgagggacggagagacgggttggttccctgaagattttgcaaggtttatcactagtcgggtagctgtagagggaaatgtgcgccgaatggagcggttgagggtggaaactgacgtttag

SEQ ID NO: 29837 - DNA, 1890 bp, Artificial Sequence
  Description of Artificial Sequence: Synthetic coding sequence
atggaggagtcccccctatcacgggctccatctagaggcggagtcaacttcctgaatgtggctcgcacctatatcccgaacactaaggttgaatgtcactacacgttgcctccgggaaccatgccatcagcaagcgattggatcgggatctttaaggtcgaggccgcatgcgtgagggactatcataccttcgtgtggtctagtgttccggagtctacaacggacggtagcccgatccatacctccgtgcagtttcaagcctgtaatcagctcgatgagagccagcaggagaggaacgatctcatgcaactgaagttacagctggagggccaggtcacagagctccgatcccgggtccaggagctagaaagagcattggccactgcccgacaagaacacaccgagctcatggagcagtacaaggggattagtcggtcccacggtgagatcactgaggagcgcgatatcctttctcggcagcagggggatcacgtggctagaatccttgagctcgaagatgacatccaaaccatctctgagaaagtgctcactaaagaagtggagctcgacagactgcgagacacagtgaaagccctaacacgcgaacaggaaaagctcctgggccagctcaaagaggtacaagcagataaggaacaaagcgaggccgagctgcaggttgcccagcaggaaaaccatcacctgaacctggacttgaaggaggctaaatcttggcaggaggagcagtcagctcaagctcagcgcctcaaagataaagtcgctcagatgaaggacactctaggccaagcccaacagcgagttgcagagctagagccgctcaaggagcagctgcgcggtgctcaagagcttgcggcatcaagtcaacaaaaagccacccttctgggcgaggagctagctagtgctgccgctgccagagaccgaaccattgccgaactgcacaggtcacggttggaggtcgctgaagtgaatggtcgactcgccgaattgggcttgcacctaaaagaagagaaatgccagtggagcaaggaaagggcaggactattacaatctgtggaagcggagaaagataaaatcctcaagctttcagctgaaattctacgattagagaaagctgtgcaagaagaacgcacccagaatcaggtgtttaaaaccgaactggccagagagaaggactcatcgctcgtgcagctcagcgagtctaagagggagcttaccgagcttcgatccgctctgcgagtgcttcagaaggagaaggagcagttgcaagaagagaagcaggagctgctggagtatatgagaaaactcgaagctcgtcttgagaaggtcgccgatgaaaagtggaacgaggatgcaacgacagaagatgaggaagcagctgtgggcctctcatgtcccgctgcgcttaccgattcagaggatgagtccccggaggatatgcgactgcctccctatggcttgtgcgaacgtggagacccaggaagctccccagccggtcctcgggaggccagcccactggtggtcatatctcagcctgcccctattagcccccatctgagcggaccagctgaagactcgagctctgatagtgaggccgaggacgaaaaaagcgttcttatggccgctgtacagtccggtggcgaggaggccaatttgctgttacctgaacttgggtccgccttctatgacatggcctcggggttcactgttgggaccctttctgagaccagtactggtggcccagcaacccccacctggaaggaatgtcccatctgcaaagagagatttccagctgagagcgataaggacgccctcgaggaccatatggatggccatttcttctttagcacacaagatcccttcacattcgagtag

SEQ ID NO: 29838 - DNA, 2451 bp, Artificial Sequence
  Description of Artificial Sequence: Synthetic coding sequence
atgccgctctctagccccaatgccgctgccacagcttccgacatggacaagaactccggctcaaacagctcttcagcctcttcaggctctagtaagggacagcagccaccaagaagcgccagcgctggccctgcaggagagagcaagcccaagtctgacggaaaaaatagctcaggctccaaacgttataaccggaaacgggaactcagttaccccaagaacgagtcttttaacaatcagagccggaggagctcatcccagaagagcaaaacattcaacaagatgccaccacaaagggggggaggatcctcaaaactattcagctcttcttttaatggcggtagacgcgacgaggtcgccgaggcacagagagcagagttctcacctgcgcagttcagcggaccaaagaagatcaaccttaatcatctgctgaatttcacattcgagccacgagggcagaccggtcattttgaagggagcgggcacgggtcttggggcaaacgcaacaagtggggtcacaaaccattcaacaaggaattgtttctgcaggccaactgccaattcgtggtctccgaggatcaagactacaccgcccactttgccgacccagacactcttgttaattgggacttcgtggagcaggtgcggatctgcagccacgaggtcccctcttgcccgatctgcctgtaccccccaaccgctgcaaagatcacaaggtgtggacacattttctgctgggcatgtatcctccattacctctcactgagtgagaaaacctggtctaaatgccctatttgttacagcagcgtccacaagaaagatctgaagagcgtggtggcaacagagtcacaccagtacgttgtgggagacacaattaccatgcagctgatgaagcgggaaaagggtgtcctggtagctctgccaaaaagcaaatggatgaatgtggaccaccctattcaccttggcgatgaacaacatagccaatactcaaagttactgctggcgagcaaagagcaagtgcttcaccgggtggtcctcgaggaaaaagtcgccttggagcagcagcttgccgaggaaaagcacacccctgagagttgctttattgaagcagctatccaggagctgaaaactagggaagaagcactcagcggcctcgcaggatccaggagggaggttacgggtgttgtggctgctttagaacagctggtgttaatggccccattggcaaaggaatcagtcttccagcccagaaagtctctcctacaacagggggttctcgagtatctcagtgccttcgatgaggagacaactgaggtgtgttctcttgacacgccatctaggcctctcgctctgccactggtcgaggaggaagaggcagtgtcggagcctgagcccgaaggcttacctgaagcatgtgatgacctggaactcgcagatgacaaccttaaagaagggaccatctgtaccgagagctcccagcaggagcctatcaccaaaagcgggttcacccggctgtcatcctctccttgttattacttctatcaggcagaagatggccagcacatgttcttgcatcccgtgaatgtgcgctgccttgttcgggagtatgggtctttggaacgatccccagagaagatctctgctacagtggtggagattgccggatactccatgagcgaagacgtacggcaacggcaccgctatcttagccatctccctcttacatgcgaattttcaatctgtgaactcgcacttcagccgcctgttgtcagtaaggagaccctcgagatgttttctgacgacattgagaaacggaaacgacagagacaaaagaaggctagagaggagagaagaagagagagacgcatcgagattgaagaaaacaagaagcaggggaagtaccccgaagttcatattccgcttgaaaacctccagcagtttcctgccttcaatagctatacctgctcaagcgacagtgctctcgggccaacgagcaccgaaggccacggggcactgagcatatctccattatccagaagtcccggaagccacgcagactttctcctcaccccattgtcgcctacagcatctcagggaagtccatccttctgtgtcggatcattggaggaggatagtccattcccgtctttcgctcaaatgctccgcgtggggaaagcaaaggcggacgtttggcccaaaaccgccccaaagaaagacgaaaatagcctggtcccacccgctcccgtggacagcgacggagaaagcgacaacagcgacagagtgccagttccatcctttcaaaattccttctcacaagcgattgaagccgcatttatgaaactggatacacccgctacttccgaccccctgtcggaagagaagggcggtaagaaaaggaagaaacaaaaacagaaattattattctccaccagtgttgtgcataccaaatag

SEQ ID NO: 29839 - DNA, 429 bp, Artificial Sequence
  Description of Artificial Sequence: Synthetic coding sequence
atggcatcccctggcaaggacaactaccgcatgaaatcgtataagaataaggccctcaacccccaagagatgcgcagacgcagggaggaagaaggcatccagctccgaaagcagaaacgagaggagcaactgttcaaaagacgtaatgtgtacctgccccgaaatgatgaaagcatgctcgagagccccatccaagaccccgatattagttcgacagtgcccattccagaggaagaagttgtcactactgacatggtgcagatgattttcagcaataacgcggaccagcagttgacagctactcaaaaatttcgcaagttattatccaaggagccaaatcctcccatcgaccaagtcattcagaaaccaggtgtggtgcaaagatttgtgaagtttttagaacgaaatgaaaattgcacattacaatag

SEQ ID NO: 29840 - DNA, 297 bp, Artificial Sequence
  Description of Artificial Sequence: Synthetic coding sequence
atgtccgaacagggtgatctgaaccaggcaattgccgaagagggaggaaccgaacaagaaactgctactcctgaaaatggaatcgtgaagagtgagagcttagacgaggaagaaaagctagaactgcagcgtaggctcgaggcccagaatcaggagcggaggaagtcaaagtcaggggcaggcaagggcaagcttacccgctcactggcagtttgcgaggaatcatctgcgaggccaggcggagagagcctccaggaccaggaaagcatacacctgcaactgagtagcttctcatag

SEQ ID NO: 29841 - DNA, 1917 bp, Artificial Sequence
  Description of Artificial Sequence: Synthetic coding sequence
atggaaaacctgcagaccaacttttccctagtccagggctcaaccaagaagctcaacggcatgggcgatgacggcagtccccctgccaagaaaatgattaccgacattcatgcaaacggaaaaacaatcaacaaggtgcccactgtgaaaaaagagcatttggatgactatggtgaggctcctgtagaaaccgacggcgagcacgtaaagaggacctgcacctccgtgcccgaaaccctgcacctgaacccgtcgttgaagcacactctcgctcagtttcacctgtcttcccagtcatccctggggggaccagcagctttctctgctcgtcactcgcaggagagcatgtcgcctaccgttttccttccattacccagtcctcaggtcttaccagggcctctactcatcccatcggattcctccaccgagctcacccagacagtcctggagggggaaagcatctcttgcttccaggttggaggagaaaagcgcctgtgcctcccccaggttctgaactccgtgttgagagagtttacactccagcagatcaacaccgtgtgtgacgagctgtatatctactgttctcggtgcacatctgaccagctgcatatcttaaaggttctcgggatccttccatttaacgcgccttcctgtggcctgataacactcacggatgctcagagactttgcaacgccctgctgcggcctagaacattcccccagaacggcagcgtgctccccgctaaaagcagcctggctcaactaaaagaaactggcagcgcctttgaggttgagcatgagtgcctcggcaagtgccaggggctgtttgccccacagttctacgtccagccggacgcaccctgcattcagtgcttagagtgctgcggaatgttcgcacctcagacttttgtgatgcacagccaccgcagccccgacaagcggacctgtcactggggcttcgaatcagctaagtggcactgctatctgcacgtgaaccagaaatacctcggaacaccagaggaaaaaaagcttaagattattctggaggaaatgaaggagaagttttcaatgcgatctggcaaacggaatcagtccaaaacagatgcaccctcagggatggagctccagtcctggtaccccgtgatcaaacaagagggcgatcacgtgagccaaacacactcttttctacacccctcctactatttgtacatgtgtgataaagtggtggctcccaatgtaagcctgacgagtgccgtctcccagagcaaagagctcaccaagacagaggccaatgcttccatcagtaataactccaccagcaagaggaagagtgagtctgcaacctgtaacctggttcgcgatattaataaggtgggcatcggtctggtggccgctgctagcagcccgttgcttgtcaaggacgttatttgcgaagacgacaaggggaagataatggaggaggtcatgcgtacttaccttaaacagcaggaaaaactcaacttgattttgcaaaagaagcagcagctccaaatggaggtgaagatgctctcgtccagtaaatcaatgaaagagctgaccgaggaacagcagaatctgcagaaggagcttgagtccctgcagaacgagcacgcacagcgcatggaagaattttacgtggaacaaaaggaccttgaaaagaagctggaacaaatcatgaaacagaagtgtacctgcgatagcaatctggagaaggacaaggaagccgagtatgccggacaactggcggagttgcgtcaacgcttggaccacgctgaagcagacagacaggagttgcaagacgagctgcggcaggaacgagaggccaggcagaaactggagatgatgattaaggaactgaaactgcagatcttgaaaagctccaagactgcaaaagaatag

SEQ ID NO: 29842 - DNA, 1530 bp, Artificial Sequence
  Description of Artificial Sequence: Synthetic coding sequence
atgaagagagggaggctcccttcaagctcagaggacagcgacgacaacggatcactgagtaccacatggtcccagaacagtaggtctcagcataggagatcctcctgttcccgccatgaggatagaaaaccatccgaagtctttagaaccgacctgattacggccatgaaactgcatgatagctaccagctgaaccccgacgagtattacgtgctggccgatccatggcgccaggaatgggagaagggcgttcaggtgcctgtatcgcccggaaccatcccgcagcctgtggctcgggtggttagtgaagaaaagtctcttatgtttatccgtccaaaaaagtacattgtgtcgagcggctctgagcccccagaattggggtacgtggacattcgaaccctcgccgacagcgtctgtcgatatgacttaaatgatatggacgctgcctggctggaactgactaatgaagaattcaaagaaatgggcatgcccgagctggacgaatacactatggaacgcgtacttgaggagttcgaacagagatgctacgataatatgaatcatgctatcgagactgaggaggggttggggattgagtatgacgaagacgtggtgtgcgatgtgtgccagagccctgacggcgaggacggcaacgagatggttttttgtgacaaatgtaatatttgtgtccatcaggcgtgttatggcatacttaaggtccctgaaggatcctggctctgtcgaacttgcgcgctcggagtgcaacccaagtgcttactgtgtccaaaaaaaggaggagcaatgaagcccacacggtcgggcactaagtgggttcatgttagctgcgctctgtggattcctgaagtctcgattgggagccctgaaaagatggaacctataacaaaagtgtcgcatatcccctcgagcaggtgggccctcgtttgttccctgtgtaacgagaaattcggggcatctatccagtgtagcgtgaaaaactgtcggacagcttttcacgtgacatgcgccttcgatcgaggtctcgagatgaaaacaattctcgcagaaaacgatgaggttaagttcaagtcctactgcccaaaacattcatcccatcgtaagcctgaagagtccttagggaagggtgcggcacaggaaaacggtgctccagaatgttcgcctagaaatccgctggagccttttgctagtctggagcagaaccgggaggaggcccatagggtgtccgtccgaaagcaaaagctgcagcagttagaagatgaattctatacttttgtcaacttgctcgatgtggctagggccctgagattgcctgaagaggtggtcgattttctgtatcagtattggaagcttaaaaggaaggtgaatttcaacaaacctctaataactcctaagaaggatgaggaggacaacttggccaagcgggagcaggacgtgctattcagaaggcttcagctgtttacacatctgcgccaggatctggagagagtaatgatcgacaccgacaccctgtag

SEQ ID NO: 29843 - DNA, 354 bp, Artificial Sequence
  Description of Artificial Sequence: Synthetic coding sequence
atggccttttccggcagagccaggccctgtattattccagagaacgaggagattcccagggccgcactgaataccgttcacgaagccaacgggacagaagacgagagagccgtgtcaaagctgcagaggcggcacagcgatgttaaagtctataaggaattttgtgacttctatgctaagttcaacatggcaaacgcactcgcaagcgccacctgtgagcgctgtaaagggggatttgcccctgcagagaccatcgtcaactccaacggggaattatatcacgagcagtgctttgtctgtgcccaatgtttccaacagtttcctgagggcctgttttacgaggagagaacctag

SEQ ID NO: 29844 - DNA, 1110 bp, Artificial Sequence
  Description of Artificial Sequence: Synthetic coding sequence
atgaaggatacacaggacattcaggaagcgagcaaggcaatgcagaataaagtccatgaacaggaggataagaatgagaaacagaaacaaagggaagacaagttaggagtctattctctggtgcactttagtcctaaaatgcttgggtcagtggctaccacgctccccctctctagctccaattcatctggcatgcctttaggatattacttatcgagtccacaaatttctcgggtgacaattagcacaactggccagctgacaagcaaagcaaccgtgggttcttgttcccgggttgaaaactcacttgacgcctccccgttttccgtgcccaagaaacaggatgaatcacccatgattggggacggcgaagattacttccttagtctcttcggggatagtaaaaagctcactgcacactctaattacacacaaaaaacacttaagtacttcagcatgattctcgaggaggttggccagtttactagttcctcgctcggcgacgtggagatcgccgaggtgaacgtgaaaggcctgttcgttaaactgatcaattctagtttagataaagagatggccattggtgatcacatccttcagcagaacgtgaacggccagactattagcctgtataggtttttacccaatatcgtgatgcaagcaaactctaccgttaccgccattgcttggtacacaccaatccactggaaacaggcatgggaaaagctggacgctgacgtggaatttaaccgctgttccgtggtgtcccccaccttcagaaaacgggtgttccagtggaccgcttctactgctaccatcacaaaggagaagcaagaccagcccaaaaaagatatttctaactaccaggtggagcaggcccaggtgctgctcaagagagaaaaggaaattcctcccacggtctttcccaaccgctctccgtggtgccagaatccttacgtatccgcccacccgtactgccccctaatcgaaccccataatacgagcaccgccggaggccgattagataggcaaccgagaaccaggagcacgcggcctaatcgcgcaagtggcagcaaaaaaaaaaaaacctcagagtcccagaaacagtag

SEQ ID NO: 29845 - DNA, 681 bp, Artificial Sequence
  Description of Artificial Sequence: Synthetic coding sequence
atggaccagtcacgcgtgctgctgtgggtcaaagccgaacctttcatcgtgggggctttgcaagtgccacccccttccaagttcagcctgcactatcttcggaaaatatcgacctatgtgcagataagggctaccgaaggtgcctatcctaggctctattggagcacatggcggcacattgcatgcgggaagctccaactcgccaaggacctggcctggttatactttgagatcttcgattccctgtccatgaaaacccccgaagagcgactggagtggtcagaagtcctttcaaactgtatgagtgaggaagaggtcgagaaacagcgaaatcagctgagtgtggatacattacagttcctgctgtttctctacatccagcagctcaataaggtgtctctgagaacaagcctgattggagaggagtggccctcacctcggaacaagtctcagtctcccgatctgaccgaaaagagcaattgccataataaaaattggaacgattattcccaccaggcattcgtttatgaccatctcagtgatcttcttgagctcctcttggaccctaaacaattaacggcctcattccactctacacactccagcttggtgtcacgtgaagccgtggtggctttaagttttctgattgaggggaccatttcacgcgcaagaaagatttag

SEQ ID NO: 29846 - DNA, 747 bp, Artificial Sequence
  Description of Artificial Sequence: Synthetic coding sequence
atgaatgacaggttgggagaggatgagagcctcctcatgaagttatattcttttttactcaatgacagtcccctgaatcctctgctggccagctttttcagtaaggtgcttagcatcctgatatctaggaagcccgagcagattgtggacttcctcaagaagaagcatgacttcgtagacctgatcatcaaacatatcggtacttccgccatcatggatctcctgttgaggctgttaacttgcatcgaaccgcctcaaccgcgacaggacgtactgaattggttaaacgaagagaagattatccagaggcttgttgaaatcgtgcacccctctcaggaagaggataggcatagtaacgccagccaaagtctgtgtgaaattgtccggctgagtcgggatcaaatgctgcagatccagaattccactgaacccgatctgctcttagcaagcggcctgcctgacctgaatggggtcgggcctcgaggcttgctggtggataacatgctttggtctcgcctggtggtttcgtttgcctctcatggacaggggcttgcgcctctggtggcccacgtcgcatccgtagtgtggacctggtggcttctacaccctactgtggccagcgtagtgtggacatggtggctgcttcaccccacccaaggaaactctgtgctgctgcatcctacagattgttgggagcgagcttccggtacctttctgtgggggattatacttttctgcctatcttag

SEQ ID NO: 29847 - DNA, 1869 bp, Artificial Sequence
  Description of Artificial Sequence: Synthetic coding sequence
atggccatggcaccctctcccagtctggtgcaagtatacacaagtcctgctgccgtcgcggtctgggagtggcaagacggcctgggcacttggcatccatattctgccaccgtctgtagctttatcgagcagcagtttgtccagcaaaaaggccagaggttcggtcttggatcactcgctcatagcattcctctgggtcaggccgatccttcattggccccatacattatcgacttgccctcctggacccagttccggcaggacacaggcaccatgcgagccgtgagaaggcatctattcccccagcacagcgccccagggagaggcgtagtgtgggagtggctgagcgatgacggcagttggaccgcttacgaagcaagcgtttgtgattatctggagcagcaggtggccaggggtaaccagctcgttgacctggctccccttggctacaattataccgtgaattataccacgcacacccagaccaataaaacttcatctttttgtagaagtgttcgacgacaagccggtccaccttaccctgtcacgacaattatcgctccaccgggacacactggtgtggcctgtagctgtcaccaatgtctgtcgggctctaggactggcccagtatctgggaggtatcgccactccatgacaaatttacctgcctacccagtgcctcagcacccgccacaccggacagccagtgttttcgggacccaccaggcatttgccccatataacaagccctccttatctggcgcacgatccgccccaaggctgaatactacaaatgcatggggggctgcgccaccgtctctcggcagccagcctctgtacagaagctcactctcgcacctgggtcctcagcatctgcctcccggaagctctactagtggagccgtatccgcctctctccccagcggaccctcaagctcccccggttcagtgccggctaccgtccctatgcagatgcctaagcctagcagagtgcagcaggctttggctggaatgacgtctgtcctgatgtctgccattgggctgccagtgtgcctcagccgcgcaccccagcccacgtcacctcctgcgtcccgcttagcctccaagtctcatggcagtgtcaaaagactcaggaagatgagtgttaagggggctacccccaagccagagccagagcccgaacaggtcataaagaactacacagaggaactcaaagtcccacccgatgaggattgcatcatttgcatggaaaaactctcaactgcaagtggctactccgatgtgactgacagcaaggctatcggcagcctggccgtaggtcatcttacaaaatgctcccacgcattccatttgttatgtcttttagccatgtactgtaatggaaacaaagacggcagtctccagtgcccttcctgcaaaaccatctatggcgaaaaaactggtacacaaccgcaggggaaaatggaagtattgagatttcagatgagtctgccaggccacgaagattgcggcaccattctaattgtctattccattccacacggcattcagggaccagagcaccccaaccctggcaagccttttacagccagaggcttccctcggcagtgctacctacccgacaatgcacaaggaagaaaggtgctggaactgctaaaggtcgcgtggaagcgccgtctgatcttcactgttggaactagtagcactaccggggagactgacacggtcgtttggaatgaaattcatcacaagaccgagatggaccgcaatattacgggacatggctacccagaccccaattacctgcagaatgttcttgccgagctcgcagcccaaggggtgacggaggactgcctggaacagcagtag

SEQ ID NO: 29848 - DNA, 4008 bp, Artificial Sequence
  Description of Artificial Sequence: Synthetic coding sequence
atggaagagattccagtgaaggtggctgtgagaatcagaccattactttgtaaagaagcactccacaatcaccaggtgtgtgttagagtgattcccaatagtcaacaagtaatcattggcagagatagagtgttcacctttgatttcgtgttcgggaagaactccacccaagacgaggtgtacaatacttgcattaagcctctggtgctctccctcatcgagggatataacgcgaccgtattcgcttatggacagacagggagtggtaaaacgtacactataggaggtggccatatcgctagcgtagtagagggacagaagggtattatcccacgcgcaattcaagaaatcttccagtccatcagcgaacatccatctatagacttcaatgtcaaagtaagctacatcgaagtttacaaagaggatctacgcgatctgcttgaacttgaaacatcaatgaaggacctgcacatcagagaagatgagaaaggcaataccgttatcgtgggcgctaaggagtgccacgtagagagtgccggagaggttatgagcctgctggagatgggcaatgcagctcggcacaccgggaccacgcaaatgaacgagcacagctcaagaagccacgcaatttttacaatcagcatatgccaggtgcataagaacatggaagctgctgaagatggcagttggtacagcccacgccacatcgtgtcgaaattccattttgtcgacctggccggaagcgagagagtgaccaaaaccggtaacaccggcgagcgttttaaggaaagcatccaaatcaacagtggtttgcttgcattgggcaatgtgatcagtgcactcggtgatccgaggcgaaagagctctcacataccatatcgggacgccaagattacccggctgcttaaagattccctgggcggatctgccaaaaccgttatgatcacctgtgtaagcccctccagttccaacttcgacgaatccctcaatagcttgaagtatgcaaaccgggcaagaaatattaggaacaagcctaccgtaaatttcagcccagaaagtgataggatagatgagatggaattcgagattaagctccttagggaggcattacagagtcagcaggcgggagtctctcaaacaacacagatcaacagggagggatcccccgataccaatcggattcactccctcgaggaacaagtggcccagctacagggagagtgcctcggataccagtgttgcgtggaggaggcatttacatttcttgttgaccttaaggacacggtgagactcaacgaaaagcaacagcacaagttacaagagtggttcaacatgattcaagaggtgcggaaggccgtcttgacgtcctttcggggaattgggggaacagcctccttggaagaggggcctcaacatgtcaccgtgttacagctgaaaagagagcttaagaagtgtcagtgtgtgctcgccgctgatgaagtggtgtttaaccagaaagaacttgaagtaaaggaattgaagaatcaggtccaaatgatggtccaggaaaacaaggggcatgcagtgtctctgaaggaggcacagaaggtaaaccggttacaaaatgaaaagataatcgagcagcaactgctggtggaccagctgagcgaggagctcactaagttgaatctgagtgtgacaagctccgccaaagagaattgtggggacggcccagacgctaggatcccagagcggagaccctacacagttccttttgacactcacctagggcactatatttatataccatcacggcaggattctcggaaagttcacaccagcccacccatgtattccctggatcgtatcttcgcagggtttcggacaagatcgcagatgctcctgggacatattgaggagcaagacaaagtgttacactgccaatttagtgacaatagcgacgacgaagaatctgagggccaagaaaagagcgggaccagatgtcgttctcgaagctggatacagaagcctgatagcgtgtgtagcttggtcgagctcagtgatacccaggacgagacacagaagagcgacctggaaaacgaagatcttaagatcgactgcttgcaggagagccaagaactcaacctccaaaaactgaagaattcagagcgcatcctgacagaagcgaagcagaagatgcgcgagctcaccattaatatcaagatgaaggaagatttgattaaggagctgatcaagacaggaaacgatgctaagagtgtctcaaaacagtatagcctgaaggtaactaaattagaacacgatgctgaacaggctaaagttgaattaattgagacgcaaaaacagctgcaggaactagagaacaaagacctctctgacgtagccatgaaagttaagctacagaaagagttccggaaaaagatggacgccgctaagctaagggtgcaggaaatacaacttaaaactggacaggaggaaggattaaaaccaaaggccgaggatttggatgcatgcaacctgaagaggcggaagggatcatttggaagcatagatcacctgcagaagcttgatgaacagaagaaatggcttgacgaagaagttgagaaggtcttgaatcagcgtcaggaactggaagaactggaggccgatctcaaaaagcgcgaagcaatcgtctcaaaaaaagaagcattgctgcaggagaagtcacatctggaaaataagaaactgcggagcagccaggcactaaatactgactctctgaaaatcagcacccgtctgaatctgcttgaacaggagttaagcgagaagaatgtacagcttcagactagtaccgcagaggaaaaaaccaagatcagtgagcaggtggaagtgttgcagaaggagaaggatcagctgcagaagagacgacacaacgtagacgaaaagcttaaaaacggacgcgtactgtctccagaggaggaacacgtcctcttccagctggaagaaggcatcgaggcacttgaggccgcaattgaatacaggaatgaatcaatccaaaaccgccagaagagtcttcgggcaagctttcataaccttagcagaggggaggccaatgtcctagagaagctggcatgcctgagcccggtggagatccgtactatcttatttagatatttcaacaaagtcgtaaatctccgtgaggctgaaagaaagcagcagctttacaacgaggagatgaagatgaaggtgctggagcgcgacaacatggtacgggagctcgagtccgcgttagatcaccttaaacttcaatgcgacaggcgtttgacgctccagcagaaggaacatgagcagaaaatgcaactgctgttacaccattttaaagagcaggacggtgagggtatcatggagaccttcaaaacctacgaagacaagattcagcagcttgaaaaggatttatacttttacaaaaagacgtctagggaccacaaaaagaaactgaaggaacttgtgggcgaggcaatcaggcgccagctggctccgagtgagtaccaagaggccggtgacggagtgctcaagcccgaagggggtggcatgcttagcgaggagctcaagtgggcatccagacctgagtccatgaagttgagcggaagagagagagagatggattcgagcgccagcagtttgagaactcagccaaatcctcagaaactgtgggaagatatacccgagcttccacctatccatagcagcctcgctcccccttccggccatatgctaggaaacgagaataagaccgaaaccgacgataatcaattcaccaagtcacactcaagattatccagccaaatccaggtggtggggaacgtggggcgtctacatggagtgactccggtcaaactctgcagaaaggagcttcggcagatttcagctctagaactaagtctccggcgatctagcctgggtgttggtattgggagtatggccgcagactctattgaagttagtcgtaaaccccgagatttaaagacctag

SEQ ID NO: 29849 - DNA, 2745 bp, Artificial Sequence
  Description of Artificial Sequence: Synthetic coding sequence
atggaggagagaatcaccactctcgaaaagaggtatttagccgctcagcgagaggctaccagcatccatgatctgaacgacaaactcgagaatgagctcgcaaacaaagaaagtctccacaggcagtgcgaagaaaaggcccgacatctgcaggagctgctcgaggtcgcggagcagaaattacagcagacaatgaggaaagcagaaacattacctgaagtagaagccgagctcgcgcagagaatcgccgcacttaccaaggcagaagagaggcacgggaacattgaagaacatcttcgccagttggagggccagctcgaggagaagaaccaggaattggcccgagttcgccagagagaaaaaatgaatgaggaccataataaacgcctctccgatactgtggaccgcttgcttagcgagtccaacgagagactacagctacatttaaaagagcgcatggccgctctcgaagaaaaaaacaccctgatacaggagttagagagttcacagcggcaaatcgaggagcaacaccaccacaaaggcaggctatcagaggagatcgagaagctacgacaagaagtggatcagctaaagggaagagggggacccttcgttgacggagtccatagccgatcacacatgggttccgccgctgatgttcggttttctctcgggactacaacacatgccccaccaggcgtgcatcgcagatacagtgcccttcgagaagagagcgctaaggattgggagacgtcccccctaccgggaatgcttgcccctgctgctggtcctgcctttgactccgaccccgaaattagtgatgtggacgaggatgaacctggtggcctagtggggtctgctgatgtggtttcaccgtccgggcactcagacgcacaaactctggccatgatgctgcaggagcaactggatgccattaatgaagagattagaatgatccaagaagagaaagagtccacagagctccgggcagaagaaattgaaacccgagtaacttccgggtctatggaggctcttaatctgaagcagctcagaaagcgaggatcaattcctactagcctcacagccctcagtttggctagtgcatcacctcctcttagcggccgaagcacgcccaaactgacgtccagaagtgccgcacaggatttggaccgcatgggggttatgaccctcccctctgacctgcgaaagcaccgcaggaagttactctcaccagtgtcacgcgaggagaacagggaggacaaggccactattaaatgcgaaacatcaccaccctcctctccgagaacattgcgtttagaaaaactgggacatcccgctctgtctcaagaagaggggaaaagcgccctggaggaccaaggaagcaatccaagctccagcaactcttctcaggactctctgcacaagggagccaagagaaagggaattaagtcaagcataggtcgtttattcgggaagaaagagaaggggaggctaattcagctgtcacgggatggagccaccggccacgtgttactgacagattcagaattttccatgcaggaacccatggtgcccgcaaagcttggtacacaggcagagaaggaccggaggttgaaaaagaagcaccaattgctcgaggatgcccgaagaaagggtatgcccttcgctcagtgggatggccctaccgtggttagctggttggagctatgggtgggcatgcctgcatggtacgtagccgcatgtcgcgctaacgtgaaatcgggtgctatcatgtctgcactaagtgatactgagatacagagagagatagggataagtaacgcactccatcggcttaaactgcgcctggctattcaagaaatggtctctctgacatccccctcagcccctcctacgagtagaacaagtagtgggaacgtgtgggtaacccatgaggagatggagaccctcgagacaagcactaagaccgatagtgaggagggttcatgggctcagaccctggcctacggcgacatgaaccacgagtggatcggcaacgagtggctgccttcattgggtttgccccaataccgatcgtacttcatggaatgcctggtggacgcaaggatgctggatcatctgaccaaaaaggaccttcgggttcaccttaagatggtcgactcctttcaccgcacttccctacagtacggaatcatgtgcctcaaaagactgaactacgacaggaaagaactagagaagcggagggaagagtctcaacacgagataaaggacgtgctggtgtggacaaatgaccaagtggtccactgggttcagtccattggccttcgcgactacgctgggaacctgcatgaatccggggtccatggggctctccttgcattggacgaaaatttcgaccataatacgctggctctaatactccagatccctacacagaacactcaggccagacaggtgatggagcgggagttcaataacctgctggcccttggaaccgacagaaaacttgatgacggggatgacaaggttttcaggcgagcgccttcgtggcgcaagcgttttcgcccacgcgaacatcacgggagaggcggtatgctgtccgcctctgcagaaacactgcccgctgggtttcgagtcagcaccttgggaaccttgcaaccaccaccggctcctcctaagaaaatcatgcctgaagctcattcccattacctctatggacatatgctgtcagccttccgtgattag

SEQ ID NO: 29850 - DNA, 1494 bp, Artificial Sequence
  Description of Artificial Sequence: Synthetic coding sequence
gatgtgggaggagaccgcccttgggattctgggaacacccaactccctccgagaaaccctgtcaaggcaaacgccatgttcggagcgggagatgaggatgataccgattttcttagccctagtggcggagcccgtctcgcttcgctgtttggtttggatcaggccgcagccggacatgggaacgaattttttcagtacacggcccctaaacagcccaagaaggggcaggggaccgccgctacgggtaaccaagccacgccaaaaaccgcccctgcaaccatgtctactccgactatactggtggctacagcagtgcacgcctaccgttatacaaacggtcaatacgtgaaacaaggaaagtttggcgcagcggttcttggtaatcacaccgcacgcgaatataggatcctgctgtacatatcacagcaacagccggtgacagtggctagaatccatgtgaatttcgagctgatggtacgacccaataactacagcactttttacgatgaccaacgccaaaactggagtatcatgttcgaatccgaaaaggccgctgtagagttcaacaaacaagtgtgtattgcaaaatgcaatagcacttcatctctggatgcagttctgtctcaggaccttatagtcgccgacgggcctgccgtggaagtgggagattctctggaagtggcttatactggttggctctttcagaatcacgtgttgggccaggtgttcgatagtaccgccaacaaggacaaactgcttcgcttgaagcttgggtctggcaaagtaattaaggggtgggaagacggaatgctgggcatgaaaaagggtggtaaacggctccttattgtgccccctgcctgcgctgtaggctctgaaggcgtcattggctggacccaagccacagactcaattctcgtgttcgaagtggaggtgaggagagttaagttcgcgagggactcggggagtgatgggcattctgtctcatcaagagacagcgcagctcctagccctattccgggagccgataacctgagtgccgacccggtggtttcgccacccacgagcattcccttcaaaagcggggaacccgcactgcgtacaaagagtaattccctgtccgagcagctcgctattaacacctcaccagacgctgtgaaggctaaactgatctctcgcatggctaagatggggcaaccaatgttgccaattctgccccctcaactggacagtaatgatagtgagattgaagacgtgaataccctgcagggcggagggcagcccgttgttaccccttctgtgcagccttctctccaccctgcccaccctgccctgcctcagatgacctcacaggcaccacagccatccgttacaggcctgcaggcccctagtgccgcactcatgcaggtctcctctctcgactcgcactccgccgtgtccgggaatgcccagagctttcaagtcaccttctacaataggatcaattatatcttgtag

SEQ ID NO: 29851 - DNA, 462 bp, Artificial Sequence
  Description of Artificial Sequence: Synthetic coding sequence
atgaatctcgcagagatatgcgataatgccaaaaagggtcgtgagtacgcactcctcggaaattacgattcgtccatggtctactatcagggggtcatgcaacagatccagcggcactgtcagtctgtgcgagatccagctattaaaggaaagtggcagcaggtccgtcaagaactgctggaagaatatgagcaagttaagagcatcgtgagcacgcttgagtccttcaaaatcgacaagcctcctgatttccccgtgtcctgccaagacgaacccttccgagaccccgctgtctggcctccacctgtgccggcagaacacagggcccctcctcagatccgtagacccaatcgggaggtgagacccctgaggaaggagatggccggagttggggctagaggcccagttggacgagctcatcccatcagtaaatcagagaagccgtcaaccagcagagattag

SEQ ID NO: 29852 - DNA, 627 bp, Artificial Sequence
  Description of Artificial Sequence: Synthetic coding sequence
atgtttcaggtgcctgactccgaggggggacgcgcaggctccagagcaatgaagcctccgggaggggagtctagtaatctctttggatcacctgaggaagctacaccatcgagccgtcccaaccgcatggccagcaacattttcggacctacagaagagcctcagaacatccctaaacggaccaacccccctgggggaaagggatccggaatcttcgacgagtctacacccgttcagacgcgacaacatttaaacccccctggagggaaaacctccgacattttcggaagcccagtgacagccacatcacgccttgcccatccaaacaaaccaacccgcaatagtagagacagggtagccatgttttcttttcctttcgctcagatgagtggcgtgggaagggggctggttctctgtgaaccgggttgctctgcgtcgcctggccgtcacgactcctgtcttgaaacgagagcttttcagatggcgggaagatgcctctgcggagacgaaatgggtcatccttggccctccctgatgtgctcgccagggctacggggaacgggccgtggtgttagagtcgggcgatggggcagagcctggtcacttgatcagcagcccgctagctag

SEQ ID NO: 29853 - DNA, 591 bp, Artificial Sequence
  Description of Artificial Sequence: Synthetic coding sequence
atgccattctctaaagagaagtatattctggatagcagtcccgaaaagcttcacaaagaactcgaggaggaactcaaacttagcagcacagacctgcggtcccatgcctggtaccacggcaggatccctcgtgaggtatctgagacattggtgcaacggaacggtgactttcttattagggactcactgacctcactgggcgactacgttctcacatgcagatggcgcaaccaggctctccatttcaaaattaacaaggtggttgttaaggcgggtgagtcatacacccacatccagtacctgttcgaacaggaatcatttgatcacgtgccggcactcgtacgttaccacgttggatctcgtaaggccgtatccgaacagagtggagctatcatttattgccccgttaacaggacgtttcccctcagatatttggaggccagctatggcctcggccagggcagtagcaagcccgcatcacccgtgtcaccctcagggcctaaaggctcacatatgaagaggagaagtgtgacgatgacggacggcctaacagccgataaggtaacaagatccgatggctgtcccacttag

SEQ ID NO: 29854 - DNA, 1986 bp, Artificial Sequence
  Description of Artificial Sequence: Synthetic coding sequence
atgcaggccaatggtgctggagggggaggaggaggcggaggaggcggaggaggtggtggagggggtgggggaggtcaaggacaaactccagagttggcttgcctatctgcgcagaatggagaatctagcccaagcagctcttctagtgctggcgatcttgcacatgctaatggcttgctgccctcggccccaagtgccgcaagcaacaatagcaatagtttaaatgttaacaatggcgtccctggcggtgcagctgcagccagctccgccacggtggctgcagctagcgcaaccaccgctgccagcagctccttagccacacctgaactcggatcttccctcaagaagaagaaacggttaagtcagtccgatgaggacgtgatacgcctgattggacagcatcttaatggcctgggtctgaatcagaccgtggacttgctgatgcaggagagtgggtgtcgactcgagcatccctccgccactaagtttcggaatcacgtgatggaaggggactgggacaaagccgagaatgatctaaatgaactgaaacccctggtgcactcgccccacgccattgtggtcaggggcgcacttgaaatctcccagacactgctgggtattattgtgcggatgaagtttctgcttctgcagcagaagtacctcgagtatctggaggacggaaaagtcctcgaagccctgcaggtcctcaggtgtgaactaacacctctcaagtacaatacagaaagaattcacgtcctgtccgggtatctgatgtgcagccacgcagaggatctccgggctaaggctgagtgggagggtaagggaacagcctcccgctccaagctgctggataagctccagacatatctcccaccgtcggtgatgcttcccccaagacgcctgcaaacactgctgaggcaggccgttgaacttcagcgcgatagatgcctctaccacaacaccaagctcgacaacaatcttgattccgtgtccctgctaattgaccatgtatgttcacgacgtcagtttccatgctatactcagcagattctgactgagcattgtaacgaggtctggttctgtaagttttccaatgatggcactaaattagcgaccggttctaaagacacaacagtcatcatatggcaggtcgaccccgacactcacttactcaaactgctgaagacactcgaaggacacgcctatggggtgagctatattgcctggtccccagacgataattatctggtggcctgcggacccgatgactgttccgagctctggctgtggaacgtgcaaactggcgaactgcggacgaagatgtcacaatcacacgaagactccctcaccagtgtggcatggaaccccgacggcaagagattcgtgaccggcggacagagggggcagttctaccagtgcgaccttgatggtaacctgctggacagctgggagggggtgagagtgcagtgcctgtggtgccttagcgatggaaaaacagtgctggctagcgatacacaccagaggattagagggtacaattttgaggacctaaccgaccgaaatatcgtacaagaagatcaccctatcatgagttttaccatttccaagaatggtagattggccctcctgaatgtagcgacacagggggtgcacctttgggacttgcaagacagagtacttgttagaaagtaccagggcgttacacaggggttttataccatccactcttgttttgggggtcacaacgaggacttcattgcatctggctctgaggatcataaagtgtacatttggcacaagcgcagcgaactgcccatcgccgaattgactggacacaccagaacagtgaattgcgtgtcctggaatccacaaatcccgagtatgatggcatcggcctccgatgacggcactgttcgcatttgggggcctgcaccctttattgaccaccagaacatcgaagaagagtgctcctcaatggacagctag

SEQ ID NO: 29855 - DNA, 1113 bp, Artificial Sequence
  Description of Artificial Sequence: Synthetic coding sequence
atggagaagaagaaaatggtgacgcaaggcaatcaagaacctaccaccacccccgacgctatggtgcagccattcaccaccatccctttcccccctccccctcaaaatgggataccaaccgaatatggcgtgcctcacacccaggattacgccggacaaaccggagagcacaacctgactttgtatgggtccacacaagcccacggggaacagagctcaaattcccccagcacacagaatggatcccttactacagaaggtggagcacagaccgatgggcagcagtcacaaacgcaatccagtgaaaattctgaaagcaagagtactcccaaacggcttcacgtatctaacattccatttcggttcagggatcccgacctgcgccagatgttcgggcaattcgggaagatcctagatgttgaaattattttcaacgaacgagggtccaaagggtttggctttgtgacattcgagaacagtgccgatgccgatcgtgcacgcgagaagctgcacggtactgtcgtggaggggcgtaagatagaagtcaataacgccactgccagagtgatgactaacaagaagatggtcacgccatatgcgaatggatggaaactgagtccagtagtgggcgcagtgtatggacccgaattatatgcggcatctagtttccaggccgacgtttccttaggtaatgacgcagctgtgccgctatctggacggggtggtattaatacttacataccactgatcagccttcccttggtgccgggtttcccatacccaaccgcagctaccacagcagccgcattccgcggagctcacctccggggaagagggaggacagtgtatggagcagtgcgcgctgttcctcccaccgcaataccggcatacccgggagtggatatgcaacccactgacatgcattccttgctgctgcagcctcagccgcctcttttacagccgctgcagcccctgaccgtgactgtgatggccggatgtacccagcccacacctaccatgcccttacccctgccgctcgccatggaattggccctgtggcgagtctacactgaggttgccaccgccgatctcccacccacagaagtgacctag

SEQ ID NO: 29856 - DNA, 348 bp, Artificial Sequence
  Description of Artificial Sequence: Synthetic coding sequence
atgccacaccttcccctagcttcgttccgacccccattttggggtctgcgccattctcggggattgccacgctttcatagcgtgtcaacacagtccgaaccccacggaagccccatctcccgacgcaatagggaggcgaagcaaaagagactgcgggaaaagcaggcaacgctcgaagcagaaatagccggagaatccaaaagtcccgcagaaagcatcaaggcctggcgaccgaaggaacttgtgttgtatgagatcccaaccaaaccaggagagaagaaggacgtatcgggccctctgccaccggcttactcgcccaggtacgttgaagcggcatggtacccatag

SEQ ID NO: 29857 - DNA, 3039 bp, Artificial Sequence
  Description of Artificial Sequence: Synthetic coding sequence
atgcttctaaaaagtatcttcatagtttatattttcttctactccatcagcgaactctcacttgacagtacactgcacgccgtcaatctgcactgcaataacatatcaaaaatcgaagctatcgatcacatttggaatctgcagcatctggatctaagctccaaccagataagtagaatcgaaggtctgaatacgctaaccaaactctgtactctaaatttgtcctgcaacctgattactaaagtggagggtctggaggagctcattaacctcacacggctgaacgtgtcttataatcacatcgacgacctgtccggcttgatccctttgcatggcattaagcacaaactccgatacatcgatctgcacagcaaccgcatcgacagcatccatcacctattgcagtgcatggtcggattgcattttctgaccaatttgatcctagaaaaagatggggacgacaatccggtttgccgcctccccggatatcgcgctgtaatcctacagaccctaccacagcttcgcattctggactgtaaaaatatttttggcgagccagttaatctgactgaaatcaactcaagccagttgcagtgcctcgagggcctcctggacaacctcgtgtccagtgattcgcctctgaacatcagtgaggacgaaatcattgaccgcatgcccgtgatcacagcacccattgacgaactggtgcccttagaacaatttgcctctacccccagtgatgccgttctgaccagctttatgtctgtgtgtcaaagctccgagccagaaaagaataaccatgagaatgatctgcaaaatgaaatcaaactgcaaaaactggacgatcagattctgcagctgttaaatgagacctcgaattctatcgacaacgttctcgagaaggatccgcgacccaaaagagacacagacatcacctccgaatccgactatggaaatagaaaggagtgcaatcgaaaagtgccccgtaggtcaaaaattccttacgatgctaaaacaattcagaccataaagcaccacaacaagaactacaactcctttgtctcttgcaaccgaaagatgaagccaccttatcttaaagagttgtatgtcagctcaagcttagccaattgtcctatgttacaggaatctgagaagcccaagactgagattattaaggtagaccagtcacactctgaggacaacacctaccagagcctggtagaacagctggaccaggagcgggagaagcgttggagggccgaacaggccgaaaacaaactcatggactatatcgacgagctgcataaacacgccaacgagaaggaagacattcactctctggcattattgacaaccgataggctgaaggaaatcatctttcgagagagaaattcgaaagggcagttggaggtgatggttcacaaactgcaaaatgaaatcaaaaaactaactgtcgagctgatgaaagctaaagatcagcaggaagatcacctgaaacacctccggaccctggaaaagactctcgagaagatggagcgccagaagcgccaacagcaggccgctcaaattcggctcattcaggaagtcgagttaaaagcctctgccgcagaccgggaaatatatctcctcagaacctctctccatagagaacgggaacaggcgcaacagcttcaccagctgctggcccttaaagaacaagaacataggaaggaactggagacacgggaatttttcaccgacgccgacttccaggacgcgctagctaaagagattgcaaaggaagagaagaaacacgaacagatgatcaaagagtatcaagagaagatcgatgtgctgagccaacaatatatggatcttgaaaacgagtttaggattgctttgacagtcgaggcccgaagattccaggatgtgaaagatggcttcgagaatgtggccaccgaactggcaaagtcaaagcacgctctgatctgggcccagcgcaaggagaatgaatcttcctctttgatcaaggatctgacctgtatggtgaaggagcaaaaaacaaagctcgctgaagtgagtaagttaaaacaggagacagcagcaaacctccagaatcaaattaataccctggagattctgatcgaggacgacaagcagaaaagcattcagatagagctgttaaagcacgagaaagtgcagcttataagcgaactcgcagcgaaggagagcttaatatttggcctgcgcactgaaagaaaagtgtggggccacgagttggcgcagcagggatcttccctcgcccagaatcggggtaagctggaggcccagattgagtctttaagcagagaaaatgagtgcctccgcaaaactaacgaaagtgattccgatgccttgaggatcaaatgtaaaataattgacgaccagaccgagactattcgtaagttgaaagattgtctgcaagagaaggatgaacatatcaagcggctgcaggagaagatcacagaaatcgaaaaatgcacacaggaacagctggacgagaaatcttctcaactggatgaagtgttggagaagctcgaaaggcacaacgaacggaaggagaagctcaagcagcagctgaagggcaaagaagtcgaactcgaagagatccggaaagcatacagcacactgaataggaagtggcatgacaagggcgaactgttatgtcatctcgagacacaggtcaaggaggtgaaggagaaatttgagaataaggagaagaagctgaaggccgagagagataaaagtattgaattgcagaagaatgccatggaaaaactgcactccatggacgatgcttttaaacggcaagtcgatgcaatagtggaagctcatcaggctgaaattgctcaactggccaatgaaaagcagaagtgcattgattcggccaacctcaaggtgcaccagatcgagaaggagatgcgcgagcttcttgaggagacttgcaagaacaaaaagaccatggaagctaaaatcaaacagcttgcgttcgcattgaacgaaatccaacaggacatgtag

SEQ ID NO: 29858 - DNA, 4665 bp, Artificial Sequence
  Description of Artificial Sequence: Synthetic coding sequence
atgtccgccacttcatggttcctggtgtcctcctctggcgcacgccaccgcctaccaagggaactgattttcgtcggccgagaagagtgcgagctcatgctgcagtctaggagcgtggacaagcagcacgctgtgatcaactacgaccaggaccgggacgaacattgggtgaaggacctcggaagtctgaacgggaccttcgtaaacgatatgcggattcccgatcagaaatacgtcaccctgaaactcaatgacgtcattcgcttcgggtacgatagtaatatgtacgtgctagagcgagtgcagcaccgagtcccggaggaggctctgaaacacgaaaaatatacaagccaactgcaggtgtccgtgaaagggctcgctccgaagcggagcgaggcattgccagaacacacaccttattgtgaagcatctaatcctaggcctgagaagggtgaccgacgccctggaaccgaagccgcttcgtatcggacacccctctacggccagccaagctggtggggagaagacgacggcagtacgctgcccgatgcacagcgacagggcgaaccctacccagagcggccaaagggcccagtacaacaagatggcgagcttcatggattccgtgcgcctgcagagccccaaggctgttcatttcgcagagaacccagctacttcgaaatccccacaaaggaaacacctcagcctagccagcctccggaggtgcccgcacacgagatgcccacaaaggacgcggaggctggtggagggggtgctgcaccagtggtacaatctcacgcctctttcaccatagaattcgacgattgttctcctggtaaaatgaaaataaaagatcatattacaaagttctccctgaggcagcgccgacctccaggtaaggaagctaccccaggcgagatggtgtctgctgagacgaaagtagcagattggcttgtacaaaatgacccttccctgctgcatcgcgtgggtccaggagacgaccggcatagcactaaatctgatctgcccgtccacactaggaccctgaagggacacaagcatgaggatggtacacagtcggatagcgaggatccgcttgcaaaggcagcttcagctgctggggtacccctcgaggcctcaggggagcaggttagactgcagagacagatcaagagagatccccaggagctcctgcataatcagcaagcttttgtcatcgagttcttcgacgaggacactccgagaaagaagaggtctcagagtttcactcattctccaagtggagatcctaaggctgacaagagaagagggccaacaccagccgatcgcgatagaccgtccgtccccgcaccagtgcaggctggtggacgcagtagtgggccacaaagggccggttcgctcaagagagaaaaaactgaagagaggctgggttcgccttcccccgcatcacgtacccctgcccgtccttttggtagtgtcgggcgtcggtcacgactcgcgcaggattttatggcccagtgcctgagagagtcatcacctgccgctaggccatccccggagaaggtgcctcctgtgttacccgcaccgcttactccccatggcaccagccccgtgggaccacctacccccccaccggctcccacggaccctcagctaaccaaggctagaaagcaagaagaagacgattctctttctgacgctggtacctatacaattgaaactgaagcgcaggataccgaagtggaggaagccagaaagatgatagaccaggtgttcggtgtcctggagtcacccgaactgtctcgtgcttcgtctgctacattcaggcccgtgataaggggcgacagagacgaatctgacgacggcggagtggcacaacggatggccctgctccaggaatttgcgagcaggccactgggcgctgcgcctcaggctgaacaccaggggcttccagtgcccggttcacccggtgggcaaaaatgggtgagtaggtgggccagcttggcagactcatatagtgaccctggcctcacagaagacggtctgggccgacgcggaggggaacctgagggtagcttgccagtgaggatgagacggcgacttccacagctgccttccgagagagccgactcaccagccggacctgagtcttcgaggcgctccggaccaggccctcctgagctggattccgaacagccctcccgattgttcggtcaggaggaactcgacccagactcactctctgacgccagcgggagcgacggtggcagaggaccggagccaggagttgaacctcaggattcacgccgacgttcacctcaggagggtccaacatggagcagaggcaggagatctcctcgggctcctggggagcctacccctgcaagcttcttcattggagaccagaacggagacgccgttctcagcaggaagccattagcagccccaggggacggggagggtctaggacagactgcacaaccgagtccccctgctagggacggcgtctacgtcagcgctaatggcagaatggttatacagctacgaccaggaaggagccccgaacccgacggtcctgctccggcattcctacgacaagagtcttttaccaaggagcctgcctccggaccccctgcgccaggcaagcctcctcacatctcctcccatccgttactgcaggacctggccgcaacccgcgcagcgaggatggacttccattcccaagatactcatctgatcctgaaagagactgaaacagccctggcagctttggaagcacgcttgctgtccaactctgtggatgctgagtgtgaagggggtagtacacccaggccccctgaagacgcactgtcaggagattccgacgtggacacagcttctacagtgagtctgcgtagtggcaagtccggcccatcaccaacaaccccccagccacttcgcgctcagaaagagatgtcgccaagcccacccgctgctcaggatccaggcggtacagccctggtgtccgccagggaacagtctagtgaaaggcagcatcatcccttaggtcccacggacatgggtcgcggagagccggtacgtcggagtgccatccgtaggggacatcgacctcgcggaagtctggattggccaagcgaggagcgtggacctgtgcttgcacatctgcccagtagcgacgtcatggcatcgaatcacgaaacccctgaggccaccggcgctgggagactcgggtccagaagaaaacctgcagcaccacccccttcacccgcagctcgtgaggagcagtcaagaagttccgcttcttcgcagaagggtccccaggcgcttacaagatccaacagtctcagtacaccaagacctacacgcgcatctagactcagacgggcacgtttgggagacgcctccgacactgaggctgctgatggcgagcgcggttcactgggcaatcctgaacccgttgggagacccgctgccgagcaggcaaaaaaattatcccgccttgacatcctcgctatgccacggaaacgtgcgggatctttcacagggacatccgaccctgaggccgctccggctaggacgtctttctctggtcgatcagtcgagctctgttgcgccagccggaaacctactatggccgaggccagagccgtgtcccgcaaggcagctaatacagccaccacaacaggaccaagacagccattttcacgggcaagaagcggttccgccagatatacttcaactacgcaaactccccgtgccggttcttcatccagagctaggtctagggcccctgggcctagagataccgatgacgatgaagaagagccagatccctacggtttcatagtgcagacggcggaaattgccgaaatcgcccgactctcccaaacgctcgtgaaggacgtggctatccttgcacaggagatacatgacgtcgcaggggatggagataccctgggcagctccgaaccagcccactctgcatcactgagcaacatgccttctacacctgcgtcaacaatttccgcgcgtgaagaactcgtgcagagaatcccagaggcctcactcaacttccagaaagtgcccccaggttccctaaatagccgtgattttgatcaaaatatgaacgacagctgtgaggatgccctcgctaataaaactagacccagaaaccgtgaggaagtaatctttgacaacctgatgctaaatcccgtgtcacagctgtcgcaagccatccgtgaaaatacagaacacctcgccgagaaaatgaaaatactattccagaacaccggtagggcctgggaggacctagaggcaagaattaatgccgaaaacgaggtgccaattctgaaaacttccaataaggaaatttcctcgatcttaaaagagctgcgtcgcgtacagaagcagctggaggtgatcaacgcaatcgtggacccatctggttcactcgacctacttacagggaatcgctccctggccagctctgcgcagcctggcctgggaaaggggagagtggcagcccaatcgccgccttcacccgcttcagcagaggctttacttccagcactgccattacggaacttccctcagagagctagttgcgggccacccagcctgcctgatccaacctttctgcccgacgccgaacgattccttatatag

SEQ ID NO: 29859 - DNA, 696 bp, Artificial Sequence
  Description of Artificial Sequence: Synthetic coding sequence
attatactgctcttggtgccttctgaggaaaccgatgagaacgatctgattctggaggttaccgcaggtgttgggggtggtttacggcacgctagcgcctctatcgggggtagcgaagcttacagacacatgaagttcgagggaggagtgcaccgcgtccagcgggttcccaaaaccgaaaagcaggggagagtccatacatcaacaatgaccgtggctatactgccacaaccaacagaaatcaaccttgtgatcaaccccaaagatcttcgtatagacactaaacgcgcatctggcgctgggggacagcatgtgaacacaacagacagtgccgttcgcatcgtgcatctcccaacaggggtcgtatcagagtgtcagcaggagaggtcccagcttaagaataaagaactggctatgacaaagcttcgcgcaaagctgtattctatgcacctagaggaggaaatcaataaacggcaaaacgcaaggaagatccaaatcggaagcaaaggtagaagtgagaaaattaggacctacaactttccccagaatagggtcactgatcatcgaatcaacaagacactgcacgatctcgaaacttttatgcagggcgactacctcctagacgagctcgtccagagcctgaaggagtacgccgactatgagagcttagtagaaattatctcgcagaaagtttag

SEQ ID NO: 29860 - DNA, 483 bp, Artificial Sequence
  Description of Artificial Sequence: Synthetic coding sequence
atggaagctgagcggccacaggaggaggaggacggtgagcaaggccctccacaggacgaagaggggtggccaccccctaatagcacaacaagaccctggagaagtgctcctccatcacccccaccgccagggactagacataccgctttggggccacgaagtgcgagcctgctctcacttcaaactgaactgctgctggacctggtggcggaggctcagagccgtcgcctggaggaacaacgagccacattttatacgccccagaaccccagtagcctggctcccgcacccttacgacccttagaggatcgagaacaactgtatagtactatcctgagccatcagtgtcagcggatggaggcccagcggagcgaaccaccattaccccctgggggtcaggagttgctggagctgcttctgcgtgttcagggcggaggccgtatggaagagcagaggtccaggccacccacacacacgtgttag

SEQ ID NO: 29861 - DNA, 423 bp, Artificial Sequence
  Description of Artificial Sequence: Synthetic coding sequence
atgcagtttggcgaacttctcgccgctgtcaggaaggcccaggccaacgtaatgctgttcctggaggagaaggagcaggcagccctatcccaagccaacggcatcaaagctcacctcgaatatcggtccgccgaaatggaaaagtccaagcaagagcttgagacaatggcagccatcagcaatacggttcaatttctggagatgtgcatgaccagccgctcgacccgtacccagcatactagtattagcgggtgtcggagaaggaccgcacgatcgccaacaccaagacccggatctatcccaactcggacatctcccgcagggtcctgcacaggcggaagatgctgccctagcagggtgtgtacatgtacaggcacgatcttaagatggagaagttccgggcaggcacccatgctggcgtag

SEQ ID NO: 29862 - DNA, 819 bp, Artificial Sequence
  Description of Artificial Sequence: Synthetic coding sequence
atggcatcttccaatacagtcctcatgcggttggtcgcatccgcctacagtatcgcccagaaggcgggtatgattgtgcgacgggtcatcgcggaaggcgatcttggaatcgttgagaagacatgtgcgacggacttacagacaaaagcagatagactggcgcagatgtcaatttgttccagtctagccaggaagttcccaaaactaaccattatcggggaagagctggttgtctgggtggaccccctggatggcactaaggagtacacggaaggcctattggataatgtgacagtactgatcggaattgcctacgaagggaaggctatagccggagtgataaaccagccctactacaactatgaggccggtcctgatgctgtccttgggcgaacaatttggggggttttgggcctgggcgcttttggatttcagctgaaagaagtacccgcaggaaagcacattatcacaaccaccagatcacactccaacaagctggtgactgattgcgttgcagccatgaaccccgatgctgtcctgcgcgtgggcggtgcagggaacaagatcatccaactgattgaagggaaggcctcggcctatgtcttcgcttcacccggatgcaaaaaatgggacacatgtgcgcctgaggtcatcctccacgccgttggtggcaagcttacggatattcatggaaatgtattacagtaccacaaagatgtcaagcacatgaactccgccggagttctggcaacgctgcgaaactatgactactacgccagcagagtacctgagtcgattaagaacgcgctggttccgtag

SEQ ID NO: 29863 - DNA, 606 bp, Artificial Sequence
  Description of Artificial Sequence: Synthetic coding sequence
atggaatcgaatcataagagcggggacggtctcagcgggacccagaaggaagccgcactgcgcgcattagtgcagcgcactggatattctctggtccaagagaatgggcagcgcaagtacggaggcccaccacctggatgggacgccgctcccccagagagagggtgcgagatctttataggtaaactgccccgagacctgtttgaagatgagcttattcctctatgcgagaaaatcggcaaaatctacgagatgagaatgatgatggatttcaacgggaataatcgcggatacgcctttgtgaccttttcgaataaagtagaagccaagaatgccatcaagcagcttaataattacgaaattagaaacggtcggttgctgggcgtgtgcgcgagcgtggacaattgcaggcttttcgtggggggaatccccaagacgaaaaaacgggaggagatcctgtccgaaatgaagaaggtcaccgagggggtggtggacgtgatcgtgtacccaagtgctgcggataaaacaaaaaaccggggattcgcctttgtcgagtacgagtctcaccgcgctgcggctatggccaggagaaagcttcttccatag

SEQ ID NO: 29864 - DNA, 1905 bp, Artificial Sequence
  Description of Artificial Sequence: Synthetic coding sequence
atggccctgagcaagcgtgaactagatgagctaaagccatggattgagaaaacagtgaagagagtgctgggcttcagcgaaccaaccgtggtcactgcagccttaaactgcgtggggaagggtatggacaagaagaaagcagcggatcacctcaaaccgtttctggatgactcgactctgcgcttcgtcgacaagctgttcgaggcagtggaggaggggcgtagcagcagacattccaaatcctcttcagaccggtcgaggaagagggaactgaagattaaacagatgatggaggccgcaactaggcaaatcgaggaacgcaaaaaacagcttagctttattagccctcccactccccagcctaagactcccagcagctcccagccggaaagactgcctattgggaataccattcaaccctcacaggccgcaacgtttatgaatgatgcgattgaaaaagctaggaaagctgctgaattgcaggcccgtattcaagcccaactggcccttaaacccggtctgattggaaatgccaacatggtaggtcttgccaatctccatgctatggggatagccccaccaaaggtcgagctgaaagatcagactaagcctactcccctgatattggatgagcaggggaggactgtagacgccactggaaaggaaatagagctgactcataggatgcccactcttaaagcaaatatccgcgctgtcaagcgcgaacaatttaagcagcagctcaaagaaaagcctagcgaggacatggagagtaacacgtttttcgatcctcgcgtttccattgcccctagtcagcgccagcgtagaacctttaaatttcatgacaaaggcaaattcgaaaaaatcgcccaaagactgagaaccaaagcacagctggagaagttgcaggcagagatcagccaagcagcaagaaaaaccggcatccacacctccacccggcttgctttaatcgccccaaagaaggaactgaaagaaggcgatattcccgaaattgagtggtgggattcctacattatacctaacggattcgatctcacggaagagaaccccaagagagaagattacttcgggattacaaaccttgtggagcaccccgctcagttgaacccacccgtggacaacgacacacctgtcactttgggcgtctacttgaccaaaaaggagcagaaaaaattgcgcagacaaaccagacgggaggcacagaaagagctgcaggaaaaagtccgcttgggcctcatgccacctccggaacccaaagtcaggatctcaaatttgatgcgtgtcctgggcaccgaagcagtccaagatcccacaaaagttgaggcacacgtgcgggcacagatggcaaagcggcagaaggcacacgaagaggccaatgctgccaggaaacttaccgctgagcagcggaaagttaagaaaataaaaaagctgaaggaggatatttcccagggggtccatatttcagtgtaccgagttcgcaacctcagcaaccccgcaaaaaaattcaagatcgaagccaatgccggtcagctttatctcacaggagtcgtggttctccacaaggacgtaaatgtggtagttgtggaaggcggtccaaaggctcagaagaaatttaagcgactgatgttacaccggatcaagtgggacgagcaaacaagtaacacaaagggtgacgacgacgaggagagtgatgaagaagccgtgaaaaagactaataagtgtgtccttgtgtgggaggggacagctaaagaccgctcattcggcgagatgaagttcaaacagtgtcccacagagaatatggccagagaacacttcaagaaacatggtgctgagcactattgggacctggcgttgtctgagtccgtgctggagtcaactgactag

SEQ ID NO: 29865 - DNA, 3192 bp, Artificial Sequence
  Description of Artificial Sequence: Synthetic coding sequence
atgcctcacctgccgttagcgtcctttcggcctcccttttgggggctacgacactctagaggacttccccgatttcatagcgtgtccacacaatcagaaccacacgggagtcctataagcagaaggaatcgtgaagctaaacaaaagcgcctcagagaaaagcaagccacccttgaagcagagatagcaggagaaagcaagagcccagctgaatctatcaaagcctggagaccaaaggagctggttctttacgaaatcccaaccaagcctggagaaaagaaagacgtgtctggacctctgccaccagcctatagccctcgatacgtcgaggccgcttggtacccctggtgggtccgcgaaggcttcttcaaaccggagtaccaggccagacttccacaggcgactggggagacgttcagtatgtgcatccctcctcccaacgtgacgggctctctgcacattgggcatgcactgacggtcgcaattcaggacgccctggttcgctggcaccggatgcggggagaccaagttctgtgggttcccggaagcgatcacgctggtattgctacgcaggccgtcgttgaaaaacaactgtggaaggagcggggtgtccgcagacacgagttatctcgggaggcctttctccgggaggtctggcagtggaaggaagcaaaagggggagagatttgtgaacagttgcgcgctctcggtgcctctctggattgggatcgcgaatgcttcaccatggatgtcgggagctccgtggcagtcactgaagcgtttgtgcgcctatataaagccggactcctgtacaggaatcaccagctcgtgaattggtcatgtgctcttcgctctgcaatctccgatattgaagtcgagaatcggcctctccccggacacacccagctgcgcctgcctgggtgtcccacaccggtgagcttcggtctgctgtttagcgtggcctttccggtcgatggcgagcccgacgctgaagtcgtggtcggaacaacaaggccagaaaccctacccggtgatgttgcggtcgctgttcatcctgacgacagccggtacacccacctgcacggcaggcagctgcgacacccactcatgggccagcctctccccctgataacagactatgctgtccagccccatgttggcacgggcgcagtcaaggtaacacctgcacatagtcccgcagacgcagaaatgggagcccgtcatggcctctcccctttgaatgtcatcgctgaggatggtacgatgacgtccttgtgtggtgattggctccagggtctgcaccgttttgttgcccgagagaaaatcatgtccgtcctgagtgagtggggcttgttcagaggcttgcagaaccatccgatggttcttccgatatgtagccggagcggcgacgtcattgagtacctcttgaaaaatcagtggttcgtgcggtgccaagaaatgggagcgagagctgcaaaagccgttgaatctggcgctctcgagctgtccccaagttttcatcagaagaattggcagcactggttttcccacatcggcgattggtgcgtgtccagacagctgtggtggggccaccagatccccgcttacctagtagtggaagatcatgcccagggggaagaggactgctgggttgtgggtcgctccgaggctgaggcccgagaggtggcggctgaactgacagggaggccaggggctgagctgacccttgaaagagatcccgacgttctggacacctggttttcctccgccctctttccgttttccgcactgggatggccgcaggagacgcctgacctagcccgattctaccctctcagtttgctagagacaggtagtgatctcctcctattctgggtcggtagaatggttatgttaggcacacaacttacaggacagctgcctttttctaaggttctgctccacccaatggtacgcgatagacaggggcgtaaaatgtcaaaatccctcggcaatgtgcttgaccccagagatattatttccggagtggaaatgcaggtcctgcaggagaaacttcggtcgggcaacctggacccagcagaattggcaatcgtggccgctgcacaaaagaaagatttccctcacggtatacccgagtgcggcactgatgctctgcgctttaccctgtgttctcatggcgtacaggccggtgacctgcatctgagcgtatccgaggtacaatcatgtcgacacttttgtaataagatctggaacgcgctgcgtttcattcttaatgccttgggtgaaaagtttgtccctcagcccgctgaggagctgagcccctcgtctcctatggacgcctggattctcagtaggttggccctggccgcacaggagtgtgagcggggattcctcactcgggaattgtcgcttgtcacccacgcgctccatcacttttggctgcataacctctgcgacgtatacctcgaggccgtgaagcctgtgttgtggcactctcccagacccctgggtcccccacaagtgctattcagttgtgcggatctgggcctgcgtcttctcgcacctttgatgccatttttggctgaagagctatggcaacggctgccacctcggccagggtgcccaccggcaccaagtatctctgtggcaccctacccctcagcctgttcgctggaacactggcgccagccagagctcgaaagaagattcagccgggtgcaggaagtggtccaagtgctgcgggctttgcgcgcaacatatcagctcacaaaagctcgccctcgagttcttctccaaagctcagagccaggcgaccaggggcttttcgaagcgtttctggaacctcttggcacactgggttattgcggcgcagttgggctgctccctcccggagcggcagctcctagcggatgggcccaggcccctttatctgacactgcccaggtctacatggaactgcaaggattggtggatccccagatccagctcccacttctggcagccaggcggtacaagctgcagaagcaactcgacagtctgacagccagaaccccctctgagggggaggcgggaacccaacggcagcagaaattgagttcactgcaactggagttaagtaagctggataaggccgctagccacttgagacagttaatggacgaaccaccggctcccggttccccggaactctag

SEQ ID NO: 29866 - DNA, 2118 bp, Artificial Sequence
  Description of Artificial Sequence: Synthetic coding sequence
atgatcgactcagtgaagttacgcagagacagcgcagctgattttttctcacactacgaatatttgtgcgctctccagaattcagtaccactgcccgctgtcagggcgtgtctgagagagggtgtcttggactttaacgccgaccgacttcgcggtgttgattgggcgcctctgctgtctacccttaagattaataaggacctgcccctcgtttccattaagtccttctttcaaccctggcttggagacactgggagcgacatgaataagttctgtcggagcagagtccctgctatccgctataaagacgttacctttcaactgtgtaaagcactgaagggatgtttatccatctctagtgtccttaagaacctggagctgaatgggttgattctcagagaacgcgatttgaccatattggctaagggtttgaacaaatcagctagcctagtgcacctgtcactggctaactgtcccattggcgatggcggactcgaaattatctgccagggcataaagtcttcaatcacgctgaagaccgtcaactttactggttgtaatcttacctggcagggcgctgaccatatggccaagattctgaagtatcagactatgcgcagacatgaagagacctgggccgaaagtctgcgctaccggcgacccgatctagattgcatggctgggctgaggcgcatcacgttgaattgtaatacacttatcggagatctcggagcatgtgcctttgcagattctctgagcgaagacctctggctgagagccttggacctccagcagtgcgggctgactaatgaaggggcaaaagcgctgctcgaagctctcgagactaacactaccctggtggtgctggatatcaggaaaaatcctctgattgatcacagcatgatgaaagccgtcatcaaaaaggtgctccaaaacggcagaagtgccaagagtgaataccagtggatcacctccccttcggtgaaggagccatcgaaaactgccaaacaaaagcggaggacgatcatactcggatccggccataaaggaaaggctacaattaggattggtctggcaaccaaaaagccagtatcaagtgggaggaaacatagcctcggaaaggagtactatgcaccagccccactgccaccaggcgtgagcggcttcctgccttggaggaccgctgagcgggcaaaacgacatcgagggtttcctctgataaagacccgagacatctgtaaccaactgcaacagccaggattccccgtcacagtcactgtggagtcgccttcaagcagcgaggtcgaggaagtggacgactcctctgagtctgtgcacgaggtgccagaaaaaacctccatcgagcaagaagcactccaggagaaactggaggagtgcttgaaacagctgaaggaagagagggtgattcggctgaaggtagataagagggtgtctgagctggagcacgagaatgcccagctccggaatataaactttagtttaagtgaggcgcttcacgcacagagcctgacgaacatgattctcgacgacgaaggcgtgttggggtccatcgagaactctttccagaaattccatgctttcctggacctcctgaaagatgccggactcggccaattggccacaatggccggaatcgatcagagcgactttcagctgctcgggcacccccagatgacaagcactgtgtcaaatcccccaaaggaagaaaagaaggccctggaagatgagaagccggaaccgaagcaaaatgcccttggacagatgcagaatattcaagtgtccatatgcatgcagtcagcgtacaacgaaggcaccttaatgaaattccaaaaaattaccggagacgccagaatccccctgccgctggattcctttccggtgcccgtctcaacaccagagggactcggcacgagtagtaataatctgggggtgcccgcaacggagcagcgccaggaaagttttgagggcttcatagccaggatgtgcagcccctccccagacgccacaagtggtaccggatctcagaggaaggaagaggaactctcccgtaacagccggtctagcagcgagaagaagacaaagaccggaagccattag

SEQ ID NO: 29867 - DNA, 1287 bp, Artificial Sequence
  Description of Artificial Sequence: Synthetic coding sequence
atggcctggcaaagccgcaaaggcggacatttcagagaggtggcgatgcagtggaaggtcaccctgacttccagatggggcctgttgaggcactgccaagtgctagccggactgttgcacctaggtaatattcagttcgcagcttccgaggatgaagcacaaccttgccagcccatggacgatgccaaatattctgtgcggaccgccgcaagcctgttgggcctgcccgaggatgtgctcttagagatggtccaaatcaggaccattcgggcaggccgacagcagcaggtgtttagaaaaccgtgtgcacgggctgagtgtgatacaaggcgcgattgccttgctaaattgatatacgcaaggcttttcgattggctggtcagcgtgattaatagctcaatctgtgccgacacagactcttggaccacttttataggattacttgatgtgtatggattcgagtcctttccagataacagtctggagcagctttgcatcaactatgctaatgagaagctgcagcagcacttcgtagcacactacctcagggctcaacaggaagagtacgcagttgaaggactggaatggtcctttattaactaccaggataatcagccctgcctcgacttaatcgaaggctctccaatctcaatttgctccctcatcaatgaggagtgccggctgaatcggccatctagtgcagcccagctgcagacaagaatagaaaccgccctggcaggaagcccttgcctgggtcataataaattgtccagggaaccaagcttcatcgtggtacactatgctggacccgtgagataccacacagcagggctcgtcgaaaaaaacaaagatcccatccctcctgaactagacggtgttgaggagaagcacttttcccaggcaccctgttctctgagcacctcaccccttcagacgcgattattagaagccattatacgcctctggccccttgggctggtgttagctaatacagcaatgggagttggatcttttcagcgaaaattagtggtgtgggcatgtctacagctgcccaggggaagcccaagcagttatactgtgcagacagcccaggatcaagccggagtgacttcaattagggcgctcccccaaggtagcataaaattccattgccggaagagccctcttcgttacgccgatatatgccctgaacccagtccttatagtatcactggcttcaatcagatccttcttgagaggcatcggctaatccatgtgactagcagtgcctttacgggcctaggatag

SEQ ID NO: 29868 - DNA, 927 bp, Artificial Sequence
  Description of Artificial Sequence: Synthetic coding sequence
atgaatcccatagtagtcgtccatggcggaggagctggccctatctcaaaggaccgcaaggaaagagtccaccagggtatggtgagggccgctacagtgggctatgggatcctccgtgaaggaggctcagcagtcgacgccgttgaaggggcagtagtcgctcttgaggatgatcctgaatttaacgcaggctgtggttcagtcttgaacacaaacggcgaagtggaaatggacgcgtctattatggacggtaaggacctgtccgctggggctgtgtcagctgtgcagtgtatcgcaaaccctattaagctggccagactggtcatggaaaaaacaccacactgttttctgactgatcaaggcgcagcccagttcgcagcggcaatgggtgtgcccgagatcccaggggagaaactcgtaaccgaaagaaataagaagcgcctggaaaaagagaagcatgaaaaaggcgctcaaaaaaccgactgccaaaaaaacctgggtaccgtaggcgctgttgccctggattgcaaaggaaatgtggcgtatgctacttccaccggaggaatcgtgaataagatggttggcagagttggagacagtccgtgcctgggcgctggcggttatgctgacaacgacattggagctgtcagcaccaccgggcacggagagtccatactgaaagtcaacctggcccgtcttactctgttccatatcgagcagggcaagacagttgaggaggcggcagacctgtccctgggttacatgaaatccagggtgaaaggtttggggggtctcatcgttgtgtctaaaaccggcgactgggtggccaaatggacaagcactagcatgccatgggctgcagccaaagacggaaaactgcatttcggcattgatccggatgacacaaccataactgacctgccttag

SEQ ID NO: 29869 - DNA, 429 bp, Artificial Sequence
  Description of Artificial Sequence: Synthetic coding sequence
atgagccttcacgggaagcggaaagagatctacaaatatgaagctccatggaccgtttacgcaatgaactggagtgttcggccagacaagaggttcagactcgccctgggtagcttcgtcgaggagtacaataataaggttgtgatcctggacgtgagggtcccctgtacaccagtggcaaggttgaataaccatcgcgcatgtgtcaacggcatcgcctgggcaccccactcctcctgtcatatctgtacggccgcagatgaccatcaggccctgatctgggatattcagcagatgcccagagctatcgaagaccccatattagcgtacactgccgagggtgaaataaataatgtgcagtgggctagtacacagccagattggatcgcaatctgctacaacaactgcctggagatactgagagtgtag

SEQ ID NO: 29870 - DNA, 1233 bp, Artificial Sequence
  Description of Artificial Sequence: Synthetic coding sequence
atggcagccccttctccctccggcggtggaggcagtgggggaggctctggatcaggaactcccggacctgtcggttccccggcacccggacacccggcagtaagtagtatgcaggggtttcagattaacttctgtgagaaggctcaatccaagaggaaggctttaaagttaaatttcgcaaacccaccttttaagagcaccgctagattcacacttaatccgaacccaacaggggtacaaaacccacatatagaacgcctaaggacacatagcatagagtccagcggtaagctgaaaattagccctgagcagcactgggactttacggccgaggatcttaaggacctgggggagatcggacgtggggcttatggcagtgtcaacaaaatggtccataagccttccgggcagatcatggctgtgaaaaggattcggagtacagttgatgaaaaagaacagaaacagcttctcatggacctcgacgtagtcatgcgttcatctgactgtccatatatagtccaattttatggagcccttttccgcgaaggagattgttggatctgtatggagttgatgtccacctcatttgataagttttataagtacgtttatagtgtactggacgatgtcatccccgaagagatcctgggtaaaattaccctcgctacggtgaaggcactcaatcaccttaaagaaaatctgaaaattatccaccgtgacattaaaccgtccaacatcttactcgaccggtcaggcaatatcaaactgtgtgactttgggatctcaggacagctggttgacagcatcgccaagaccagagacgccggatgccgcccttatatggcaccagaacgtattgatccaagcgcttcacgtcagggttatgacgtgaggagcgatgtgtggtccctgggcatcactctgtatgaactggccaccggtaggtttccttacccgaaatggaattccgtctttgaccagctgactcaagtggtgaagggtgatcctccacagttaagcaattctgaagaacgcgaattctcacctagcttcattaatttcgtcaacctttgtctaacaaaggacgagagcaaacgacctaagtacaaagagctcctcaagcatccattcatcttaatgtacgaagagcgagcggtcgaggttgcctgttacgtctgtaaaattctcgaccagatgccagccaccccctcaagccccatgtacgtggattag

SEQ ID NO: 29871 - DNA, 687 bp, Artificial Sequence
  Description of Artificial Sequence: Synthetic coding sequence
atgcaactggccgtagtgtcagaggagcaggatcaaaatttaaaccgactaatctgctggatactgatgcagttcatctatatcagttcagattatgtttttgacgggactaatccaccctatcgggaggaggacatccccgcacctctcaatctgtatgggaaaacaaagttagatggtgagaaagctgtgctggagaacaacctgggggctgccgttctgaggatcccaattctgtatggggaagttgagaagctcgaagaatctgcggttaccgtgatgtttgataaggtccaatttagtaacaagtcagctaatatggatcattggcaacagcgtttcccaacacacgtgaaggatgtcgctacagtgtgcaggcagcttgcggaaaagcgcatgttggacccaagtataaaggggacgtttcactggtccggaaacgaacagatgaccaagtacgaaatggcctgcgcaatcgccgacgcttttaatctaccctctagccatctaagacccatcaccgactctcccgtgctgggcgcacagaggcctagaaacgcacagctcgattgtagcaagttggagactcttgggatcggccagcggacccctttccgtatcggcataaaagaatctctgtggcctttcctaattgataagcggtggcgccaaactgtattccactag

SEQ ID NO: 29872 - DNA, 1101 bp, Artificial Sequence
  Description of Artificial Sequence: Synthetic coding sequence
atgagcgcagctaaccccgagactccaaactctaccatcagtagggaagcatccactcagtccagttccgctgctgctagccaggggtgggttctgcctgaaggcaaaattgtgcccaacacagtcttcgttgggggaatcgacgcgcgtatggatgaaacagagataggaagttgctttgggcgttacgggtccgttaaggaggtgaagattatcaccaacaggacaggggtctccaaaggctatggttttgtgagtttcgttaacgacgtggatgtccagaaaattgtcggaagtcagatccattttcatggtaaaaagcttaaattagggcctgccatccggaaacagaaactatgtgcaaggcacgtgcaacctcggcctttggtcgtgaacccccctccgccacctcagtttcagaacgtctggagaaatccaaataccgagacttatctgcagccccagatcactccaaatccagtgacacagcacgtgcaggcgtatagcgcatatccccattctcccggtcaggtaatcaccgggtgccaactgttagtttataactaccaggagtaccccacttaccccgacagtgctttccaggtgacgaccggctatcagttgcccgtgtacaattaccaacctttcccggcttacccaagttcgcctttccaggtgactgctggctaccagttacctgtgtacaattaccaggcgttccctgcctacccctccagcccattccaagtgacaacaggctaccaactgccagtgtataactaccaagcctttcccgcatatccttcaagcccctttcaagtaaccactggctatcagctaccagtttacaactaccaggcttttccggcttacccgtccagcccctttcaggtgactaccgggtatcaactgcccgtgtacaattatcaggcatttcctgcatatccaaactcagcagtccaggtcacaacaggatatcagttccacgtgtataactaccagatgccgcctcagtgtccagtcggagaacagcgccgtaatctttggacagaggcctacaaatggtggtatctggtctgtttgatccagagacgagattag

SEQ ID NO: 29873 - DNA, 306 bp, Artificial Sequence
  Description of Artificial Sequence: Synthetic coding sequence
atggcaagcgcaggcactcagcattatagtattggactgcggcagaagaactctttcaaacagtccggcccaagcgggaccgttccggcaacacccccagagaaaccgtccgagggacgagtttggcctcaggctcaccagcaggtcaaacccatctggaaactcgagaaaaaacaggttgagactttaagcgcaggtcttgggcctggtttgcttggtgtcccccctcaacccgcatattttttctgcccctccacactctgcagctcaggtacaacggccgtgatcgccggtcacagtagttag

SEQ ID NO: 29874 - DNA, 2121 bp, Artificial Sequence
  Description of Artificial Sequence: Synthetic coding sequence
atgattgacagcgtgaagcttcgtcgtgacagtgcagccgacttcttcagccattacgaatatctctgcgcgttgcagaactccgtcccacttcccgcagtgcgcgcttgtttacgcgagggcgtgttggatttcaatgccgatcgcctgagaggcgtcgattgggcccctcttctgtcaaccctgaagatcaataaggatctgcccctggtgtctatcaaatcatttttccagccttggttgggtgataccggtagtgacatgaataagttctgccggagccgtgtgccggctatccggtacaaagacgtaacatttcagctttgtaaggccctcaaagggtgtctgagcatatctagcgtcctgaaaaatttggaactgaacggcctcatccttcgggagagagatctgacaatactcgccaaaggactcaacaaatccgcatccctcgtacacctctccttggccaattgccctataggggacgggggtctggagattatttgccagggcatcaaaagtagcatcaccttaaaaaccgtaaactttaccggttgtaacttgacttggcagggggctgatcatatggctaaaatactgaaatatcagacaatgcgcagacacgaggagacctgggccgaaagtctcaggtataggagaccagacttggattgtatggcgggacttcgtcggatcacactgaattgtaacactctgatcggagatctcggtgcatgtgccttcgccgacagtctgtcggaggacctgtggctgcgcgctctcgaccttcaacagtgtggtctcaccaacgaaggagctaaagctctgctggaggcgctcgagacgaacacaacgctggtcgtgctggacattaggaaaaatcccttgatagatcatagcatgatgaaggccgtgatcaagaaagtgctacagaacggcagaagcgcaaaatccgagtatcagtggatcacttcgccatcagttaaagagccttctaagacagctaagcagaagaggcgaactataattctgggctctggacacaaagggaaggcgaccattaggattgtgggcctggctacaaagaagcctgtttcctctggaagaaagcatagcttaggcaaggaatattatgccccagccccattacctccaggcgtctcgggctttctgccctggcgaactgctgagagagctaagcgccaccggggtttccccctgattaagactcgggacatttgcaaccagctccaacagcccggattccccgttaccgtgacagtcgagagccccagctcctcagaggtagaggaagttgatgattcaagtgagagcgtgcatgaggtgccagagaaaacgagcatcgagcaggaggctctgcaggaaaaactcgaggaatgcttgaagcaactcaaggaggaacgggtgatacggttaaaggtggataagcgcgtgagcgaactggagcacgaaaatgcccagcttcggaacattaattttagcctgtcagaggccttgcatgcccagtcccttactaatatgattcttgacgatgaaggagtgctaggaagtatcgagaattccttccagaagttccacgctttcttggatctgcttaaagacgcagggttgggacaactcgcgactatggcgggaattgatcagtcagactttcaactgctgggccacccgcagatgacaagtaccgtatccaatcctcctaaggaagagaagaaagccttagaagacgagaaacccgaaccgaaacagaatgcgctgggccagatgcagaatatccagttccagaagattaccggcgatgctcgtattccccttcctctggatagttttcccgtgccagtgtccacgcccgagggcttgggtacctcttccaataaccttggagttccagcaacagagcagaggcaggagagtttcgagggatttattgctcgcatgtgttcgccatcaccagacgccacctccgggacaggatcccagcgtaaggaggaggaactgtctcgaaacagccgttcttcctcagaaaagaagaccaaaaccggggaatacactaaaaagcatagtgataaacagcaccctggcaaagatcttcactcatag

SEQ ID NO: 29875 - DNA, 1932 bp, Artificial Sequence
  Description of Artificial Sequence: Synthetic coding sequence
atggcttgccagcaaagccgctatcacagctttagctcagccagccgtctgcagcctcgcccaagcggagtcacgatagacgaatcattcctgaccgaagacaagtccactcagaatagaaagctgctgcagaagcgtcggaccctcgagctgcctgccgcaccgttgagccattgccaagcacctgtactgggcggtaccggaaaattacccacacagggggctccacccgctgggccaggacacagattccatccagggactaaagccgcagctcaccaacgagagaagatccgggcactggagccactgaaagccaaactagtgactgtgaatgaggactgcaacgaaagaatactggcgatgagggccgaagaaaagtatgagatctcacttttgaagaaggagaagatgaatttattgaagttgatagataagaaaaatgaggaaaagataagcctgcagtctgaagtaacaaaactccggaagaacctcgcagaagaatatctgcattacctttcggagcgagatgcttgcaaaattctgattgcagaccttaatgaactgagataccagagagaggatatgtccctggcacagtcccctggtatttggggggaggaccctgtcaaactaacccttgctctgaaaatgactagacaggacctcacacggactcagatggaactaaacaacatgaaggccaactttggggacgtggttccaagaagggattttgagatgcaggagaaaacgaataaggacctgcaggagcagctcgacacactgcgggcatcctatgaggaggttcgtaaagaacatgagattttgatgcaactgcatatgtccaccctgaaggaaagggaccagttcttttcagagctgcaagagatccagcggacttccactcctcggcctgactggacgaaatgcaaggatgttgtagcaggcggaccagaacgttggcagatgctggccgagggaaaaaactctgaccagctggtggacgtgctgctggaggagatcgggagcggcctgctgcgcgaaaaagatttttttccaggtttaggttatggcgaggcaattcctgctttcctccgcttcgacggactcgtggaaaataaaaagccatctaaaaaagacgtggtgaacttgctgaaagacgcctggaaagagagactggctgaggagcaaaaagaaaccttccctgacttcttctttaacttcttggaacatagattcgggccatcggacgccatggcatgggcttacactattttcgaaaacatcaaaatctttcactccaacgaagtcatgtcacagttctacgccgtcctgatggggaagaggtccgaaaacgtatacgtgacccagaaggagactgttgcgcagctactgaaggaaatgactaatgctgactctcagaacgagggtttgctgaccatggagcagtttaatacagtcttaaagagcacttttcccttgaagaccgaggagcagatacaggaattaatggaagccggaggctggcacccttcgtcttccaacgctgacctgcttaattatcgatcacttttcatggaggacgaggagggccaaagcgagccttttgtccagaaactgtgggaacagtacatggatgagaaagacgagtatctgcagcaattgaagcaggagctcggcatagagcttcacgaagaagttaccctgccgaagcttcggggaggactgatgaccattgacccaagcctagacaagcaaaccgtcaatacttatatgagtcaggcatttcagctgcctgagagcgaaatgcccgaggagggagacgagaaagaggaggcagtagtcgagatcctgcaaaccgcgctggagcgtctgcaggtgatcgatataagacgtgtggggcctcgcgagccagaacctgccagttag

SEQ ID NO: 29876 - DNA, 474 bp, Artificial Sequence
  Description of Artificial Sequence: Synthetic coding sequence
atggcaactagtgccccactaaggtctcttgaggaggaggtaacttgtagcatttgcctggattatctgcgcgaccctgtgacgatcgactgtggtcacgtattctgtcggtcttgcaccactgacgtcaggccaatcagcggctctagacccgtgtgtcctttgtgtaaaaagccgtttaagaaagaaaacattaggcctgtttggcagctagcaagtttggtcgagaacatcgagcggcttaaggtggataaaggtcgacagccaggagaagtgactcgggagcaacaggacgccaaattgtgtgagcgccaccgggaaaaacttcattattactgcgaggatgacggtaagcttctctgtgttatgtgccgcgagtctagggagcacagaccccataccgccgttttgatggagaaagccgctcaaccccacagggaaaagatcttgaatcatctttccaccttacgatag

SEQ ID NO: 29877 - DNA, 939 bp, Artificial Sequence
  Description of Artificial Sequence: Synthetic coding sequence
atggcacagccttatcctccagctcagtatccgccacctccgcagaatggtatccccgcagagtatgctcctcctccacctcaccctacgcaggactacagcggacagactcccgtgcctacggaacatggaatgacattgtataccccagctcagacacatccagagcagcctggctctgaggcttctacccaacctattgccggtacacagactgtgccacaaacagacgaggctgctcagaccgactcccagcctctccatccatcagatcccacggagaaacagcagccaaaacgccttcacgtgagcaacataccttttcgatttagagacccagatttgcgccagatgttcggccagttcggcaaaatccttgacgtggaaattatctttaacgagcgcggatccaaggggtttggttttgtgacattcgagacttcatcagacgcagaccgcgcacgggagaagcttaacgggacgatcgtcgaagggaggaaaatcgaagttaacaatgcaaccgcacgtgtcatgacgaacaagaagacaggaaacccatatactaacggttggaagctgaaccccgttgtcggggctgtctacggcccagagttctacgcagtcacagggttcccgtaccctactaccgggaccgcggtggcttatcgcggtgcacatttgcgcggtcggggacgagcagtgtacaacacctttcgggcagccccacctccccctcctataccaacttatggcgctgtcgtgtatcaagacggcttctacggcgcagaaatttacgggggatacgctgcctaccgctacgcccagcctgcagctgccgctgcagcctattccgactcctatggcagggtgtatgcagcagccgacccctatcaccataccatcggtcccgcagccacttactccataggcacaatgtag

SEQ ID NO: 29878 - DNA, 300 bp, Artificial Sequence
  Description of Artificial Sequence: Synthetic coding sequence
atggcatcactgctgcaagatcaactcaccacggatcaggatctgctgctgatgcaagagggcatgcccatgaggaaagtgaggagtaagtcctggaaaaagttaaggtattttcgcttgcaaaatgatggcatgaccgtgtggcatgccagacaggcgcgtggatctgctaagcccagctttagtattagcgacgtggagacaatccgaaatggccacgactcagagctgctgcggtcactggccgaggaactgcccctggaacaggggttcacaatcgtattccatggccgtcgttag

SEQ ID NO: 29879 - DNA, 1620 bp, Artificial Sequence
  Description of Artificial Sequence: Synthetic coding sequence
atggctacaagcgccccacttcgctcgctggaggaggaggttacctgcagcatttgtcttgactacctgcgagacccagtgacaatcgactgtgggcatgtgttttgtcgaagctgcaccacagatgtgcgtccaatatccggcagtaggcccgtgtgccccctttgcaagaaacctttcaagaaagaaaatattaggcctgtatggcagctggcgagcctggttgaaaatattgaacggctgaaggtggacaaaggacgccagcccggtgaggtgaccagggagcagcaggacgcaaaactgtgcgagaggcaccgtgagaagctccattactactgtgaagatgatggaaaactgctctgtgtaatgtgtcgtgagagcagggaacataggccacacactgctgtgctgatggagaaagctgctcagcctcatagggagaagattctcaaccacctttccaccctcaggcgcgatcgagacaaaatccaagggttccaagcaaaaggggaggctgatattttggcggcacttaagaaactgcaggaccagaggcaatatatcgtggccgaattcgagcaaggacatcagtttctccgggagcgggaggaacacctcctggagcagctggctaaacttgaacaggaactgactgagggaagagagaaatttaagtcccgcggagtgggggaactcgcacgactggcactcgtgatttcggagcttgaaggcaaggctcagcagcccgcagccgagctgatgcaggataccagggattttttgaaccgataccctcgcaaaaagttctgggtgggtaaaccaatcgcgagagtggtgaaaaagaagaccggcgagttcagcgataaacttctgagcttgcagcggggtctgagggagttccaaggcaagctactccgtgatctggagtacaagaccgtgtcagtgacactggacccccaatccgctagtgggtacctacagctttcagaggattggaaatgtgtgacgtacactagcctctataaaagcgcatatctgcatccacagcagttcgattgcgagcctggtgttctaggcagcaagggattcacctgggggaaagtttactgggaagtagaagtggagcgcgagggctggtccgaagacgaagaggagggggacgaggaggaagagggcgaagaggaggaggaagaggaagaagccggatacggagatgggtatgacgactgggagaccgacgaagatgaggagtcgctgggggacgaagaggaggaggaggaggaggaggaggaggaggtcctagagtcatgtatggtgggtgttgcacgagactcggttaagagaaaaggagatttgagtctcaggcctgaggacggggtgtgggccctgcgactgtcttcttcggggatttgggcaaatacttccccggaggctgagctatttcctgctctgcgtcccagacgggttgggatcgctctggactacgagggaggcactgttaccttcactaatgccgagtctcaggagctgatttacacttttaccgcaacttttacccgcagactggtccccttcctatggcttaagtggcccggaactaggttgctcctccgcccatag

SEQ ID NO: 29880 - DNA, 480 bp, Artificial Sequence
  Description of Artificial Sequence: Synthetic coding sequence
atggcaacgtccgcaccattacgaagcctcgaagaagaggtcacctgcagtatttgtctcgattatctccgcgatcccgtcacaatcgactgcggacatgtcttttgtcggtcgtgtaccactgatgtccgccctataagtgggtcccgacctgtgtgtcccctatgcaagaagccttttaagaaagagaacattcggccagtgtggcagcttgagaagattttaaatcatttatccacactgagacgcgatcgggataagattcaggggtttcaggcgaagggggaagctgatatcctggcagcattaaagaagctgcaggaccagcggcagtatattgtggcagaattcgaacagggccaccagttcctccgcgagcgagaagagcatcttctggaacagctcgctaagttggagcaggaacttacggaaggccgagaaaaatttaagtctcggggagtcggggagctggcaagatag

SEQ ID NO: 29881 - DNA, 579 bp, Artificial Sequence
  Description of Artificial Sequence: Synthetic coding sequence
atgggtaagggatgtaaagtagtcgtatgcggactcctgtccgtcggcaaaaccgcaattttggagcaactgctgtacggtaaccacacgatcggtatggaagattgtgaaacgatggaggatgtgtatatggcgagcgtggagacagaccgaggcgtgaaggaacagctgcacctctacgatactcgcggtctccaggagggagtggagttaccgaagcattatttctcttttgccgacgggttcgtcctggtgtactccgttaacaaccttgagtcctttcagcgcgtggagctcctgaagaaagaaatagataaattcaaggacaaaaaggaggtcgccatcgtggtgctgggcaacaaaattgacttgagcgagcagcgacaggttgacgcagaggtcgctcagcaatgggcaaaatctgaaaaagtcaggctctgggaagtcaccgtgacagacaggaaaacactgattgagccctttacactcctcgcatctaagttatctcagcctcagtcaaagagctctttccctctccctggcaggaagaacaaaggtaactctaactccgagaattag

SEQ ID NO: 29882 - DNA, 309 bp, Artificial Sequence
  Description of Artificial Sequence: Synthetic coding sequence
atgcacaatcggtcacagggcttcttcttctcatcatgccatccgcagaaccatgtttcctatgggtgtcagagcccatctttcatcttctgtcgctgtcagtccttgaacttcgtgagccggacatgttacccgctgtcttacttcagttatggcaatcagacaatcggcagtatttccaactctttccgatccctgaattacgtctcccactctttccagcccatcagttttatgcactcaagtttccaaccggcttgcagcgacttcgtgggctggcagtcccctttcctacgacgcacctgctag

SEQ ID NO: 29883 - DNA, 723 bp, Artificial Sequence
  Description of Artificial Sequence: Synthetic coding sequence
atggacttggtacgtctgggcttggagagaggagagaccgctaaggaggcactcgatgtgatcgtgtcactcttggaggaacacggccaagggggaaattatttcgaggacgcaaattcctgccattctttccagagtgcataccttatagtggaccgtgacgaagcatgggtcctagagactatcgggaaatactgggctgctgagaaggtgaccgagtccatcactgtccagacaatgatgaacactctaagagacaaggcctccggtgtgtgcatcgactcggaattctttctgaccaccgccagcggagtgtcagtgcttccccagaaccgcagtagcccctgtatccactactttactggcacccccgatccatctcggtccatcttcaaaccttttatcttcgtggacgatgtgaaattagtacccaagactcagagcccctgtttcggggacgatgacccggctaagaaggagccacggtttcaggaaaaacctgatcgacggcatgaactgtataaggcacacgagtgggctcgggctatcatcgaaagcgaccaggaacaggggagaaaactgaggagtactatgctggaacttgagaagcagggcctggaagctatggaggagattctaactagtagtgagcccctggacccagctgaagtcggagacctgttttatgactgcgttgacaccgaaattaagttctttaagtag

SEQ ID NO: 29884 - DNA, 900 bp, Artificial Sequence
  Description of Artificial Sequence: Synthetic coding sequence
tgaagagaggaggacatctatcagttcgcctactgttatccttatacatacacgcggttccagcattacctggacagcctgcagaaacggaacatggattatttttttagagagcagctcggccaaagcgtgcaacagcgcaaattggatctgctgacgattacaagtcccgataatttgagagaaggcgcagagcaaaaagtcgtatttataacggggagggttcatcccggtgaaactccttctagcttcgtgtgccagggaattattgatttccttgtttctcagcaccccattgcatgcgtgttgagggagtacttggtcttcaagatagcacctatgttgaaccctgacggggtgtatttgggcaactacaggtgctcactcatgggctttgatctgaatagacattggttggacccatcaccctgggtgcacccgaccctgcacggagtgaaacaattgattgtacaaatgtacaacgatcctaaaactagcctggagttctacatagacattcatgcccatagcacaatgatgaatggctttatgtatggcaacatcttcgaagacgaagaacgctttcagaggcaggccatcttccctaagctgttatgtcagaatgcagaggacttctcctactcatcaacaagtttcaatcgtgatgctgtgaaggcaggaactggccgaagattcctgggcggactgcttgaccatacctcctattgctacacgctcgaggtgtccttctatagctatataatcagcggaactacagcagctgtgccgtacaccgaagaggcttgcattctttctccccatcctgctttaggccagcccagttcttcccgtgaatatccaagcctcaccggacaggagctgggaccacagctgcgatag

SEQ ID NO: 29885 - DNA, 1041 bp, Artificial Sequence
  Description of Artificial Sequence: Synthetic coding sequence
atggccgctgccgagcctgcctcttcaggtcagcaggccccagccggacaaggacaaggccagagacctccacctcaacccccacaggcgcaggctccgcagccgcctccacctccacaactgggcggtgccggaggaggatcgtcccgccatgaaaagtcactgggtcttctgaccacgaaattcgtctcactactccaagaggcaaaggatggtgtgctggaccttaaagctgccgctgatacacttgcagtgcgtcagaaacgcaggatctacgacattaccaatgtcctcgagggaatcgatcttattgagaagaagtcaaagaatagcattcagtggaagggagtgggggcaggttgcaacaccaaagaagtgattgacagactgaggtacttgaaagctgagatagaggatctggaactaaaggaacgcgaactggatcagcagaaactgtggctacagcagagcatcaaaaacgtgatggacgactcgatcaacaaccgtttcagctatgtgactcatgaagatatttgtaattgttttaatggagacacgcttcttgcaatacaggccccaagtggaacacaactcgaggtccccatcccagaaatggggcagaatggtcagaaaaagtaccagattaatttgaagagtcacagtggcccaattcacgtgttgttgatcaacaaggagtcaagcagctccaagcctgtggtatttcccgtaccaccccctgatgacctgacacagccaagttctcagagtcttaccccagtgacaccacaaaaaagttcaatggctactcagaacctgcctgagcagcatgtctccgagcggagccaagctttacagcaaacgtcagccacggatatttcctccgctggctcaatatccggagacatcatcgatgaactcatgtcaagcgatgtgttccccctgctccggttgagcccaacaccagccgatgattacaatttcaacctggatgataatgagggagtgtgtgatttatttgatgtacaaatccttaactactag

SEQ ID NO: 29886 - DNA, 396 bp, Artificial Sequence
  Description of Artificial Sequence: Synthetic coding sequence
atgtccaaacgctacctgcagaaagccaccaagggaaagctgctgatcattatctttatcgtcactctctggggtaaggtggtgagtagcgctaatcatcataaggcccaccacgtaaaaaccgggacatgcgaagtcgtggccctccaccgctgctgtaataagaacaagattgaagagagaagccagaccgtcaagtgcagctgtttccccggacaggtggccggaactacgcgcgctgccccatcttgtgtggatgcctcgatcgtagaacagaaatggtggtgtcatatgcaaccatgcctggaaggtgaggaatgtaaggtcttacctgacagaaaaggctggtcctgttccagtggcaacaaagtgaaaacaacccgggtcacacattag

SEQ ID NO: 29887 - DNA, 306 bp, Artificial Sequence
  Description of Artificial Sequence: Synthetic coding sequence
atgccgttctttggcaacacgttctctccaaaaaagactccacctagaaagtccgcaagtcttagtaatttgcactccctggatcgcagcacaagagaagtggagctcggcctggagtacgggtctccaacgatgaatttggcaggccagtccttgaaattcgaaaatggacagtggatcgccgagaccggagtgagcgggggtgtggatcgacgagaagtccagcggctgaggcgcaggaaccagcagctagaagaggaaaataacctgctgcgcctgaaggttgatatcctcttagacatgtag

SEQ ID NO: 29888 - DNA, 393 bp, Artificial Sequence
  Description of Artificial Sequence: Synthetic coding sequence
atggatatttcaaagggcctacccggtatgcagggcggactccacatctggatctctgaaaatagaaagatggtacctgtgccagagggtgcctatggcaatttcttcgaggagcattgctacgtaatacttcatgtcccccagtcacccaaagctactcagggcgcatcttctgatttgcactactgggtcggtaaacaggcaggcgctgaggcacaaggcgctgccgaggcattccagcaacggcttcaggacgagttaggtggtcagactgtgcttcatagggaggcccagggccatgagtccgactgcttctgctcatatttccgccctggcattatctaccgtaaaggcggtctcgcgtctgatctgaaacatgttgagacgaattag

SEQ ID NO: 29889 - DNA, 51 bp, Artificial Sequence
  Description of Artificial Sequence: Synthetic coding sequence
atgtgcacgagcgagacattccaggcgctggacaccttcgaagctaggtag

SEQ ID NO: 29890 - DNA, 5553 bp, Artificial Sequence
  Description of Artificial Sequence: Synthetic coding sequence
atggagagcaacttcaaccaggagggggtgcccaggccttcctacgtgttttccgcagacccaatagcacgcccttcagaaataaattttgatgggatcaaactcgatctgagtcatgagttctccctggtagcgcctaatactgaggccaattcgtttgaatctaaagattatctgcaggtatgtctgagaattcgcccttttacccagtccgagaaagagctcgagagcgaggggtgcgtgcatatattggactctcaaacagttgtccttaaggagccccagtgtatcttgggaaggctgtctgagaaatcaagcggtcaaatggcacagaagttctccttcagcaaagtgttcggaccagcaacgacacagaaggagttctttcaggggtgcatcatgcagccagtcaaagatcttcttaaaggacagtcccgactgattttcacatacgggctgaccaactcaggaaaaacatatacgtttcaggggaccgaagaaaacatcggcattcttccaagaacccttaatgtgttgtttgattctctgcaggagcgtctgtacactaaaatgaacctcaagcctcataggtcaagggagtacttgcggttgtcctctgaacaggagaaagaggaaatcgcctctaaatctgcgcttcttcggcagattaaggaggtgaccgtgcacaacgactctgacgacactctctatggtagtttgaccaacagcttgaacatctcagagttcgaggagagtatcaaggattacgaacaggctaatctcaacatggccaactctatcaagttcagcgtgtgggtctcttttttcgaaatctataacgaatacatttacgacctcttcgtgcctgtctctagtaagttccagaagcggaagatgctgcggctgtcgcaggatgtaaaggggtactcttttatcaaggacctccagtggatccaggtttccgacagtaaggaggcttatcgactcctgaaattaggtatcaagcaccagtcagtagcctttacaaaactcaacaatgcgtcatccaggagtcactctatttttaccgttaagatcctacagatcgaagatagcgaaatgtcacgagttattcgcgtatctgaactgagtttatgcgacctagctgggtccgagcggaccatgaaaacccagaacgagggtgagcgtcttcgcgagacggggaacatcaatacctcattgctcaccctggggaagtgcattaatgttttgaaaaattcagaaaagtcaaaattccagcaacacgtgccattccgcgaatccaagcttacgcactactttcaatcattcttcaatgggaaaggtaagatttgcatgatcgtaaatatttcccagtgttatttggcatatgacgaaaccctgaacgtgctgaaattctccgcgattgctcaaaaggtgtgtgtgccggatacactgaactcaagccaagaaaagttatttggtccagtaaaatctagccaggacgtaagcctggacagcaattctaactcaaagatccttaatgtgaagcgagctacaatttcttgggagaactcccttgaggatcttatggaggatgaagatttggtggaggagctagaaaatgcagaggagacccagaacgtggagaccaaactcttagatgaggatcttgacaagaccctggaggaaaacaaagcctttatttctcatgaggagaaacggaagttgctggacctcatcgaagatctcaaaaagaaactcattaatgaaaagaaggagaaattgaccctggagtttaagatacgggaggaagtgactcaggaattcacccagtactgggcccagagggaagcggatttcaaagagaccctccttcaggagcgggagatcctagaagagaatgcagagaggaggcttgctatatttaaggatcttgtgggcaaatgcgacacacgagaagaggctgcgaaggacatctgcgctaccaaagtggaaacagaggaaactcacaattacgtaggatttgaagacatcattgatagccttcaggataacgtggccgacatcaaaaagcaggctgagatagcacacctgtatatagcgtctcttcccgacccccaggaggctactgcctgcctcgaactcaagtttaaccagatcaaagccgaactcgccaaaaccaaaggggagctgatcaagaccaaggaggagctgaaaaaacgtgagaacgagagcgatagcttgattcaagagcttgagacatcaaacaaaaaaattattacccaaaaccagcggataaaggagctgataaatattatcgaccagaaggaggacactatcaacgaattccagaacttgaagtctcacatggaaaatacatttaagtgtaacgacaaagccgacacgtcaagcctgatcataaacaacaaactgatctgcaacgaaaccgtcgaagtgcctaaggattccaagagcaaaatctgtagcgaacgcaaacgagtgaatgagaacgagctacagcaggatgagcctcctgccaagaagggcacaactagtgcagccagtagccgtcgcttgcgaaaactaatcagcaagcccgtgaaccggacacgccaaactgagggccacagtcttgtctctatccacgtttcatctgccataactgaggatcagaagaaatctgaggaagttcgtcccaatattgccgagatcgaagatatcagggtgttacaggagaacaacgagggcctacgcgctttcctcttaacgatcgaaaacgagctgaagaacgaaaaagaggagaaggccgaactgaacaaacagattgtgcactttcaacaggagctttctctttctgagaaaaaaaacctgaccctgtccaaagaagtgcagcaaattcaatccaactacgatattgctattgctgagctccatgttcagaaaagcaagaaccaggagcaagaggagaagatcatgaagctgtccaatgagatcgaaacagcaacgcgcagcattacaaacaatgtctcccagatcaaactaatgcatacaaaaattgatgagctcaggaccctcgactcggtgtcacagatatccaacatagacttattgaacctaagggatttgtccaacggaagcgaggaggataaccttcctaatacccagctggatctcctaggaaatgattatttagtgtccaagcaggtgaaggagtacagaatccaggagcccaatcgggaaaattccttccatagctccatcgaagctatctgggaggaatgtaaggagattgtcaaggcgagtagtaagaagtctcatcagatcgaagagctggaacagcaaatcgagaaactacaggcagaggttaaaggctacaaagacgaaaacaaccgcctcaaagaaaaggaacacaagaaccaagatgacctactgaaggaaaaagagacactgattcagcaactgaaagaggaattacaagaaaaaaatgttacgttagacgttcagattcagcatgttgtcgaaggcaaacgtgccctttccgagttaactcagggggtgacctgttacaaagccaaaatcaaagagttagaaaccatactggagactcagaaggtcgagtgctcacatagtgcgaaactggagcaggacatcctcgaaaaggagtctatcattctgaagctagagcggaacttgaaggaattccaggagcacttgcaggactccgttaagaacactaaggaccttaacgtgaaagaactgaagctcaaggaagaaatcacccaactgacaaacaatctgcaggatatgaagcacctgcttcaactgaaggaagaggaggaggagacgaaccgccaggagaccgagaagctgaaggaagaactgtccgcgagcagtgcaagaacccagaatctcaaagccgacctgcaaaggaaagaggaggattatgcagaccttaaggaaaagctgaccgacgcgaagaagcagatcaagcaagtacaaaaagaggtgtccgtgatgcgcgatgaagacaaattgctacggatcaagattaacgagcttgaaaagaagaaaaatcagtgctcacaggagctggacatgaaacagaggaccattcagcagctgaaagaacaactgaacaaccagaaggtcgaggaagccatccagcaatatgaacgcgcttgtaaggacctgaacgtcaaagagaagattattgaagacatgcggatgactctggaggagcaggaacagactcaggtggagcaagatcaagtactggaagcaaagctcgaggaggtggaaaggctcgctaccgaactggagaaatggaaagaaaaatgtaacgatttggaaacaaagaacaaccaaaggtcaaataaggagcacgagaacaacacggatgtactgggtaagctgactaacctccaggacgagctccaggagtcagagcagaaatacaacgccgacagaaaaaagtggctggaggaaaaaatgatgctcattactcaggccaaggaggcagaaaatatcaggaataaggagatgaagaagtacgcggaggaccgtgaaagattcttcaagcagcaaaacgagatggaaatcctcaccgctcagttgactgagaaggattcagacttacaaaaatggcgtgaggaacgagatcagctagtggcagccttagaaattcagctcaaagcactgataagttccaacgtccagaaagacaacgagatagagcagctcaagcggatcatcagcgaaacgtccaagatcgagactcaaatcatggatattaagccaaagaggatctcctcagcggatccggacaagctgcagacagaacctctgagcacttcctttgagatatcaaggaacaagattgaggatggctccgttgtgcttgattcctgcgaagtgagcaccgagaatgaccagagtacaagatttcctaaaccagagctcgagatccagtttactcccttacagcctaataagatggccgtgaaacaccctggatgcactacccccgtgacggtaaagatcccaaaggctcgaaaacggaaatcaaatgaaatggaagaggacttagtcaaatgcgagaataagaaaaatgcaacaccgagaaccaacctgaagtttcccatatccgatgaccggaatagttctgtcaagaaagagcaaaaagttgcaatcagaccctcaagtaaaaagacttatagcctacgcagtcaggccagtataataggagtcaatttggcaacgaaaaaaaaagagggcacactccaaaagtttggggattttctgcagcacagcccctctatcttgcagagtaaagccaagaaaataatagagactatgtcctcatccaagttaagtaatgtggaggccagtaaggagaatgtcagccagcccaaacgagctaaacgtaagctgtatacctcagaaatatcttcccctatcgatatcagtggccaggtgatcctcatggaccagaagatgaaagaatccgaccatcaaatcataaagcgcagacttcgtaccaaaactgctaagtac

SEQ ID NO: 29891 - DNA, 1527 bp, Artificial Sequence
  Description of Artificial Sequence: Synthetic coding sequence
atgcggtgtcctaagagtgctgtaacaatgcgcaatgaggaactcctcctttccaacggtaccgcaaataagatgaacggagccctggatcacagcgaccagccagaccccgatgccattaaaatgtttgtaggccagatcccccgtagctggagtgagaaggaactgaaggagcttttcgagccctacggcgcagtgtatcaaatcaacgtcttgagagaccgaagtcagaaccctccacaatcgaaaggctgttgtttcgttacgttttacacacgcaaagccgctctggaggcccagaacgctctgcataatatcaaaaccctccccggaatgcaccacccaattcagatgaaacccgcagattccgaaaagagcaacgccgtagaggatcgcaagctgtttatcggcatggtaagcaagaaatgcaacgagaatgacatcagggtgatgttctcccccttcggccagattgaggaatgtcgcatcttgaggggtcctgacggcctctctcggggttgcgctttcgtcactttttctacacgggctatggctcagaatgcgattaaggctatgcaccaatcccagactatggagggttgctcttctccaattgtggtgaagttcgcagatacacaaaaggacaaagagcagcgcagactgcagcagcagttggctcaacagatgcagcaattaaacacagcaacctggggtaacctgaccgggttgggaggcttgactccacagtatctggcactgctgcaacaggccaccagttcttcaaacttgggcgcattttccggcattcagcagatggcaggaatgaacgctttacagcttcagaaccttgcgactcttgcagccgctgccgcagctgcacagacgagcgccacaagtactaacgcaaacccactttctacgacctcaagcgcactcggagcccttacatccccagtggctgccagtacccccaattctactgcgggagctgcaatgaattccttaaccagcctgggcaccttgcaaggcctggctggcgcaaccgtgggattgaacaacatcaatgccctggccggtatggcggcactcaatgggggattgggcgctacaggattaacgaacggcactgctggcaccatggatgcactgactcaggcctatagcgggattcagcaatatgccgcagccgcactacccaccctgtattcgcagtctttgctgcaacagcagtccgcagctgggtctcagaaggagggacccgagggcgctaatctgttcatctaccatttaccacaggaatttggggaccaggatattctccaaatgtttatgccttttggaaatgtgatcagcgcaaaagtgtttattgacaaacaaactaatctgagcaagtgctttggcttcgtcagttatgacaaccctgtctccgcacaggcagcaattcaggcgatgaacggatttcagatcggaatgaaaaggctcaaggttcagttgaaacggagtaaaaatgactccaagccgtattag

SEQ ID NO: 29892 - DNA, 975 bp, Artificial Sequence
  Description of Artificial Sequence: Synthetic coding sequence
atgttcattggaggtcttagttggcagacgagccctgacagcctccgcgattatttttccaaattcggcgaaataagggagtgcatggtcatgcgcgaccctacaacaaagagatcccgaggttttgggttcgtcaccttcgccgaccctgccagtgtggacaaggtattgggtcagccacaccacgaattggactcaaaaacaatcgatccgaaggtagcctttccaaggcgggctcagcctaaaatggtcactcggacaaaaaagatttttgttggcggactttctgccaacaccgtggtcgaagatgtgaaacagtacttcgagcagtttggaaaggtggaagacgccatgcttatgtttgacaagacaaccaaccgacatcgaggctttggctttgttaccttcgaaaacgaagacgtggtcgagaaagtctgtgaaatacatttccacgaaatcaacaataaaatggtggaatgcaagaaggcccagccaaaagaggtcatgtttcctcctggaaccagaggcagggcacgtgggctcccatacacaatggatgctttcatgctcgggatggggatgctcgggtacccaaatttcgtggctacctatggtaggggctatcccggtttcgcaccatcttatggataccagtttcctggctttcccgctgctgcttatggacccgtggccgctgctgccgtggccgctgcccgagggtctgttctgaactcttattcagcccaacccaattttggagctccagcaagccccgcaggaagcaaccccgcaaggccgggaggctttcccggagccaacagcccagggcctgttgccgacctgtacggccctgcctctcaggactcgggtgttggcaattacatctctgctgcttccccccagccaggatccggcttcgggcacgggatagccggaccgctgatcgctaccgccttcactaacggttaccattag

SEQ ID NO: 29893 - DNA, 333 bp, Artificial Sequence
  Description of Artificial Sequence: Synthetic coding sequence
taacacaaaccttgctacggagctctatttggtcccaggggagtgaatattggcggtgtggggagctacctctacaacccgcctactccctcccccggttgtaccacacctctctccccttcctctttcagtccacctcgcccacgaacaggcctcccgcagggtaagaagaccgagaaagttatgtctttgggcaggaattggcacaggccctgtttgagatgccagcgctgccacaagactctgactgctggctctcacgccgaacacgacggtgtgccatattgccatgtcccctgctacgggtacctgttcggccctaaagccctgtag

SEQ ID NO: 29894 - DNA, 411 bp, Artificial Sequence
  Description of Artificial Sequence: Synthetic coding sequence
atgacagaagattcacagagaaactttcgtagtgtttactacgagaaggtcggtttccgtggcgttgaggagaagaagtcactcgagatcctgcttaaggacgatcggctagatacggaaaagctatgtacttttagtcagcggtttccactacccagcatgtatcgtgcgctggtatggaaggtacttctgggcattctccccccacatcatgagtcacatgcaaaagtcatgatgtaccgaaaggagcaatacctcgacgtgctccatgcccttaaagtggtgagatttgtctcagacgctacaccccaagccgaagtatacttgaggatgtatcagttggaatctggcaaattacctagatcaccatcttttccactggagccagatgatgaggttttcctggcttag

SEQ ID NO: 29895 - DNA, 1686 bp, Artificial Sequence
  Description of Artificial Sequence: Synthetic coding sequence
atggccagccaattctgcttgcccgaatcaccctgtttaagtccaccgcctttgagtcctcttgcacttgcacccagctccgcaatcagggatcaacgcactgcgaccaaatgggttgcaatgattccacagaaaaaccagacggcttctggagattccctggacgtgcgagtgccgagcaagccatgcctgatgaaacagaaaaaaagcccgtgcctgtgggaaatccagaagttacaggaacagcgagagaagcgaagaaggctccagcaggagataagagccaggcgggctctggacgtgaacacacgtaaccccaactacgagattatgcacatgattgaagaatatagacggcacttagactcatcaaagatctcagtgctggagccaccacaggagcatcgcatctgtgtttgtgtcagaaagaggcctctaaaccagcgagaaaccactttaaaggatcacgccttcgacgacaaagcctccaatgagttagtttatcagttcactgcacagcctctggttgagtccatattccgtaaaggtatggccacatgttttgcttacggccagaccgggagtgggaaaacttacaccatgggaggcgatttcagcggaacagcacaggattgctctaagggaatctacgccctggtggcccaggacgtgttcctgttgctgcgtaatagcacctacgaaaagctggacctgaaggtgtacggcacctttttcgaaatctatgggggaaaagtgtatgatctcctaaattggaagaaaaaactgcaggtgctcgaagacggaaatcagcagattcaggtcgtgggcctgcaagagaaagaagtctgttgcgtcgaggaggtcctgaacctcgtggagatcggaaactcttgcagaactagccggcagactccagtgaatgctcattccagcagaagtcacgccgtttttcagatcatactcaagagcggacgcattatgcatgggaaattttcattagtggatctcgcaggcaacgaaaggggagcggataccaccaaagcctctagaaaacgccaacttgagggagccgaaatcaataagtcactgcttgctcttaaggaatgtatcctggcactcggacagaacaagccacacacacccttccgagctagcaaactgacgttagtgctgcgggactccttcatcgggcagaattccagcacatgcatgattgcgaccatatctccaggcatgaccagttgtgagaacactttgaacactttgaggtatgccaatcgcgtgaaaaaactgaacgtagatgtccgcccatatcacaggggtcattaccccatcggtcatgaggcaccgaggatgctcaaatcccacatcggaaacagcgagatgtctttacagcgcgatgagttcataaaaattccctacgtacaatccgaggaacagaaggaaatcgaggaggtggagaccctccccactctgttgggcaaggacaccaccatctcagggaagggcagctcacagtggctcgaaaacattcaggaaagagctggaggagtccatcacgatatcgacttttgcattgccaggagtctctccattctcgagcagaaaatagatgctctcaccgaaatccagaaaaaacttaaactcctcctagcagatctccacgtcaaatctaaggtcgaatag

SEQ ID NO: 29896 - DNA, 375 bp, Artificial Sequence
  Description of Artificial Sequence: Synthetic coding sequence
tgaagtgcctgtattgggaactgttctacagccctcgaggagctgacagatgatatgaccgaagattttcttccagtactgcgcgagtatatactgtactccgactcaatgaagtctgttctgaagaaaagggatcaggtgcaggctgagtacgaagccaagctggaggccgtggcactgcgaaaagaagacagacctaaagttccagcggatgtggagaaatgccaagataggatggagtgtttcaatgcagatctcaaagctgatatggaaagatggcagaataacaagcggcaagatttccggcagcttctgatgggaatggcagacaagaacatacaatactatgagaagtctattgccgatcttaagtag

SEQ ID NO: 29897 - DNA, 747 bp, Artificial Sequence
  Description of Artificial Sequence: Synthetic coding sequence
atggccacttctgccccactacgttcccttgaggaagaagtgacttgctccatttgccttgattatctgagagacccagttacgatcgactgtggccacgttttttgcaggtcctgcactacggacgtacggcctatttccggcagcaggcctgtgtgtccgttgtgcaagaaaccattcaaaaaggaaaacattcgcccagtttggcagctcgcttccttggttgagaacattgagaggctgaaagtggataagggcagacagcccggagaggtcaccagagagcaacaggacgcaaagctgtgcgagcgacatcgggagaaactgcattactactgtgaggacgatggaaaacttctgtgcgtgatgtgtcgcgagagtcgcgagcaccggcctcacacagcagtcctcatggagaaggccgcacagccccatcgggaaaagatcctgaatcacctcagtacgctgaggagagatagggacaagattcagggatttcaggcaaagggcgaggccgatattcttgctgcacttaaaaagctgcaggaccagcgtcaatacattgtggccgaatttgaacagggccaccagttcctgcgagagcgcgaggaacacctactggagcaacttgctaaattggagcaggagctcactgaagggagggagaaatttaaatccaggggggtgggagaactggctcgcctcgctctggtcatcagtgaactggagggcaaggcccagcagtag

SEQ ID NO: 29898 - DNA, 1125 bp, Artificial Sequence
  Description of Artificial Sequence: Synthetic coding sequence
atggacttcaatatgaagaaactcgcaagcgatgcaggaatattcttcactagggctgttcagttcactgaagagaagttcgggcaggcagagaaaactgaacttgacgcacatttcgagaatctcctggctcgggctgactcaacgaagaactggacggaaaagatacttagacagactgaggtactgctgcagcccaaccctagcgccagagttgaggaattcctgtacgaaaaattagatcggaaagtgccctcccgggtgaccaatggagaactgttagcacagtacatggccgatgccgctagtgaactcggaccaactaccccctatggaaagacactgattaaggttgctgaagcggagaagcaacttggggctgccgaacgtgattttatacacactgcttctatatcctttctgaccccactacgcaacttcctcgaaggcgattggaagacgatttccaaagaacgccgtttgttgcagaatcgtcgcttggatcttgacgcatgcaaggcccgtctgaagaaagccaaagccgctgaagctaaagccacactgtggaacgatgaggtcgacaaagccgaacaggaactgagagtggcccaaactgaattcgatcgacaggcagaggtgactaggctgctcctcgaaggaatctcaagcacgcatgtcaatcatcttcgatgtctgcacgagttcgttaagtctcaaacaacctactatgcgcagtgctatcggcatatgctagacctgcaaaagcagctgggcagattccccggtacctttgtcgggaccactgaaccagctagcccaccgctgtcctctacgagccctaccactgcagcagctaccatgcccgtcgttccaagcgtggcaagcctggcaccgccaggcgaggcaagtttgtgtctcgaggaagtggcccctcccgcttcggggacacgcaaagcgagagtactctacgactacgaggccgcagactcaagcgagctggccctcctcgccgatgaactgatcacagtgtacagcttgcctgggatggaccccgactggctgatcggtgaaaggggaaacaagaaagggaaagttcccgtcacttacctggaactgctgagttag

SEQ ID NO: 29899 - DNA, 1188 bp, Artificial Sequence
  Description of Artificial Sequence: Synthetic coding sequence
atggcatctgccgcatccgtcacatcgctcgccgacgaggtgaactgcccaatatgccagggaacccttcgggagccggttaccatcgattgtggccacaacttttgtcgagcgtgcctcacaagatattgtgagattccgggacctgacctggaggaatccccaacctgtccgctgtgcaaggagcccttcagacctgggtcatttaggcctaactggcagctggctaacgtggtggagaacatcgagcgccttcaactggtgtccactcttggtcttggcgaggaggatgtctgccaagaacacggagaaaagatctattttttctgtgaggatgacgagatgcagctgtgcgtcgtatgccgcgaagcaggagaacatgccacgcatacaatgcgattcttggaggatgctgcggctccatatcgtgagcaaatacataaatgtcttaagtgtctgagaaaagagcgtgaagaaattcaggagattcaatccagagagaataaacgtatgcaggtacttctgacacaggtgtctaccaagaggcagcaggttatttcggagttcgcccacctaagaaagtttctcgaggagcaacagagcatccttttagcacagctagaatctcaggatggggatattctgcggcagcgggatgagttcgacctccttgtggccggagagatttgcagattctctgccttgatcgaggaactggaagagaagaatgagaggcctgctcgggagctgctgaccgacatccggtctactctgatccggtgtgaaacaagaaagtgtcggaagcctgtggcagtgtcccctgaactcggacagcggattcgtgattttcctcagcaggccctccccctccagcgcgagatgaagatgtttctcgaaaagctatgttttgagcttgactacgaacccgctcacataagtctcgatccccaaactagccatccaaagctgctcctatccgaggaccatcagagagctcagttctcctacaagtggcaaaacagccccgacaatccacagcgtttcgatcgggcaacatgcgtgctggcccacaccggaattactggcggtaggcatacgtgggtgtggatggcacgcgtgcctggtgacagcggatgctgccagttctgctcgcccccaagcgttttgggaaccgaagttgctgcgtag

SEQ ID NO: 29900 - DNA, 1131 bp, Artificial Sequence
  Description of Artificial Sequence: Synthetic coding sequence
atggagaaaaagaaaatggtgacgcagggcaaccaggaacctactaccacccctgatgccatggtccagccttttaccactattccctttccgcctccgccacagaacgggatcccaaccgagtacggagtcccccacacacaggattatgccggacaaaccggagaacataacctaactttgtacggttccactcaggcacatggagaacaatcgagcaattcgccgtccacccagaacggatcactcactacggaaggaggagcccagacggatggccagcagtcccagacacagtcctcagagaacagtgaatctaaatccacgccaaagcggttacacgtttccaatattccctttcgtttccgggatccagaccttaggcaaatgtttggacagttcggcaaaatcttagatgtagaaatcatcttcaacgagcgcggttctaaaggcttcggttttgtcacttttgaaaacagcgccgatgctgatagagcgagagaaaagctgcacggtaccgttgttgagggccgtaagattgaagtgaataatgcgaccgccagggtcatgaccaacaagaagatggtgaccccctacgcaaatggttggaagctttcacctgtggttggcgcagtctacggacccgagctttacgcagcctcatccttccaggctgatgttagcctgggtaatgatgcagcagtacctctgtctggacggggaggtatcaacacctatatcccgctgattatcccaggttttccctatccaacagccgctacaacagctgccgcatttcgaggggcacatctgagaggacggggtaggacagtgtacggcgctgttcgggcagtccctcctacagccataccagcatatccgggagtcgtttaccaggatgggttttatggcgctgacttgtacggtggctatgcagcatacagatatgcccagccagctaccgctaccgctgccaccgccgcagccgcagctgccgctgcttacagtgatggctacggccgtgtttacaccgccgacccttatcacgccctcgcccctgccgcatcctacggggtcggtgccgttgcctcactctaccggggtgggtattccagatttgccccatattag

SEQ ID NO: 29901 - DNA, 1638 bp, Artificial Sequence
  Description of Artificial Sequence: Synthetic coding sequence
atgggcaccccttggcgtcccccaagccggcgaccctggcgctggcccaccgggtgcacacgcaagacctgtggtccacccacttggtctttggaaagaacccggtcatggttgtcgggcagggagcatagtgtgttcacaggcgtggccatcgtgcactgttccagtaaagatcaccagctggatacacgggtgagcgaattttacgaagagacaaaggtgaagttttctgagctctcagaagaactgttgtgggagtacgtgcattccggggaaccgatggacaaggccggaggctacgggatccaggctctcggaggaatgctggtggagtccgtccacggtgatttcctgaacgtagttggcttccctctcaaccacttttgcaagcagttggttaaactctattatccgcctagacctgaggacctgcgcagatccgttaaacacgacagcatccctgcggctgatactttcgaggacctgtctgacgtcgagggtggtggttcagagcccacacagagggacgcgggttctcgggatgagaaggccgaagcaggggaggctggccaggcaacagccgaggccgagtgtcatcggacccgtgagacccttccccctttccccactcggcttctggagctaatcgagggctttatgctcagcaagggtcttctcacggcatgtaaactgaaagtttttgatctgctgaaggacgaggccccacagaaggctgccgacatcgcatccaaagttgatgccagtgcttgcggtatggaaaggttgctggacatctgtgcagctatgggactgttagaaaagacagagcagggatattccaatacagaaaccgcaaacgtttacctggccagtgatggcgagtacagccttcatgggtttatcatgcacaacaatgacctgacttggaacctgtttacatatctggagttcgcaatcagggaaggcaccaaccagcatcacagggccctgggtaagaaagcagaagatttgtttcaggatgcatattaccagagccccgagacaagattgcggttcatgcgggcaatgcacgggatgacgaaactcacggcttgtcaggtagccacagccttcaatctgtccaggttctctagcgcttgcgatgtcgggggttgcaccggtgctcttgccagggagctcgccagggagtatcccaggatgcaggtgaccgtctttgatctgcctgacattatagagctggctgcccacttccagcctcctggccctcaggccgtgcagatccacttcgctgcaggggacttcttccgcgaccctctgccaagcgcggaactgtacgttctctgtaggatccttcacgattggccagacgataaagtgcacaaactcctgagccgcgtggccgaatcttgcaagcctggcgcaggcctgctgctggtggagacactgctagacgaagaaaaaagggtggctcagagggctctcatgcagtctttgaacatgttggtacagacagaaggtaaagaacgatcactgggcgaatatcaatgccttctggagctacatgggttccaccaagtccaagtcgtacatctgggaggcgtgctcgatgccatactggctacaaaggtcgctccatag

SEQ ID NO: 29902 - DNA, 621 bp, Artificial Sequence
  Description of Artificial Sequence: Synthetic coding sequence
atgagtcagacttccctgaagcagaaaaagaatgaaccgggaatgcgaagctcgaaagaatcactggaggccgaaaagagaaaagagagtgataaaactggtgtaagattgtccaatcagatgaggcgcgctgtcaatcccaatcactctttaagatgctgccccttccaaggccattcctcttgtcgtagatgtttgtgtgccgcagaaggaacggctctcgggccatgtcatacaatccggatctacatccatatgtgtctgttgtgggaacaaggtcagcagattacgatgatgagagtatctcgcgaccataccacggacagcggcggagagcctcagactacatgggggtctcaggagtcctctctgcggaagacagacagtcgaggatacctggtccgcagccagtggtcccgaattagcaggtctccctctacaaaagctcctagtatagatgagcccaggtccagaaataccagcgcgaaacttccgagctccagtacatcgtccagaaccccaagtacctccccctctcttcacgatagcagtccgccaccacttagcggacagccctccctccagccccctgcatctccccagctcccaagatccttatag

SEQ ID NO: 29903 - DNA, 414 bp, Artificial Sequence
  Description of Artificial Sequence: Synthetic coding sequence
atggcaccaggtacccccaagagtctgttacttagtgcttccataaagcgcgagggcgagtccccgaccgctagccctcattcctccgccacggacgacctgcatcacagcgataggtatcagactttcttacgtgtgagagctaaccgccagactagactgaatgcgaggatcggcaagatgaagagaagaaagcaggatgaggggcaagtgtgtccgctatgtaatcgtcccctggccggatctgagcaggaaatgagtagacacgtggaacattgcctcagcaagagagaaggaagttgcatggcagaagacgatgctgtcgacattgagcacgaaaacaataacaggtttgaggaatatgaatggtgtgggcagaagcgcatcagagccaccaccctgctggaaggttag

SEQ ID NO: 29904 - DNA, 570 bp, Artificial Sequence
  Description of Artificial Sequence: Synthetic coding sequence
atgatacctatttgcccagtcgtgtccttcacgtacgtccccagccggcttggcgaggatgccaaaatggcaactgggaactactttggttttacccacagcggcgctgcggctgctgctgctgcagcccagtatagccagcagcctgcctccggggtcgcttatagccacccaacaacagttgcgtcctatacagtgcaccaggcaccagtggccgctcacacagtgacggccgcttacgctcctgccgctgccactgtcgcagtggcgagacccgcacccgtggctgtggcggcagctgccacggctgccgcatacgggggttatcccaccgctcacaccgcaaccgactacggctatacccaaaggcagcaggaggccccaccccctccgccaccggctacaactcagaactatcaggactcatacagctacgtgcggagcacagctccagctgtggcctacgacagtaaacaatactaccagcagcccgctgccacagaggcaggttcgagttccagctgctgttgctgttgtaacagctgcctggatagggaccatctctattag

SEQ ID NO: 29905 - DNA, 387 bp, Artificial Sequence
  Description of Artificial Sequence: Synthetic coding sequence
atggacgctgacagtgacgttgccttagacatcctgattaccaacgtggtctgcgtgttccgaacaagatgtcacctaaatttgcgaaagatcgcgctcgaaggggcaaacgtgatctataagagggatgtcggtaaagtactgatgaagctgaggaaacccaggataacggccactatctggtcgtctggcaaaatcatctgtactggagctacgtctgaggaagaggctaaatttggagccagacgcctggccaggagcctacaaaagcttggctttcaggtgatctttactgacttcaaagtggtcaacgttctcgcagtgtgcaatatgccatttgagatccgacttccagagttcactaaaaataataggccgcacgcgtag

SEQ ID NO: 29906 - DNA, 381 bp, Artificial Sequence
  Description of Artificial Sequence: Synthetic coding sequence
atgtggaccgcaaggggtccttttcgtagagataggtggtcatcggaggacgaagaggcagcgggaccatcccaggccctgtccccactactgagtgacactcggaagatcgtgagcgaaggagagctggatcagctcgcgcagattcggccactgatatttaacttccacgaacaaactgctataaaggactgccttaaaatacttgaggaaaagactgccgcttacgatataatgcaagagttcatggcacttgagttgaagaacctgcctggggaatttaactctggaaaccagcctagcaaccgggagaaaaatcgttatcgtgatattcttccttttcagcaccacggttactccggccctaacgagaggacttag

SEQ ID NO: 29907 - DNA, 912 bp, Artificial Sequence
  Description of Artificial Sequence: Synthetic coding sequence
gaagatgagtatattcagagccacaactttgattctgctatgaaagtgacctcacaaggccagcccagccctgtagagccccgaggcccattctacttttgcagactgctactcgacgatctggggatgaactcgtgggatcggaggaagaattttcacttacttaagaagaattctaaactcctccgcgaacttaaaaatctggacagtcggcaatgccgggaaacccacaagatcgcagtgttctacattgccgaggggcaggaagacaagtgttcaatcctgtccaatgaaaggggctcacaggcttatgaggattttgttgctggcctgggctgggaagtagacctgagtacccattgtgggttcatggggggtttgcagcggaatgggagcactgggcagaccgccccttactacgcaacctccaccgtggaggtgatctttcatgtctcaaccagaatgccttcagattcagacgactcactcaccaaaaaactgcgacacctggggaacgatgaagtacacattgtatggagcgagcattctagggactatcggaggggaatcatccctaccgcatttggcgatgtgtccatcatcatctaccctatgaagaaccacatgtttttcatagccatcaccaagaaacctgaagttccctttttcgggccacttttcgatggtgcgattgtgagtggcaaattactcccaagtctggtgtgcgccacatgcatcaatgcctctcgggctgtgaaatgccttatacccctctaccagtccttttacgaggagcgggctctctacctcgaagcaattatccagaatcaccgcgaagtcatgacctttgaggatttcgctgcccaggtgtttagcccatcgccgtcgtattccctgtctggtacagattag

SEQ ID NO: 29908 - DNA, 2883 bp, Artificial Sequence
  Description of Artificial Sequence: Synthetic coding sequence
atggaggtgcaagttagccaagccagccttgggtttgagctcacgtcagttgagaagtctctgcgagaatggagtcgcctgtcacgagaggtcatcgcgtggctgtgcccctcttctcctaatttcatattgaactttcctcctccgccatctgcctccagtgtgagtatggtccagttattcagctcgccctttgggtatcagagtccctcaggacattccgaagaagagcgggaggggaacatgaagagtgccaagcctcaggtgaaccatagccagcacggggaatcacaacgcgctctgagcccactgcagtccaccctgtcatcagccgcaagcccgagccaggcctacgagacctatatcgaaaacggtctgatctgcctcaagcacaagattcgtaacatagagaaaaaaaagctcaagctggaagactacaaggatcgcctaaagagtggcgaacatctgaatcccgatcagttagaagccgtggagaagtacgaggaggtgctccacaatctcgagttcgcaaaggagttacagaaaaccttcagtggactttcactcgatctcttgaaggcgcagaaaaaagctcagcgacgggagcatatgctgaagttggaggcggagaagaagaagttgagaactatccttcaggttcagtacgtgctgcagaatctgacacaagagcacgtgcagaaagacttcaagggcggtctgaacggagcagtttatctgcccagcaaagaacttgattatctcatcaagttttccaagctaacatgcccggagagaaacgagagtctgagcgtggaggaccagatggagcagagctcactgtacttctgggacctgctggaaggctccgagaaagcagtggtaggtaccacctacaaacacttgaaagatttactttccaaactgctcaatagcggatatttcgaatcgatcccggtgcctaagaacgccaaggagaaggaggtacctctggaggaggaaatgctgatccagtctgaaaagaagacccagttgtccaagaccgaaagcgtgaaagaaagtgagagcctaatggaattcgcccagcctgagatccaaccacaggaatttctgaatcgcaggtatatgaccgaagtggactacagtaataagcaaggagaggaacagccgtgggaggcagactacgctcgcaaaccgaatctcccaaaacggtgggacatgctcaccgagcctgacggccaagaaaaaaagcaagaaagctttaaatcatgggaggcgagcggaaaacatcaggaggtgtccaagcctgcggtctcattagagcagcggaagcaagatacaagtaaactgagaagcactctgccggaagaacagaagaagcaggagattagtaagtctaagccaagcccgtctcagtggaagcaagatactccaaagagtaaggccggttacgtacaggaggagcaaaagaagcaggaaacccccaaactttggccagtgcagctccaaaaagagcaggacccgaagaagcagactcctaagagctggacaccttctatgcaaagtgaacagaacactacaaagagctggactacgcccatgtgcgaggagcaggactccaaacagcctgaaactccgaagagttgggagaacaatgttgagagccagaagcacagtctgacttctcagagccaaatctcaccaaagtcatggggcgtcgcaacagccagcctgatcccaaatgatcaactcctgccacgcaaactgaatacggagccaaaagacgtcccaaagcccgtgcaccagccagtcggttccagttctactctgccgaaggaccctgtgctgagaaaggagaaacttcaggatttaatgacccagattcaaggcacttgcaatttcatgcaggaatccgtcctggattttgataagccctcatctgcaatccccacctctcaaccgccatccgcaacacctggctccccagttgcatcaaaagagcagaatttaagttcccaaagtgatttcctccaagaacctctgcaggctacttcatccccggtgacctgcagctcaaatgcttgcctggtaacaacggaccaagctagttcaggcagcgagacagaattcatgacttccgagacaccagaagccgctatccctccaggaaaacagccgagctctctagcctcccccaatccacccatggcaaaaggtagcgagcagggctttcagagccctcctgctagtagcagtagcgtgacgatcaacactgccccttttcaggcaatgcaaacggtgttcaacgtcaatgcgccactgccgcctcgaaaagagcaggaaataaaagaaagtccttattcccctggctataatcagtcctttaccacagcctccactcaaactcccccacagtgtcagcttccatccatccacgtggagcaaaccgtgcatagtcaggaaacagctaactatcatcccgacggtacgatccaggtgtcaaatgggagccttgcattttaccccgctcagactaacgtttttccacggccaacacagccgtttgtgaacagcaggggatccgtacgcggatgcacgagggggggtcgtttaatcaccaatagctaccggagtccaggaggttataagggctttgacacctatagaggcctacctagtatctccaacggaaattacagccagctgcagtttcaggctagagaatattctggggctccatattcccagagggacaatttccagcagtgttacaagaggggtggaaccagtgggggtccacgtgccaactcccgagccaattgtttcatcatgcgaaacagccttctgctgatcaagcagcaaggaggagtgatcttgcttcgttag

SEQ ID NO: 29909 - DNA, 1746 bp, Artificial Sequence
  Description of Artificial Sequence: Synthetic coding sequence
aacaacaacggaacatacgatggtatagcgtacttcgaatgtaaagaaaagcacggtatatttgcgccaccccagaagatcagccacatcccagaaaatttcgacgattacgtcgatattaacgaggatgaagattgctattctgacgaacgataccagtgttataatcaggaacaaaacgataccgaagggcctaaagaccgcgagaaggacgtgtccgaatatttttacgagaagtccttaccctccgtaaacgacattgaggcatccgtcaacagaagtaggagcctgaaaatagagacagataacgttcaggatatttctggggtgcttgaggcccatgtccatcagcagtcctcagtggattctcagattagcagtaaggagaataaagacttaattagtgatgccacagagaaggtctctatcgctgccgaggatgatacattggacaatacattttctgaagagctggagaaacaacagcaattcacagaagaggaggacaatctatacgcagaggcttccgagaagctttgtactcccttacttgatctcctaaccagagagaagaatcaactggaagcacagctgaagtcatcactcaatgaagaaaaaaaatccaagcagcagctggaaaagataagtttactgaccgacagcctgttgaaggttttcgtgaaggatacagtgaatcagctgcagcagattaaaaagacaagagatgaaaaaatccagctttctaatcaggaattactgggcgatgatcagaagaaagtcacaccacaagatttatctcagaatgtggaagaacagagcccaagcattagcggctgtttcctgagctccgagctggaggatgagaaggaggaaatctcatcccccgacatgtgccccaggcccgagtcacctgtcttcggtgccagtggacaggaggagctggccaaacgtttagccgagctcgagctgagtagggagttcctgagcgcactgggagatgaccaggattggtttgacgaagacttcggcctaagctccagccataaaatacagaagaataaggccgaggaaaccatcgtaccactcatggctgagcccaagagagtaacgcagcagccttgtgagacactccttgccgtgcctcacaccgccgaggaagtcgagattttagttcacaatgcagccgaggagctctggaagtggaaagagctggggcatgacctgcactcaatttctatcccaaccaaattattgggttgcgcatccaaaggactggatatagagtctacctccaaaagggtgtacaaacaggctgtcttcgacctcaccaaggagatttttgaggagattttcgcggaggatccaaatctgaatcagcccgtatggatgaaaccttgtcgaattaattcgtcttattttcgcagggtgaagaatcccaataatctcgacgagattaagtccttcattgcatcagaggttctgaaactgttctccttgaaaaaggagccaaatcacaaaaccgactggcagaaaatgatgaagttcggacggaagaagcgcgatagggtggaccacatcctcgtccaggagttacacgaggaagaagcacagtgggtgaactacgacgaggatgagctgtgcgtcaaaatgcaactagctgatggtatcttcgaaactctgattaaggatacaattgacgtgcttaaccagatatctgaaaagcaaggcaggatgttgctagtgtag

SEQ ID NO: 29910 - DNA, 345 bp, Artificial Sequence
  Description of Artificial Sequence: Synthetic coding sequence
atgtggagcctgactgcttctgagggggagtccacgacagcccacttctttcttggtgccggagacgaaggattgggaaccagggggatcggcatgagacccgaggagtctgattccgaactgctggaggacgaggaggacgaggtaccccctgaaccgcaaataatcgtcggcatatgtgcaatgacaaagaagagcaagagcaagcccatgactcaaatcctggaaagactctgccggttcgattatctaactgtggtgattctcggggaggacgtgatattaaatgagccagtagagaattggccatcctgtcactgcctcatctcattccattccaaatag

SEQ ID NO: 29911 - DNA, 918 bp, Artificial Sequence
  Description of Artificial Sequence: Synthetic coding sequence
atggaagcagaaagctttccctgtctgttgaggccatttttcaaggaaagatcctgcgcacttcggccagcttttcatactgccaaatgcgagaaacttcagaaagagaaggaggaattagagcggaggttcgaagccgaaatggcacgcctacaggaggaacatggtgaccagcttctgtccatacgatgtcagcaccaggagcaggtggaggaccttactgcctcgcatgacgccgcactgctggagatggagaacaaccacaccgtggccattacaatacttcaggatgatcacgatcataaagtgcaagaactcatgagcacgcacgaactggaaaagaaagaattggaagagaacttcgagaaactccgcttgagcctccaggatcaggtcgacactctgacctttcaatcccagagcctcagggaccgcgcaagacgtttcgaggaggccctgcggaaaaacacggaggagcagctcgagatcgctctggctccttatcaacacctggaggaagatatgaagtcactgaagcaagtgcttgagatgaagaatcagcagattcacgagcaggagaagaagatcctggagttggaaaagctggctgaaaagaacatcatactcgaagagaagatacaagtgctccagcagcagaatgaggatctgaaagcccgaatcgaccaaaatacagttgtgactaggcagttgagcgaggagaatgctaacttgcaggaatacgtggagaaagaaacccaggaaaagaaaaggctatctcgaactaacgaggaactgctttggaagctccagacgggtgaccccacctcccctattaagttatcgcccacatcacccgtgtacagaggcagttcatccggccctagctcccccgctagagttagcactacccctaggtag

SEQ ID NO: 29912 - DNA, 2319 bp, Artificial Sequence
  Description of Artificial Sequence: Synthetic coding sequence
atgcaggaacttgaagagttacggaaacagctcggaagcgtcgctacaggttctactctccaacagagtctcgagctgaaaagaaaaatgctaagggacaaacagaacaagaagaactccggccagcatttgcctatattccctgcgtgggtttacgagcgccctgctctgattggcgacttcttgatcggtgccggtatttccacagacaccgcgctgcccattgggacgcttcccctggctagtcaggagtctgcagtcgtcgaggatctgctctacgttctagtgggggtcgatggcaggtatgtgagtgcgcagccgctggctgggagacagagtcgaaccttcctggtcgaccccaatctggatttgagcattagagaactagtacaccgtatcctgccagtggctgcgtcatattctgccgtcacgaggtttatagaagagaaaagctcattcgagtacggtcaagtaaatcatgctctagccgcagcaatgcggacactcgtcaaagagcacctgatcctcgtcagtcagctggagcagcttcatagacaggggctcttatctttgcagaaactttggttctacattcagcccgcaatgcgcactatggatattctggcttctctagcgacttcagttgacaaaggcgagtgcttggggggatcaaccctttcccttctccacgaccgtagcttttcatatactggcgattcccaggcccaggaactttgtctttatctgacaaaggcagccagcgccccatactttgaagtgttagaaaaatggatctaccgaggtattatacacgacccttactccgagtttatggtggaggaacacgaacttagaaaagagcggattcaggaagactacaacgacaagtattgggaccaacgttacacaatcgtacaacagcagattcccagcttcctgcaaaaaatggcagacaaaatcctctcaaccggcaagtatttgaacgtggtgcgagaatgcggccatgatgtcacttgtcccgtggccaaggaaatcatttacactttgaaggagagagcctacgtggagcagatcgagaaggccttcaattatgcttctaaggtgctgctggattttctgatggaggagaaagagctggtggcccacctgaggtctatcaagcggtactttctgatggaccagggagactttttcgtccacttcatggacctggccgaagaagagttgcgaaaacccgtggaggacatcactcccccaaggctcgaggccctcttggaactggccctcaggatgagtacggccaacaccgatcctttcaaggacgacctgaaaattgacctaatgccacacgacctcataacccagttgctccgggtgctcgccattgagacaaaacaggaaaaagccatggctcacgcggaccctaccgagctggcactttctgggttagaagccttcagcttcgattacatagtaaaatggccattgtctctgattattaatcgaaaagccttgacgagatatcaaatgctgtttaggcatatgttttactgtaagcatgttgagcgtcagctttgttcagtatggattagtaacaaaactgccaaacagcactcactgcactctgcacagtggtttgccggagcttttacattgcggcagcgcatgttgaacttcgttcagaatattcagtattacatgatgttcgaagtgatggagccgacctggcacatcctcgagaaaaatctgaagagcgcaagtaacattgacgacgttcttggccatcacaccggattcctcgatacatgtctaaaagattgcatgctgaccaaccctgaactccttaaggtgttctctaagttgatgtctgtctgtgtgatgttcaccaactgtatgcaaaaatttacccagagtatgaaactggacggcgagttgggtggacagaccctggaacacagtacagttctgggcctcccagcaggcgcagaggagagggccaggaaagaactggctagaaagcacctggccgagcatgccgatacagtgcaacttgtcagcgggttcgaggccacgattaacaaattcgacaagaacttcagcgcacatttgctggatttgctagccagactgagcatctatagtacgagtgattgcgagcatggcatggcatccgtcatttcgcggctggacttcaacggcttttacacagaaagactcgaacgcctgtcagcagaacgctctcaaaaggcaaccccccaagtccctgtgttgcgaggccctccagcgccagcgcctcgggtggccgttaccgcacagtag

SEQ ID NO: 29913 - DNA, 1203 bp, Artificial Sequence
  Description of Artificial Sequence: Synthetic coding sequence
atggactttaatatgaaaaagctggcatccgacgccggtatcttctttacacgggctgttcaatttaccgaagagaagttcgggcaggctgaaaaaacggaactggatgcacattttgaaaatctattggctagggccgattctacaaagaactggaccgaaaagatcctgcgccagactgaagtgctcttacagcctaatccatccgccagggtcgaagagttcctatatgagaaactcgacagaaaggtgccttcacgcgtgaccaacggggagctactggcccagtatatggccgacgccgcatcagagctgggaccaacaaccccttatgggaaaacgcttatcaaggtggcggaggctgagaagcagctgggcgcagccgagcgggacttcattcatacggcttccatttccttcttaacccctctcagaaatttcttggagggcgactggaaaactatctctaaagagaggaggctcctccaaaatcgaaggttggatctggatgcctgcaaggcccgtttgaaaaaggcgaaagccgctgaggccaaggcaaccaccgttcctgattttcaagagacccggccacggaactacatcctctccgcctcagctagtgccttgtggaacgatgaagttgacaaagctgaacaggaactgcgcgtggctcagaccgagttcgataggcaggcggaggtgacgcgcttgttattggaaggcatttcctccactcacgtcaaccaccttcgatgcctccacgagttcgtgaagtcccagaccacctactacgcccagtgttaccggcacatgcttgacctccagaagcagttgggcagcagccagggcgcaatcttcccagggacctttgtgggcactacagagcccgcatctcctcccctgtcaagcacttcaccgactacggctgcagcaacaatgccagtagtgccaagcgtagcctccctggctccacctggtgaggcctccttatgcctggaagaggtggcaccccctgcgtccgggacacgtaaggcaagagtcctgtacgactatgaagcggcagactcgtctgagctggcccttctggccgatgagttaatcactgtgtacagcctgcctggaatggacccagattggctcatcggtgagcgtggcaataagaaagggaaggtcccagtcacctaccttgagctgctgagttag

SEQ ID NO: 29914 - DNA, 1827 bp, Artificial Sequence
  Description of Artificial Sequence: Synthetic coding sequence
atgcctttttggcctatcagatgtttgaaaaggagtagacgcatgccaaggggcggtgcaggagagcgggagaaggtgcctgcaaaccctgaggcactgctgttgatggcctcttcacaacgcgacatggaagactgggttcaagcaatacgtcgggtcatatgggctcctttaggcggaggtatatttgggcagcgcctagaagagactgttcaccatgagaggaaatacggccctaggctggccccacttctcgtggagcagtgcgtcgattttattcgagaacgcggacttactgaagaggggttgttccggatgcctgggcaggctaatctcgtaagagatctgcaggattctttcgactgtggtgagaagcccctgttcgacagcacgacagacgtccacacggtggcatcactgctgaagttgtatcttcgcgagttacctgagccagtggttccatttgccaggtacgaggatttcctgtcttgtgcccaactgctaaccaaagacgaaggagagggcaccctggagcttgcgaagcaggtatcaaacctgcctcaagctaattacaacctgctaagatacatatgtaaatttttagacgaagtgcaggcctactccaacgtgaacaagatgtctgtgcagaacctggccaccgtgtttgggcctaatatactgcgtccccaagtggaggatcctgttaccatcatggagggaacaagtctggtccaacaccttatgacggtgctcataaggaagcacagccagttattcactgcccctgtccctgagggacccacgtccccccgtgggggactccagtgtgctgtgggctggggttctgaggaggtaactcgcgatagccagggcgagccgggaggcccagggttgcctgctcatcgcacctcaagtctcgatggcgctgcagtggctgtcctctctagaaccgccccaaccgggccagggtcgcggtgcagcccgggtaaaaaagtccaaacactaccctcgtggaagtcaagtttcaggcagccgcgaagcctgtctggttctcccaagggcggaggctccagcttggaggttcctattatttctagcggagggaattggctcatgaacggactgagctctctgagagggcatcggagagcatcaagtggagacagactgaaggacagcggttcggttcagagactgtcaacctatgacaacgttccggctcctggccttgttccgggaattccgtccgtcgctagtatggcttggtccggcgcttcttcgtctgagtccagtgtgggaggaagtctgagctcctgcactgcttgtcgcgcttcagactcctcagctcgctcttctctgcacaccgattgggcactcgaacccagccctctcccaagttcctcggaagatccaaaatctctggatctggatcattcaatggatgaagctggagcaggagcttccaatagcgagcccagcgaacccgactcccctacacgggaacatgctcggaggtcagaggccctgcagggactggtaaccgagctgcgggcagagctctgcagacagaggactgaatacgagagaagcgtgaagcgaattgaggaagggtctgccgacttgcgcaaacggatgtcgagactagaggaggagctggaccaggaaaagaagaagtatattatgcttgaaattaagcttagaaattcagagagagcgagagaagatgccgaaaggcgcaaccagctcctgcaaagagagatggaagaattttttagtacactgggctctttgaccgtgggggctaaaggagccagagccccaaagtag

SEQ ID NO: 29915 - DNA, 708 bp, Artificial Sequence
  Description of Artificial Sequence: Synthetic coding sequence
atgtttagcgaagaatgcattatggatgtgattggatgtctcgaatacgatcccgcattgagtcagccccgtaaacaccgggagttcctcacaaagacggctaaatttaaagaagtgatcccaatctccgaccccgaactcaagcagaaaatccaccagacatatagggtgcagtacatccaagacatggtgcttccaaccccgtccgtctttgaggagaacatgctatctactctgcattctttcatcttctttaataaagtcgagattgttggcatgttgcaagaagacgaaaaatttctcaccgaccttttcgcccaattgactgatgaagccacggacgaggagaagagacaggaactagtgaattttctgaaggagttttgtgctttttcacagaccctgcagccccagaacagagacgcctttttcaaaaccctgagtaatatgggtatcctgcctgctctcgaggtaatcttgggaatggacgacacccaagtccgttccgctgcgaccgacattttctcctatctcgtggaatacaacccctccatggtccgggaattcgtgatgcaggaggcccagcagaatgatgacgtgtcgaagaaactcaccgagcagaaaatcacctcaaaagttaacatcatctgtacgaactccaaatatctgtatattggctcttataactgtttctactactctttttag

SEQ ID NO: 29916 - DNA, 3513 bp, Artificial Sequence
  Description of Artificial Sequence: Synthetic coding sequence
gtgtacaagggaaggcatgtaaagacggggcaactcgctgccattaaggtgatggacgtaactgaggatgaagaagaggagatcaagctggagattaatatgttaaaaaaatattcacatcatagaaacatcgctacttattacggagctttcattaagaagagcccccctggccacgacgatcagttatggctggttatggaattttgtggtgcagggtcgattactgacctggtgaagaacaccaaaggcaatacattaaaagaggattggattgcctacattagcagagagatcctgagaggcttagcgcatcttcacattcaccacgtgatccaccgggacattaaaggtcaaaatgtgctgctgactgaaaacgctgaagtgaagcttgtcgactttggagtgagcgcacagctcgaccgtacggtcggaaggcgcaatactttcatagggacaccatactggatggccccagaagtgatagcgtgcgacgagaacccggatgccacctacgactaccgctccgatctctggagctgtggaataaccgctatcgagatggcagagggagcccctccattatgcgatatgcaccctatgcgggctctcttcttaataccgcgaaatccccctcccaggcttaagtccaagaaatggagtaaaaaatttttcagctttattgagggctgtctggtaaaaaattatatgcagcgcccttccacagagcagctgttgaaacatccgtttattcgcgaccaaccaaacgagcgccaggttcgcatccagctgaaagatcacatagatagaactagaaaaaaacgcggtgagaaggacgagacagaatacgaatactcaggctctgaagaagaagaggaggaagttcccgaacaggaaggcgagccatctagcatcgtaaatgtaccaggcgagagcactttgagacgcgacttccttaggttgcagcaggaaaacaaggaacgttcagaggccttaagaagacaacagcttttgcaggagcagcagctgagagagcaggaagagtacaaaagacaacttctggccgaaaggcagaagcggatcgaacagcaaaaagagcagcggcgaaggctggaggagcagcagcgaagagaaagggaagctcggaggcagcaagagcgcgagcagcggcgacgtgaacaagaggaaaaaaggagactggaagagttggaaagaaggcgcaaggaagaggaggagcggcgtcgggcagaggaggaaaaaaggcgcgttgagagggagcaggagtacatccgcagacaactcgaagaggaacagcgtcatctggaggttctccagcagcagctgctgcaggaacaagcaatgcttctgcacgaccatcgacgccctcacccacaacattctcagcaaccaccgcctccccagcaggaaagatctaaaccatcctttcacgctcctgaacccaaggcccattatgaacccgctgatagagcccgagaagtggaggacagatttcgcaagactaaccacagctcccccgaagcccagtcaaaacagacagggagagtgctcgagcctccagtgccatctaggagtgaaagtttctccaacgggaatagtgagtccgtccatcctgcgctgcagagacccgctgaaccacaggtccctgtgcgcacaacttcaagatctccggtcctgtcacggagggattcaccactgcagggcagcggacagcaaaatagccaggctggtcagcgtaattctacatcaattgagccaaggcttttgtgggagcgggttgagaagctggtgcctcgcccaggctcaggatcgagctctgggtcaagtaattccggctcccagccgggtagccatccaggttcccagtccggcagcggcgagagattcagggtcaggtctagtagcaaaagtgagggaagccccagccagcggctcgaaaacgcagtaaaaaagcccgaggataaaaaggaggtgtttaggcctctgaaacccgctgacctgacagctctggccaaggagcttagggctgtagaggacgtacgccctccacacaaggtaaccgactactcttccagtagcgaggagtctggaactaccgatgaggaggatgatgacgtggaacaagaaggtgccgacgagtctacctccggccctgaggatacgcgtgcagcgagttcccttaaccttagcaatggggagaccgagtctgtgaaaacgatgattgtgcacgatgatgttgagtccgagcccgctatgacgccgtctaaagaaggaacactgatcgtgcgccagacccagtctgcttcctctacactgcagaagcacaaatcctctagttcctttactccttttatcgacccacggctgttgcagatttccccctcgagtggaactactgtcacctcggtggtaggcttctcttgtgacggaatgcggccagaggccattcgccaggacccaactcgcaaaggctccgttgttaacgtgaaccccacaaatacacgaccccaatccgatacaccagagattagaaaatacaaaaagagatttaactccgaaatcctttgcgctgccctatggggagtgaatttgcttgtgggtacagaatcaggcctcatgcttctggatcggtcggggcagggaaaagtttaccccttaatcaatcgcagaagattccagcagatggatgttttggagggcctgaacgtgctggtgacgattagtggtaaaaaggataagcttcgagtatactacctcagctggttgcggaacaaaattctgcacaacgatcctgaggtggaaaagaaacagggatggacaacggtgggggatcttgagggatgtgtgcactacaaagttgtcaagtacgaaagaattaaattccttgtgatcgccctcaaatcatccgtggaggtctatgcctgggctccaaaaccatatcacaaattcatggccttcaagtcgttcggagagttggtccataaaccgctgctggtcgatcttaccgtggaagagggtcaacgattaaaagtaatctacgggagctgtgccggttttcatgccgtcgacgtggatagcgggtcagtgtatgacatatatctcccaacccatattcagtgctccatcaaaccccacgccatcatcattctacctaataccgacggcatggaactgcttgtttgttacgaggacgagggggtctatgtgaatacctacggacgtatcacaaaagacgtcgtgctacaatggggtgaaatgcctacaagtgtggcttacatacggtccaatcaaactatgggctggggcgaaaaggctatcgagatacgcagtgtggagaccggtcacctcgatggagtcttcatgcacaagagggcccaacgactcaagtttctgtgtgaacggaacgacaaagtgtttttcgccagtgtgcggtccggcggatcatcgcaagtgtatttcatgaccctgggtcgaacatcgttgctttcatggtag

SEQ ID NO: 29917 - DNA, 1476 bp, Artificial Sequence
  Description of Artificial Sequence: Synthetic coding sequence
gtaatcattcaccgagtgctggaaaaacaggaagtcgaggtcttctaccccgactttggcaacattggcatagtgcaaaaatcaagccttcgcttcctgaaatgctgctataccaaactacctgctcaggccatcccctgcagcctggcatgggtgcgacccgtcgaggagcattggacaagtaaagctattttgcaatttcagaagctgtgtggcctgaagccgctggtgggggtggtcgatgagtacgtcgacggcatcttgaacattttcctgtgtgatactagctcaaacgaagatgtttatttccatcacgtcctcaggactgaaggacatgccatcgtgtgtagggaaaatatcagcagcaagggcttttcagagctaaatccattggcactgtacaccacaagctctgggggacccgaggatatagtactaactgagctggggtaccccagtcaacagcactatttcaacgaggaccgcaagattagcccccagagcaaggaatcagaactgaggattctgcaggatattaacgatgagaagtcgctctcgcacctgaaatccgaatccaaggagccacttaaggactcagaattcgaatcactgaagacttgtaataaatcctttgaagaggaccctaagtggagcaaccccgaacctaacgatctgaaggaagagaacgaagatgaaattccaactggcatgccctgcctcgaatccgtgacgatcggcgatgatatttgggatgaaaattggctgccactgcaggccaagatgggcaaggggggtgacgccgcttctcacctgtttacagcctctctcggcggaaaaaaccaatacagttcctgtaaagagatgccccagaaggactggtgtttctctacccccaaggacacctgggacgactcttggcagccttcaggactcgtaaacggaaccaaagtggaggtccataaacccgaggtcctgggcgcacaggagaaaaacacgggtacaaatcgcacccagaaacaacttgatatcaacggctcctccgactccagcacccttcccaagttggaagaattttgcacctccttaacgcagagcgaacagagtgccgacggtagccagtccgagcctaataattcacagacccagcccaaacaaattcaactcagtacagcagccccttgcagtacaacagccgtggacgattccgccgagaagcccagcgggagtgtggagtcttccccggagatcctgaaaaacgaagatttttcctcaagccgagcaattactctttacaaggacaagcggcaggaaagcgtcgaccagctatctctcatcttgtcctacgaatgtcagatctcccaaaaactgtatatccccaggagtacagccacagccgcattgggagccgcagctaggctcgccactagccggtccttgcttcattggtatcctagtgtaaaaaggatggaagcttag

SEQ ID NO: 29918 - DNA, 426 bp, Artificial Sequence
  Description of Artificial Sequence: Synthetic coding sequence
atgcctaccacctccagacccgcattagacgtgaaaggcggtacctctcctgctaaagaagatgccaaccaggagatgagcagtgtggcatattctaacttggccgtaaaggatcgcaaggccgtcgccattctccactatccaggagtggcatctaatgggacaaaagcctccggcgctcccacatccagcagcggcagccccatcggctctccgactactactccacccacaaaacccccatcttttaatctgcacccggcacctcacctgctcgcctctatgcacctgcagaagctaaactcccagtaccagggtatggcagcggctacccccggtcagcccggtgaggcagggccactgcagaactgggactttggcgctcaggccggaggagcagagtctctgtctcctagcgcgggatag

SEQ ID NO: 29919 - DNA, 1188 bp, Artificial Sequence
  Description of Artificial Sequence: Synthetic coding sequence
atggcctccgctgcttcagtcaccagcctggcagatgaagtcaattgtcctatttgtcagggcactctgcgtgaaccagttacaattgattgcggtcataacttttgcagagcctgcctgaccaggtactgtgaaatccccggtcctgacctggaggaaagtcctacctgcccactctgtaaagagccatttagacctggttcattccgccctaattggcagcttgcaaacgtggtcgagaacatagagagacttcaattggtcagtaccttaggccttggggaagaggatgtctgccaggagcatggggaaaagatctatttcttctgtgaagatgacgagatgcagctgtgtgtggtgtgccgagaggccggagaacacgccacccatactatgaggttcctcgaagacgccgctgccccatatcgcgaacagatccacaagtgcttaaaatgtctgcggaaagagcgcgaggaaatacaggaaattcagtcccgcgagaataagagaatgcaggtgcttctgacacaggtgtccaccaagcgccagcaggtgatttccgaatttgcacacctccgaaaattcttagaggagcagcaatctatcctcctggctcagctggagtcacaggacggggatatcctgcgccagcgagatgaatttgatttgctggtggcaggcgagatctgccggttctcggcccttattgaggaactcgaagaaaagaatgaacgcccagctcgagaactgctaaccgacattcgctccaccctcattagatgcgaaacccgcaaatgccggaagcctgtcgcggtgtctcccgagctgggacaacgtataagggatttcccacagcaggctttgcccctgcagagagagatgaagatgtttctggagaagctgtgcttcgagttagattacgaacctgcgcatatcagccttgacccccagacttcacaccctaaactcctgttatccgaggatcaccagagggcgcagttttcctacaagtggcagaactcccctgataatcctcagagatttgatagagcaacttgcgtgctggcccatacagggataactggtggacgccacacatgggtttggatggccagagtgcctggagacagcgggtgctgtcaattctgcagccccccttcggttctgggaaccgaggtggccgcatag

SEQ ID NO: 29920 - DNA, 1344 bp, Artificial Sequence
  Description of Artificial Sequence: Synthetic coding sequence
atggcaacagactcttgggctttggcggtggacgagcaagaggctgccgtgaaatctatgaccaacctccagattaaagaggagaaagtgaaagctgatactaacggaatcatcaagacaagtaccaccgccgagaagacagacgaagaggaaaaggaagaccgagcggctcagtctcttctcaacaagctgattcggtccaacctggtagataacaccaaccaggttgaagtcctgcagcgggaccccaactctcctctatattccgtgaagtcctttgaggagctccggctcccccagaatctgattgcccagtcccaatcgggaacaggcaaaactgctgcattcgttctggccatgcttagcagagtggagccctccgatcgctacccacagtgtctttgcttgtctccaacttatgagttagctctgcagactggtaaggtgattgaacagatggggaagttctatcctgagctgaaattggcttacgccgtcagggggaataagctggaaagggggcagaagatctcagaacagatcgtgataggcacccctggcacagttttagactggtgttctaagttgaaattcatcgacccaaagaagatcaaagtctttgtccttgatgaggctgatgtaatgatcgcaacccagggccaccaggaccaaagcattcggattcagcgcatgctccccaggaattgtcagatgctgctgttctcggctaccttcgaagactctgtgtggaaatttgctcagaaggtcgtcccagaccccaacgtcatcaaattaaaaagagaggaagaaaccctcgatactattaagcagtattacgtgttatgcagcagtagagacgaaaagtttcaggcattgtgcaacctctacggagctataactattgcacaggccatgattttttgccacacccgcaagacagccagttggctggcagccgaactgtccaaggaggggcatcaagtagctctcctgtctggtgaaatgatggtagagcaaagggccgctgtcattgagaggttccgagagggcaaggagaaagttctggtgacaactaacgtatgtgcaagaggtattgatgttgaacaggtttctgtagtgatcaactttgaccttccagtggataaagacggtaacccggacaatgagacctatctgcatcgtattggcagaactgggaggttcggaaagcgaggtctggccgtgaatatggtggattctaagcattccatgaatattctgaatcgaattcaggaacattttaacaaaaagatagaaaggttggacactgatgacctggacgagatcgaaaaaatcgctaactag

SEQ ID NO: 29921 - DNA, 630 bp, Artificial Sequence
  Description of Artificial Sequence: Synthetic coding sequence
atggcatcatctgacctagaacaactctgcagccatgttaacgagaagatcggtaacataaagaaaactctgagtttacggaattgcgggcaagaacccacgctgaagaccgtacttaataaaataggagatgagatcattgtgatcaacgagctgctcaataaactggagcttgaaattcagtatcaggaacagaccaacaatagcctcaaggagttgtgtgagtccctggaagaggattacaaagatattgagcacttaaaggaaaatgtacccagccatctaccgcaggtgacagtcacccaatcatggtatatgaaaagtcgcttaacctacaaccagatcaatgatgtcatcaaggagataaacaaggctgtcattagtaagtacaagatcttacaccagcctaaaaaatccatgaatagtgtgacccgcaacctgtatcacaggtttatcgacgaggaaaccaaggacaccaagggccgatactttatcgttgaggccgacatcaaagagttcaccacccttaaggcagataaaaagttccatgtattactgaatattcttcggcattgtcggcgactcagcgaagtcaggggtggcggtcttaccagatatgtaatcacctag

SEQ ID NO: 29922 - DNA, 1125 bp, Artificial Sequence
  Description of Artificial Sequence: Synthetic coding sequence
atggacagcgtgaggagtgggccatttggacagctctttcggcctgacaactttatatttggccaaaccggcgctgggaataattgggccaagggacattacacagaaggcgctgagctggtcgacgctgtcttggatgtggtgcgcaaggagtgtgagcactgcgattgccttcagggtttccagctaacccatagtctgggaggaggaactggcagcggcatgggcactctccttattagtaaaattcgtgaggagtttccagaccgaattatgaacaccttctctgtcatgccttcaccgaaggtgtccgatactgttgtggagccatataatgccaccttgtcagtacaccagttggtggagaacaccgatgaaacttactgcatcgacaatgaggctctgtatgatatatgtttcagaacgctgaaattaacaacacccacttacggcgatctgaatcacctggtttccgctacaatgagcggtgttaccacatcccttaggtttcccggtcagctcaatgccgatctgcgcaagctggcggtgaacatggtgccctttccccgactgcactttttcatgcctggatttgctcccttgacgtcaagaggcagccagcagtatagggcactgaccgttcctgagctgacccaacagatgttcgatgctcggaatatgatggccgcatgtgatcctcgccacggccgatatctcactgtcgccactgtgttccgcggaccaatgagtatgaaggaggtggatgagcagatgctggccatccagtcaaagaattcttcctatttcgtcgagtggattcccaataatgttaaggtggccgtgtgtgacatcccccctagaggtctgaagatggcttctacatttatcggaaattcaaccgccatccaagagttgttcaagaggatctctgaacagttttcagccatgtttcgccgtaaggcgtttcttcattggtttacaggggagggaatggatgagatggaatttacagaggctgagtccaacatgaacgatctcgtgtccgaatatcaacagtatcaggatgccacagccaacgatggagaagaggccttcgaagatgaagaggaggagattgatgggtag

SEQ ID NO: 29923 - DNA, 2289 bp, Artificial Sequence
  Description of Artificial Sequence: Synthetic coding sequence
atggctagtctgctgcaggatcaactaacaacggaccaagatcttttgctcatgcaggagggcatgcctatgcgcaaagtacggtcaaagagttggaagaagctcagatattttaggctgcagaacgacggtatgactgtttggcatgcacggcaggcgcgtgggtccgcaaagccctccttcagcatctctgacgtagaaacgataagaaatggtcacgactccgagctgcttcgctcactggcagaggagttacctctggagcagggtttcaccattgtgtttcacgggaggagatcaaacctggacttgatggcaaactctgtcgaggaggctcagatttggatgcgtgggcttcagttgctcgtcgaccttgtcacatctatggatcatcaagaacgcctcgaccagtggctgagcgactggttccaacgcggtgacaaaaaccaagatggcaagatgagctttcaggaggtgcagagactgctgcatctgatgaatgtcgagatggatcaagagtacgcattctcattattccaagccgcagatactagccagagcggcaccttagaaggggaagagtttgttcagttctacaaagcgcttacaaagagggcggaagtccaggagctgttcgagtctttctctgcggacgggcagaaattaaccctgctcgaatttctggatttcctgcaggaggagcagaaggaaagggattgtacgagcgaactcgcccttgagttgattgaccgctatgaaccatcagattccggaaagctccgtcacgtgcttagcatggatggcttcctgtcctacctatgctctaaggatggggatatattcaatcctgcttgcctacccatctaccaggatatgacccagccattgaaccactattttatctgcagttctcataatacataccttgtgggcgaccagctctgtggacagtcttcagttgagggatatattagggcactcaagcgtggttgtcgctgtgtggaagttgatgtctgggacgggccttcaggggagccagtggtgtatcacgggcacaccctcactagtagaattctgttcaaagatgtagtcgccactgtggcccaatatgcattccagactagtgactatccagtgatcctttcattggagacccactgcagctgggagcagcaacagaccatggctaggcacctgacagagatcctgggggagcagctactttcaaccacgctggatggcgtcctccccacgcaacttccgagtccagaagagttgcgacgcaaaatactggtcaaagggaagaagttgaccctggaagaggatctggaatatgaggaggaagaggcagagccagagcttgaggagtccgaattagcactggagtctcagtttgaaacagagccagaaccccaggagcagaacctgcagaacaaagataagaagaaaaagtcaaagccgatactgtgtccagctctgtcaagcctcgtgatctaccttaaaagtgtctctttccggtcgtttactcacagtaaggagcactaccacttttacgagatttcttccttcagcgaaactaaagctaaaagactgatcaaggaggcaggcaacgaattcgttcagcacaacacctggcaactgagtcgggtgtacccatccggactccggaccgactcatctaattataatccgcaagagctgtggaatgcgggatgccagatggtggctatgaacatgcagaccgctggtctcgagatggacatctgcgacggtcattttagacagaatggcggttgtggctacgtgctgaagccagattttctcagagatattcagtcctcattccaccccgagaaaccaatctccccgttcaaagcacaaaccctgctcatccaggtgatctcgggacaacagctacccaaagtcgataagacgaaagagggttccattgtagacccactggttaaggtacagattttcggggtgcgactggacacagcacgtcaagagactaactacgtcgagaacaacggcttcaatccttattggggtcaaacactatgcttccgggttttggtgcctgagctggccatgctgagatttgtcgtaatggactatgactggaagtcccgaaacgatttcatcgggcaatacaccctgccctggacctgcatgcagcaggggtaccggcatatccacctgctgtccaaagatggcataagtttgcggcctgcatcaatcttcgtgtacatctgcattcaagagggcctggagggagacgagtcatag

SEQ ID NO: 29924 - DNA, 1461 bp, Artificial Sequence
  Description of Artificial Sequence: Synthetic coding sequence
atggctgagctgcagatgttgcttgaggaagagattcctggcggaagacgcgcactgtttgactcttacaccaacctagagcgcgttgccgattactgcgaaaataattatatccagtccgccgacaaacagcgagcattagaagagaccaaggcctacacgacccagtccctggcgtccgtggcataccttattaacacacttgctaataacgtactgcagatgctggatatacaggcgagccagctaagacgcatggaatcatccatcaatcacatctcacagacggtcgatatccacaaggagaaggtcgcaaggcgggagattggaatcctgaccaccaacaagaacactagcaggacgcacaagatcatagcccctgctaacctggagaggcccgtgcgctatatccgtaagccgattgattatacaatcctagacgatattggacatggggttaaatggctgctcaggttcaaagttagcacgcagaacatgaagatgggcggactgccaagaaccacaccaccgactcagaaacctccaagcccgcctatgtccggtaaaggcacacttgggagacacagtccttaccggacactggagcccgttaggcctcctgtggtgcctaatgactacgtcccctcccctacaagaaatatggccccatcccaacagtctccagtgcgaacggcaagcgtaaatcagcgcaaccgaacctactcttcatctggctcatccggcggaagtcatccaagtagcagatcatcgtctcgggagaactcgggaagcgggagcgtgggagtcccaatcgcggtacccacccccagtccaccatcagtgttccccgctccagcaggaagcgctggcaccccacccttgcctgcaacctccgccagcgcccctgcacccctggtcccagccacagtaccaagcagcactgctcctgacgcagctgccggtggggctcaaaccctggcagatggattcacatcacctaccccaccagtggtgtcttccacgcccccaaccggacaccctgttcagttttacagcatgaacagacccgcttctcgacatacccctccaactattgggggatctctgccttatcgaagacctccttccataacttcacaaactagcctgcagaatcagatgaacggtggccctttttactcccagaacccagtctcagatactcctcctcctcctcctcccgtggaagagccagtcttcgacgaatctccgccacctcctccccctcccgaagactatgaagaggaggaggctgccgtggtggaatacagcgatccctacgccgaggaggatcccccttgggcgcctaggtcgtacctggaaaaagttgtggcgatttatgactacaccaaggacaaggaggatgagctgtctttccaggagggcgctattatttacgtaattaagaagaacgacgattag

SEQ ID NO: 29925 - DNA, 2145 bp, Artificial Sequence
  Description of Artificial Sequence: Synthetic coding sequence
atgctcagcccgaagatacgccaggcacgcagagctagatccaagagcttggtgatgggcgaacagtcaaggtccccaggccgtatgccctgtcctcatcgtttaggccctgtgttaaaagctggctggctcaagaaacaacggtccatcatgaaaaattggcagcagcgctggttcgtccttagaggtgatcaacttttttattacaaagacaaagacgagatcaaaccccagggcttcatttcgctccaggggacacaagtgactgaactaccccctgggccagaggaccccggtaagcacctgtttgagataagtcccggaggtgctggtgagcgggaaaaggttcccgcaaaccctgaggctttgctcctgatggcaagctcccaaagggatatggaagattgggtacaggctatccggagagtgatatgggccccactggggggtggcaccgcgcgacgatctcatgcccacccgcttgaacctctcccgccaggcatcttcggacagcggcttgaagaaaccgttcatcacgagcgcaagtacgggccacgtctcgccccactgttagtcgaacagtgcgtggacttcattagagagagaggcctcacagaggagggtctttttagaatgcctgggcaggccaatcttgtgagggacctgcaggattctttcgactgcggtgaaaaaccactcttcgatagtaccactgatgtgcacacagttgccagtctactgaagctttaccttagagagctgccggagcctgtggttccttttgcacgatatgaggactttctgtcctgcgcacagttgcttacaaaagatgagggagaaggcacactggaactagccaaacaggtgtctaatttgccccaagccaattataatctcttgaggtacatctgcaagttcctcgatgaagtgcaggcatattcaaacgtgaacaagatgagcgtgcagaatctggcaactgtgttcggccctaatatccttcggccacaggtggaggaccctgtcacgataatggagggaactagtttggtgcagcatttgatgacagttctgatacgcaagcatagccaactgttcacggcgccagtgccggaaggacccacgtctcctagaggaggactacagtgtgccgtcggctggggcagcgaggaagtcacccgggactcccagggggaacccggaggcccaggtctgcctgctcaccgcacgagttcacttgatggggcagcggtggctgtactgtcaaggactgctccgacaggcccaggttctagatgtagcccagggaagaaggttcagacactgcccagctggaagtcctcatttcgacagccccgtagcctctcagggagccctaaaggtggcggttcatcactggaggtccctatcattagtagcggtgggaactggctgatgaacggtttatctagcctgagaggccaccgcagagcatcttccggcgacagattgaaagacagcgggagtgtacagaggttatcaacatacgataacgtcccagctccagggcttgtcccaggaattcctagcgtggcttccatggcttggtccggagcatcctcttcagagagttccgtgggcggatcgttgagctcttgtactgcatgccgcgcatccgactcgagtgctagaagctccctgcatactgactgggcactggagcctagtccgcttccctcctcatcagaggatccaaagagcctcgacctagatcatagcatggatgaggccggagctggcgcatccaattccgagccatctgagccagattctcctactagggaacacgccagaagaagcgaggccttgcagggactcgtgactgagttgagagccgagctgtgccgacaaagaactgagtatgagagatctgttaagagaatagaagaggggtcagctgacctgaggaaaagaatgagtcggctcgaggaagaactggatcaagaaaaaaagaaatacatcatgttggagatcaaactacgtaactccgagcgcgcacgcgaggatgctgagaggaggaaccaactgctccagagagagatggaggagttttttagcactttagggtctttgaccgtgggtgctaagggagcacgggctcccaaatag

SEQ ID NO: 29926 - DNA, 381 bp, Artificial Sequence
  Description of Artificial Sequence: Synthetic coding sequence
atgtggactgcacggggtccgttccgcagggatcgctggtcgtcggaagacgaagaagccgcagggccatctcaggcactgtcaccattgcttagcgacactcggaagatcgtgtctgaaggagagctggatcaattggcccagatccggcctctgatttttaactttcacgagcagacagctataaaagattgccttaagatccttgaagagaaaaccgcagcctatgacattatgcaagaatttatggccctggagctgaaaaatttgcctggcgagtttaactccggcaatcagccctcaaatagggaaaaaaatcggtatcgtgacattctgccattccagcatcacggatacagcggccctaatgagcggacctag

SEQ ID NO: 29927 - DNA, 2442 bp, Artificial Sequence
  Description of Artificial Sequence: Synthetic coding sequence
atgtctgagcagggcgatctgaatcaggccatcgcggaggagggcggaaccgagcaagaaaccgccactccggagaacggcatcgtcaagagcgagtcactcgacgaggaggagaagctggagctgcagcggagactggaggcacagaatcaggaacgccgaaagagcaaatctggcgcaggcaaggggaaactcaccaggtctctagccgtgtgcgaggaatcttctgccaggccaggtggggagagtctgcaggaccaggagagcatacacctccagctgtcttcattctccagcctgcaagaggaggataagtcacggaaagacgatagcgagcgcgagaaggagaaagacaagaacaaggataagacttcagaaaaacctaagattagaatgctgtctaaggattgctcccaggaatatactgatagcactggaatcgatctgcatgaattcctgatcaacactctcaagaataattcaagggacagaatgattctgctgaaaatggaacaggaaattatagacttcatcgctgataataataatcactacaagaagtttccccagatgtcaagctatcagagaatgctggtgcatcgggtcgcagcctacttcggtctggatcacaatgtcgatcagaccgggaaaagcgtcattattaacaaaaccagttctactcgcatccccgagcagaggttttgtgagcacctcaaagacgaaaaaggggaggaatcacagaaacggttcatccttaaaagggacaactcctctatcgataaggaggataaccagtccgtgtgtagtcaggaatccctgtttgtcgaaaatagcagactactggaggattccaatatttgcaatgaaacctacaagaagcggcagctgtttaggggcaatcgagatggaagcggaaggacatcaggatcccgacaaagctcttccgagaacgaattaaagtggtcagatcaccagcgcgcatggagctcaaccgactccgatagcagcaataggaatttgaagccagctatgacaaaaaccgcgtccttcggtgggatcactgtcctcactcggggagactccacctcatcaacccggagcactggcaagctgagcaaagccggaagcgagagctccagttctgctggttcttctggctctctaagtcggacccaccctcctttacaatctacacctttggtaagcggcgtggccgcaggcagccctgggtgcgtaccatatccagagaacggtattggcggtcaggttgcaccctcatccacctcctatatcttgctccccctggaggctgctacagggatacccccaggatcgatcctgctcaaccctcacacgggccagccatttgtgaatcccgacgggactcccgcaatctacaatccgcctacaagccaacagccacttaggtccgccatggtggggcagagccaacaacaacccccacaacagcaaccctcgccccaaccccagcaacaggtgcagccccctcagccgcagatggcaggtcctcttgttacccagtccgtgcagggactgcaggcctctagccagtctgtgcagtacccagctgtatctttcccgccacagcacctgctaccagtgtccccaacccagcactttcccatgcgggatgatgttgccacacagttcggccagatgacgctgtctcgtcagtcaagcggggagacgccagaaccacctagtgggccagtttacccaagctccctcatgcctcagccagcccagcaacccagctatgtcattgccagcaccggtcagcagttgccgactggcggattcagcggctctggtcctccaatcagccagcaggtgttgcaacccccaccatctccacagggtttcgtgcaacagccaccacccgcacagatgcccgtatattactatccctccggacagtatcccacctctacaactcagcaatacaggcccatggctcctgtgcagtacaatgctcaacgatcccagcaaatgcctcaggcagcgcaacaggcaggctaccagcccgtgcttagtggtcagcaaggctttcaagggctgataggagtacagcagcccccacagtcccagaacgtgatcaacaatcaacaggggacccctgtgcagtcagtgatggtcagctaccctactatgagttcttaccaggttcctatgactcagggctcacagggccttccacagcaatcatatcagcaaccaattatgctgccaaatcaggcagggcagggttcccttccggcaaccggaatgccggtttattgcaatgtgaccccaccaacacctcagaataacctgcgactgatcggaccccactgtccatcctcaactgtgcctgtgatgtcggcatcctgccggaccaattgcgccagcatgtctaacgcaggctggcaagtgaagttttag

SEQ ID NO: 29928 - DNA, 1467 bp, Artificial Sequence
  Description of Artificial Sequence: Synthetic coding sequence
atgaacggcgctctcgaccatagcgaccaacctgatccggacgcaattaaaatgttcgtggggcagattcccaggtcgtggtccgagaaggagttgaaagagctgtttgaaccctacggtgcggtctatcagatcaacgtgttacgcgatcgctctcagaacccaccacagagtaagggctgttgcttcgttactttctatacgagaaaagcagccctggaagcccagaatgccctccacaatataaagaccctgcccggaatgcaccatcccattcagatgaagcccgctgattccgagaaaagtaacgctgtcgaagaccgaaaattgttcatcggcatggtgagcaagaagtgcaacgagaatgatattcgcgttatgttctcgcctttcggccagatcgaggagtgccgaattctgagaggaccggacggcttatcacgaggttgtgcttttgtcacgttcagtactcgtgctatggcgcagaacgctatcaaggctatgcaccagtcccagaccatggagggctgtagttcccctattgttgtgaagtttgccgatacgcagaaggataaggagcagcggcgactccaacagcagctagcccagcagatgcaacagttgaatactgcgacatggggcaacctgaccggactcgggggactgacccctcaatacttggctctgctgcagcaggcaaccagctcctccaatctgggggctttcagcggtatacagcagatggccggtatgaatgccctccagcttcagaacctggccaccctagctgccgctgcagctgctgcacagacttccgctacttctactaatgctaatccgctgagcaccaccagctccgctctgggggctctgacgtcaccggtcgcagcttccacccctaactctactgcaggagccgctatgaattcgctaacatctcttgggaccttacaggggctggctggggctactgtcggtctgaataatattaacgctctggcaggcaccatcaatagcatggctgctctgaacggcggactgggagccactggactgacgaacgggacagcaggcaccatggacgcacttacccaggcatactctgggattcagcagtacgcagccgcagctctgcctaccctctactcacagtccctgctgcagcaacagagcgctgccggaagccagaaggagggccctgaaggcgcaaacttgttcatttatcatctgcctcaagagttcggcgatcaggacattctacagatgtttatgcccttcggaaatgtcatcagcgccaaagtatttattgataagcaaactaatctttccaaatgtttcggattcgtttcctatgacaacccagtcagtgcacaagccgctattcaggccatgaatggcttccagattgggatgaaacgcctgaaggtccagctaaaaagatccaaaaacgatagcaagccatactag

SEQ ID NO: 29929 - DNA, 474 bp, Artificial Sequence
  Description of Artificial Sequence: Synthetic coding sequence
atggctacctccgctccgctgaggtccctagaggaggaagtcacatgcagcatttgtttggattatctgcgtgacccagtaaccatagactgtgggcatgtcttctgtcgctcctgtaccaccgacgtgcgaccaatttccggatcaaggcctgtgtgccccctgtgcaaaaaaccatttaaaaaggagaatatcaggccagtttggcagctggcttcccttgtggaaaacatagaacgattgaaggtcgacaagggacgacaaccaggagaagtcacgcgggagcagcaggacgctaagctctgcgaacggcacagagagaagctgcattattattgtgaggacgacgggaaactgctgtgcgtcatgtgtcgcgagtcaagggagcaccgccctcacacagccgtactaatggagaaggcggcacaaccacatcgggagaagatccttaaccacctgagcacattacggtag

SEQ ID NO: 29930 - DNA, 303 bp, Artificial Sequence
  Description of Artificial Sequence: Synthetic coding sequence
atggcctctgaagacattgccaagctagcagagacactcgcaaaaacccaggtggccggaggccaattgtcctttaaaggaaaaagtctaaagttaaacactgctgaagacgccaaggacgtaatcaaagagattgaggatttcgactctcttgaggcgctaagactcgaaggcaataccgttggggtggaggcggctcgggtgatagctaaagcccttgagaagaagagcgagctcaagagatgtcactggtcagacatgttcactgggagattgcgtactgagattcccccagccctgtag

SEQ ID NO: 29931 - DNA, 459 bp, Artificial Sequence
  Description of Artificial Sequence: Synthetic coding sequence
atgtcggtgacctatgatgacagcgtgggtgtagaggtcagcagtgattctttttgggaggtcgggaactataaacgcaccgtaaaaagaatcgatgacggccaccggctctgctctgatctgatgaattgcttacacgaaagggccaggattgagaaagcttacgctcagcaattgacagagtgggcgagacgatggcggcagcttgtagagaaggggcctcagtatgggactgtggaaaaggcttggatggccttcatgagcgaggccgagcgcgtctccgagctgcacctcgaggtcaaagcctctctgatgaacgatgactttgagaagattaagaattggcagaaagaagcttttcataaacagatgatgggaggtttcaaggagacaaaggaagccgaggatggtttcaggaaggcccagaaaccgtgggccaaaaaactcaaagaggtgtag

SEQ ID NO: 29932 - DNA, 543 bp, Artificial Sequence
  Description of Artificial Sequence: Synthetic coding sequence
atgtttgctagcgatctattgagagctctggattgctgtcctggtgccggtagtagtggcctcttgcctcaactgggacccagacaactgttggcctttactgtgaactgtcttggcaatcatagatatctgggctttttcgaggatctagaacagcgtcacaaggcacaagtgctggtggaagatattagtgacatcttggaagagcatgccgaaaagcacttccatccatacattgcgtactgcagcaacgaagtgtaccaacagcgtactctgcagaagttaatctcatctaatgcagcctttcgggaggctctcagagaaattgaaagacgtccggcatgtggcggtttgcccatgctgtccttcttgatcctccctatgcaacgtgtaacacgcctccccctcctgatggataccctctgcctgaaaactcagggacatagcgagcgatacaaagcagcaagcagagcccttaaggccatttcgaagttggtgagacaatgtaatgagggagcccatcgcatggagaggatggagtag

SEQ ID NO: 29933 - DNA, 2487 bp, Artificial Sequence
  Description of Artificial Sequence: Synthetic coding sequence
atggacagcgaagcctttcagagtgcaagggacttcttggatatgaactttcaaagcctggctatgaagcacatggatctcaagcagatggagctcgacaccgctgccgcaaaagtagacgagcttaccaagcaactggaaagcctgtggagcgattcacccgcacctccgggtccacaggcgggaccaccaagcagaccccctcgatactcctcttcatccatccccgaaccatttgggagcaggggctcccccaggaaagcggctactgacggtgctgatactcccttcggccgatccgagtcagcccctacactgcacccatattcaccactctctcctaagggaagaccttcgtcacctaggactcctttgtacctgcagccagatgcctacgggagtctggatagggccacttctcctcggcctagagcgttcgatggcgctggatcatccctgggtcgagctccgagcccacgcccaggaccgggtcccctgcggcagcagggaccgccaacccctttcgactttctggggcgtgctggatccccgagagggtccccactggccgagggtcctcaggccttttttcccgagcgtggaccttctcctaggcccccagccaccgcgtacgacgctccggcatctgcttttggctcttctctattaggaagtggtggctcagccttcgctcctccactgagggcccaggacgacctcaccctccggaggcgacccccaaaagcctggaacgaaagcgatctggacgtggcctatgaaaagaagccatctcaaacagccagttacgagcgcctggacgtttttgcccgtccagccagcccctcactccaactcctgccgtggcgggaatccagcctagacgggctgggcggaacaggaaaggataacctgacctccgctacactacccaggaactataaggtgtccccattggcatccgatagaagatccgacgcaggtagttataggcggagcctcggctccgccggaccgagtggcacactgccgagatcatggcagcccgtaagtcggattccaatgccaccctcatcccctcagcccaggggggctccccgacagaggcccattcctctgagtatgatctttaaactgcagaacgcattttgggagcatggcgcatcaagagccatgctgccgggaagtcctctgtttactagggcaccgcctcctaaactccagccgcaaccccagccccagccgcaaccccagtcgcagccccagcctcaattacccccacagccacagactcagccgcaaaccccaactcccgcaccacagcaccctcagcaaacgtggcccccagttaacgagggcccaccaaagccgcctactgaattggagcctgagcctgagattgaaggattactcacgcccgttttggaggccggagatgtcgatgagggccctgtggccaggccactgtcccccacccggcttcagccagctctgccccctgaggcccagtctgtcccagagctggaggaagttgcccgagtgctggccgaaatccctaggccccttaagcgacggggaagcatggaacaggcgccagccgtggccctccctccgactcacaaaaaacaataccagcaaatcattagccgactatttcatcgccatggcggacctgggccaggcggtcccgaacctgagctttcccctattactgaaggtagcgaggctcgagctgggcctccagctccagcccctcctgctcctattcctccacccgctccgtcacaatcatctccacccgagcagccacagtcaatggagatgcgctctgttcttcggaaagccggtagtcccagaaaagcaaggagagcccgtctgaatcccttggtgctgctgttggatgccgctctgactggggagctggaggtcgttcagcaggccgtgaaagagatgaacgaccctagtcaaccaaatgaagagggcattaccgcgctccacaatgccatttgtggcgctaactatagtatcgtggattttctcatcaccgccggtgctaacgtcaattccccagattcacatggttggacccccctgcactgtgccgcaagttgcaatgacaccgtcatctgcatggccctagtgcagcatggtgccgcaattttcgccacgacattgagtgacggcgctaccgcgtttgaaaagtgcgatccttatagagaaggttacgccgactgtgccacctatttagccgacgtggagcagtccatgggcctgatgaatagtggcgcagtatacgctctgtgggactactctgctgaattcggggatgagctgtcattcagagagggggaaagtgtcaccgtgctccgtcgagatgggccagaggagaccgattggtggtgggccgcattacacggacaggaaggctacgtgcccaggaattattttggtttatttccgagggtgaaaccacagaggagcaaggtctag

SEQ ID NO: 29934 - DNA, 4455 bp, Artificial Sequence
  Description of Artificial Sequence: Synthetic coding sequence
atgcggatccccgaccaaaaatacgtcactttaaagctgaacgatgtgatccgcttcggatacgacagcaacatgtacgtgctggagcgagtacaacatcgagtccccgaggaggcgctcaaacacgagaagtacacttctcagttgcaggtttctgtgaagggcctcgctcccaagaggtccgaagcattgcctgaacacacgccctattgtgaggcctccaacccaagaccggagaagggggataggcggccagggaccgaggcagcgagctacaggacgccgttgtatgggcagccttcttggtggggagaggatgatggaagcaccttgcccgacgcccagagacagggcgagccttacccagagaggccaaaagggccagtccaacaagacggggaactgcatggctttcgtgcgcctgcagaacctcagggctgtagctttaggcgcgagccctcttatttcgagatcccaaccaaggaaacaccacagccaagtcagcccccagaggtgcccgctcacgagatgccaacaaaagatgctgaggctggcggtggaggcgcagctccagtggtgcagagccacgccagcttcacaatcgaattcgatgactgctcccctggaaaaatgaagatcaaagaccacatcaccaaatttagtctcagacagcgccgtcctcccggtaaagaggcgacccctggcgaaatggtgagtgcagaaactaaagtggcagattggctcgtgcaaaatgacccaagtctcctgcatcgggtgggcccaggcgacgatcggcattccactaaatcggatcttccagtgcacacccgcacactcaaaggccataaacacgaagacggcacccagagcgacagcgaggaccctctcgccaaggctgcttctgccgctggggtgccattggaggcaagtggagaacaggttcgcctgcagaggcagatcaaaagagatcctcaagaactgttacacaatcagcaagccttcgtgattgagttcttcgatgaggatacccccagaaagaaacggagccagtcctttacacatagtccgtccggtgaccctaaagcagacaaacggagaggccctactccagctgacagagacagaccatcagtacccgctcccgttcaggccggtgggagaagctcaggcccacagcgcgctggatctctgaaaagggagaaaacagaggagcgcctggggtcaccttctcctgcaagcaggacccccgctcgtccctttggaagcgtggggagacgctcccgactcgcccaggattttatggcccagtgtctgcgggagtcttcaccagcggctagaccttctccagagaaagtccccccagttctgcctgctcctttaactccacacggaacatccccagtggggccaccgacaccaccccctgcgccaacagatccacaattgacaaaggccagaaagcaggaagaagatgactccttgagtgatgccggtacatatactatcgaaacagaggcacaggacacagaggtagaggaggcccgaaaaatgatcgaccaggtgtttggagtcctggaatcaccggagctgtctcgtgcaagtagcgccacctttagacctgtaattcgaggtgaccgggacgaatctgatgatggtggcgtggctcaacgaatggccctgctccaggaattcgcttctcggccactgggcgcagcccctcaggcagagcaccaggggctccccgtcccaggatctcccggtggtcagaagtgggtgagcagatgggccagtctcgcggactcctactcagatccaggcttaaccgaagacgggctgggccgtagagggggtgagcccgagggaagcctacccgtgcggatgcggcgtcgcctgccacaactgccttcggagcgtgcggattccccagccggtcccgagtctagcaggcggtccggccctggccctccggagcttgacagtgaacagccctctcgactatttggacaggaggagctggatcccgactccctgtcggacgcctcaggttccgacgggggacgcggacctgagccaggggtcgagccacaagattcaaggcgtaggtcgccccaggagggcccaacatggtctagaggccgacggagcccccgagcccctggagagcctacgccagcttctttttttattggcgatcagaacggggatgcagtgctctctcgaaagcctctcgctgctccaggcgatggcgagggtctgggacagacagcccagccatctccacccgctcgcgacggcgtttatgtgtctgccaacggtagaatggttattcaattaaggccagggagaagccctgaaccagacggaccggcaccagcctttttgcgacaggaaagtttcaccaaggaacctgcttcaggacctccagccccagggaaacctccccacatatctagccaccctctgctgcaggacttggctgcaacaagggcggctcgaatggactttcactctcaagacacgcacttgattctgaaagaaacagaaacagctcttgccgctcttgaagctcggctactgagcaactcagttgatgcagaatgtgaaggaggttccaccccacgccctcccgaggacgccctctcaggagactctgatgtagatacggcctccaccgtatctttgcgctcaggtaaatccgggccatccccaactaccccccaaccccttcgcgctcaaaaggagatgtccccatcaccacctgctgcccaggatccaggcggaaccgctctggtctctgccagagagcagtcttcagagaggcagcatcaccccctaggccctacagacatgggccgaggagagccagtgcgcagaagcgctattcgacgcggacaccggcctcgtggcagcctcgattggccctctgaggagagggggcctgtgttggctcaccttcccagtagcgacgtcatggcctccaaccatgagactccagaggctactggcgctgggaggctgggatctcggaggaagcctgccgctcccccaccttcaccagccgctagggaagagcagtctagatcctctgcgagttcgcagaagggcccacaggctctgacaagatcgaactctctttccaccccccgacctactagggcttccagattgaggagggctcggcttggtgatgccagtgacaccgaagccgcagacggggagaggggaagcctcggaaatccagagcccgtgggtcgcccagccgcagaacaggctaagaagttgtctagacttgatatattggccatgccccgtaagcgcgctgggtctttcaccgggactagcgatcctgaggccgctcctgcacggacttcattctctggacggagcgtcgaactgtgttgcgcttctcgaaagcctaccatggcggaggcaagagctgtgtcaaggaaggcggcaaatacggctacaaccactggtcctaggcagcctttctcgagggctcgctcaggtagcgcccgatacacctccaccacacaaacacccagggcaggttcctccagcagggcacggtctcgggcacctgggccaagggacaccgatgacgacgaggaagagccggatccctatggcttcatcgtgcagactgccgagattgcagagatagcacggcttagccagacactggtcaaggacgtcgccatcctcgctcaggagatccatgatgtggccggtgacggtgacactctcggatcaagcgaacccgcacatagtgccagtctcagtaatatgcctagcacccctgcctcgacaatttcagctcgagaggaactggtccagcgaattcctgaggcttccctgaacttccaaaaggtccctcccggatccctgaatagcagagatttcgaccagaatatgaatgatagctgcgaggacgctctcgccaacaagaccaggcctagaaatcgcgaggaagtgatattcgacaacctaatgctcaatccagtgagccaactgtctcaggccatcagggagaacaccgaacacctggctgaaaaaatgaagattttgtttcaaaatacaggtcgtgcctgggaagacctcgaagccagaatcaacgctgagaatgaggtcccaatcttgaaaacaagtaataaggaaatctcttccattcttaaggaactaagaagggtgcaaaaacagttagaagtaatcaacgccatcgtagacccatctggcagcctcgatctgctgaccggcaatcgttcactggcttcatctgctcaaccgggacttggaaagggcagagtggctgcccaaagcccaccatcccctgcgtccgctgaagcattgttgccggctctgccacttaggaattttccacagagggccagttgtggtcccccatcactcccagatcctaccttcctgcccgatgcagaacgcttcttaatctag

SEQ ID NO: 29935 - DNA, 150 bp, Artificial Sequence
  Description of Artificial Sequence: Synthetic coding sequence
atgtatccaaaccccctaatttattgtacatgttgggatccatggaacctgggaccaaggaagttgatcaagaccccacaactccccaggaagaatagcactggcagctccaaattgacccccctggtgcccgcaccaaaaaaccactag

SEQ ID NO: 29936 - DNA, 948 bp, Artificial Sequence
  Description of Artificial Sequence: Synthetic coding sequence
atggcttttcctgagccaaagcctcgcccacctgaactgccccagaagagactcaagacgttggattgtggccagggagcagtccgcgcagtgcggttcaatgtcgacggtaactattgccttacctgcggatcggacaaaactctgaagctgtggaatccactgcggggtacgctactgcgcacttattcaggccacgggtacgaagtgctcgacgccgcaggatccttcgacaacagctccctctgctccggcggaggagataaggcggtggttctatgggatgtggcatccggccaagtggtgcgcaagtttcgaggccacgccggaaaagtgaacactgtccaatttaatgaggaggccaccgtaatccttagcgggagcattgactcctctatacgatgttgggactgcagatctcgtagacctgaacccgtgcaaacccttgacgaagccagagatggggtttctagtgtcaaagtttccgaccacgaaatcctcgcaggctccgtcgatggacgagtgagacgatatgacttgcgtatgggccagcttttctctgactacgtcggctcccccatcacgtgtacatgcttttcccgggatggccagtgcaccctggtgtcttctctggactcaaccctgcgtttgctcgacaaagatactggcgagctcctcggcgaatacaagggacacaaaaaccaggaatacaagcttgattgttgtctctctgagagagacacgcacgtggtttcttgcagcgaagacggcaaggtcttcttttgggacctcgtggagggtgccctggccctggccttgccagtgggtagtggggtagtgcagagtctagcataccatcctaccgagccatgcttgttgacagccatgggaggctcagtacagtgctggagagaggaggcctatgaggcggaggatggagccggttag

SEQ ID NO: 29937 - DNA, 3015 bp, Artificial Sequence
  Description of Artificial Sequence: Synthetic coding sequence
atgaaggccacaaccccccttcagacagtagatagaccaaaggactggtataaaacgatgttcaagcagatccatatggtgcataagcccggactctataatccaccctacagcgcccagtcgcatcccgcagccaaaacccagacataccggcctttgagcaagtctcactcagacaatagtcccaacgcatttaaagacgcttcctcaccggtaccaccgcctcacgtgcctcctcctgttccacccctgcgacccagagatcggagctccactgagaagcacgactgggacccgccagaccgcaaggttgacacccggaaattcaggtcagaaccacgttctatcttcgagtacgagcctggcaagtcatccattctccagcacgagagacccgcttctttataccagagctctatcgaccggtctttagaacgccctatgagctcagcttcaatggccagtgactttaggaagaggcgaaaatctgaaccagctgtcgggcctccacggggactcggcgatcagtccgctagtagaacctctcccggtagagtcgacctgccgggatcaagcacgacactaactaaatccttcacatcttcctcaccatcaagcccctcacgtgctaaaggaggagacgatagcaaaatttgccccagcctctgctcctatagcgggctaaatggtaatccgagtagcgagctcgactactgttcaacctaccggcaacacctggatgtccccagggacagcccacgtgctatttctttcaagaacggttggcaaatggcccgacagaacgccgagatttggtcatctactgaggaaacggtctctccaaaaattaaatccaggtcctgtgacgatctgcttaacgatgactgtgattccttccccgaccccaaggtcaagtccgagagcatgggatccttgctatgtgaagaggactcgaaagagtcgtgcccaatggcatggggctcaccctacgttcccgaagttaggtccaatgggaggtctcgaatccgacatcgtagcgcccgaaacgccccaggatttctcaagatgtacaaaaagatgcatagaatcaatcggaaagatctcatgaactcggaggttatctgcagcgtgaaatccaggatactccaatacgagtccgagcagcaacacaaagatctgttaagagcatggtctcaatgcagtacggaagaggtcccccgtgacatggtgcccacacgtatttcagagttcgagaaactgatccagaaaagtaaaagtatgcctaacctaggcgacgatatgctgagtcctgttactttggagccgcctcagaacgggctgtgtccaaaacggaggttttcaatcgagtatctgctcgaagaggagaaccagtctgggccaccagccaggggcagaagaggttgccagtccaatgccctggtgccaattcacatagaggtgacatctgatgaacagccacgcgcacatgtcgaattcagcgatagtgaccaggacggtgtagtgtctgaccactccgactacattcacctggaagggagcagcttctgcagtgagagcgacttcgaccatttctcgttcacatccagtgaatccttttacggaagcagccatcaccaccatcatcaccaccatcaccaccatcgacacctaatcagtagttgtaagggcaggtgcccggcttcatatacaaggtttacaaccatgcttaagcacgaaagggcccgacatgagaatacagaagagcctaggcggcaagagatggatcccggtctaagtaagctggccttcctagtgtcacctgtgccctttcggaggaaaaaaaacagtgcccctaaaaagcagaccgaaaaggctaaatgtaaagcttccgtctttgaggctctggattccgccttgaaggacatctgtgatcagatcaaggcagagaagaaacgtggctctctcccagataattccatattacaccgactcattagcgagctgctccctgacgtcccagaaaggaacagctctctccgggctttgaggcgctcccccctgcaccaaccgctgcaccccttaccccctgatggagccattcattgccccccttaccagaacgattgcggacgcatgcccagatccgctagtttccaagacgtggatactgccaacagctcttgccatcaccaggaccgaggcggtgcactccaggatcgagaatcacctaggagttattcgagcacattgacagacatggggaggtctgctccacgtgaaagaaggggtacccccgagaaagagaaactgcctgccaaggcagtgtacgatttcaaggctcagacgtccaaagaactgagcttcaagaaaggtgatactgtttatattttgagaaaaatcgatcagaattggtacgagggcgaacatcacggtcgggtgggcatttttcctatctcttacgtcgaaaaactcactccacctgagaaggcccaacctgccaggcctccgcctccagcgcagcccggtgaaataggggaggccatagcaaagtacaattttaatgcagacacaaacgttgaactaagtctgcgcaaaggagaccgcgtcattctgcttaaacgtgtggaccagaattggtacgaaggaaagatcccaggcacgaatagacaaggcatcttccccgtgagctatgttgaagtggtgaagaagaacacaaagggggctgaagactacccggatcctccgatcccacatagttattccagtgatcgtattcactctttaagcagtaataagcctcagcgcccagtgttcacacatgagaacatccagggcggtggggagcctttccaagcattatacaattacacaccacggaatgaggatgagttggagctgcgtgagagtgacgtgattgacgttatggagaaatgcgacgatggatggttcgttgggactagcaggagaacaaagttctttggaacgtttcctgggaattacgttaaacgcttgtag

SEQ ID NO: 29938 - DNA, 981 bp, Artificial Sequence
  Description of Artificial Sequence: Synthetic coding sequence
atggcagccgcagcggcagccgcagctgccacgaacggaaccggagggtcttctgggatggaggtggacgccgcagttccctccgtgatggcatgcggtgtgaccggtagtgtgagtgttgcacttcacccccttgtgatactcaacatttcggaccactggattagaatgcgctctcaggaaggccgtccggttcaagtgattggtgcactgattggaaaacaggaaggcagaaacattgaagtgatgaactccttcgaactgctttctcacactgtggaagagaagatcatcatcgacaaagagtattattatactaaagaggaacagttcaaacaggtcttcaaagagctcgaatttctaggttggtacacaaccggagggccaccagaccctagcgacatccacgtgcataaacaggtctgtgagataatcgagtctcccctgttcctgaagcttaaccccatgaccaaacacaccgacctgccagtatcggttttcgagagcgtgatagacatcattaacggggaagctacaatgctgttcgccgagcttacttataccctcgctactgaggaggccgaacggattggcgttgaccacgtcgccaggatgaccgctacggggtcgggcgaaaatagcaccgttgcggaacacctgatagcccaacactccgcaatcaagatgttgcatagtcgggtgaaattgattctagagtatgtgaaggcttcagaggccggtgaggtgcccttcaatcatgagatcctgagagaggcctatgctctgtgccactgcttaccggtactgagtacagacaaatttaagaccgacttttacgatcagtgcaacgacgtcgggcttatggcgtacctgggcaccatcacaaaaacatgtaacacaatgaaccagttcgtcaataagtttaacgtgctgtacgatagacaggggattggccgtcggatgaggggactattcttctag

SEQ ID NO: 29939 - DNA, 780 bp, Artificial Sequence
  Description of Artificial Sequence: Synthetic coding sequence
taattcactgcccaggccccttcggggaggggcgctgcggtgggatccggaacacggctcgcttcccttcggttgcttactgagttagagagccccgcatggtggccgtttagctccaagctctggaaaactccaccggagaccaaacctcgagaggatgtcagtatgacctcttgcgaaccttttggcaaggaggggatcttaattaaaataccagccgtgatttcccatcggactgagtcacacgtgaaaccgggtcgactgacagtgctggtgtctggattggagattcacgactcgtcctctctgctcatgcaccgcttcgagcgcgaggatgtggatgatataaaagtccattcaccctatgagatcagcatcagacaacggtttattggcaagccggacatggcttatcgcttaatctcagctaaaatgccagaagtgatacccattctcgaagtccagtttagcaagaagatggaactgctcgaagacgcactggtgctgcggagcgccagaacaagtagcccggctgagaaatcttgctcagtgtggcacgcggctagcggactgatgggaaggacattgcatcgggaaccacctgcaggcgatcaggaaggcactgctctccacctgcagacctctctgccggctttaagcgaggcagatacgcaggaacttacccagggttttcgccctatgtcactgtctacgcagactgtgcttgtgatgttatgttcagagtccgcaggagcactgtggcggcagagactctcatag

SEQ ID NO: 29940 - DNA, 1038 bp, Artificial Sequence
  Description of Artificial Sequence: Synthetic coding sequence
atggctgccgcagaacctgcatcttccggacagcaagccccagcagggcagggccaagggcaacgaccgcctccacagccgcctcaggcacaggcccctcagcctccaccacctccccagcttggtggcgcaggcggaggcagtagccggcacgagaaaagcctcgggcttctcaccacaaaattcgtcagcttactccaagaagccaaggatggcgtactggacctgaaagcggctgccgacacattagctgtgagacagaagagaagaatctacgatatcacaaacgtcctggaggggatcgacctgatcgaaaaaaaatccaagaatagtatccagtggaagggcgtaggagcaggttgtaacactaaagaagtgattgatcgtctgcgctaccttaaagccgaaattgaggatctcgagctcaaggagcgggaactcgatcaacagaagctctggcttcagcaaagtattaagaatgtcatggatgactccataaacaaccggttttcttatgtgacccacgaagatatttgtaactgctttaatggagacacgctactggctatccaggcgcctagcggcacccagctggaggtcccaatacctgagatgggtcaaaacggacagaaaaagtaccagatcaacttgaaatcacacagtggtccgattcacgtgctcttgataaacaaggagagctcgagctctaaacctgtagtcttcccagtaccacctcccgacgatttaactcaaccctcttcgcaaagcctaacccctgtcaccccacagaaatcaagtatggcaactcagaacttacctgagcagcacgtctcggaaaggagtcaagctttgcaacagacatctgccactgacatcagttccgggagcatctcaggggatatcattgacgagctgatgtcctctgatgtatttccactgcttcgattgtcccctacccctgctgatgattataattttaatctcgatgacaacgagggagtctgcgacctgttcgatgtccagatcctcaattactag

SEQ ID NO: 29941 - DNA, 96 bp, Artificial Sequence
  Description of Artificial Sequence: Synthetic coding sequence
atgactgtgccgtggagaccaggcaagaggcgtattacctacaaggaggaagaagacttgaccctacagccacgcagctgtcttcagtgttcctag

SEQ ID NO: 29942 - DNA, 489 bp, Artificial Sequence
  Description of Artificial Sequence: Synthetic coding sequence
atgaacaaccagaagcagcagaagcccactttatctggccagcgcttcaagacgcgcaagcgcgatgaaaaggaacgcttcgacccgacgcagttccaggattgcattatccagggattaacggagactggcaccgatcttgaggcagtcgcaaagtttctggacgcctccggagctaagctcgattatcggcgttatgctgaaactttatttgacatcctcgtggccggaggtatgctggcgccaggtggtactttggccgacgacatgatgcggacagacgtgtgtgtgtttgctgctcaagaggacttggaaacaatgcaggcatttgctcaagtctttaacaaactgataaggcgatacaaatacctggagaagggcttcgaggatgaggtgaagaagctgttgctgtttcttaagggcttctcggaatccgaaagaaataagctggctatgctgaccggcgtgctgcttgcgaacggcacctag

SEQ ID NO: 29943 - DNA, 270 bp, Artificial Sequence
  Description of Artificial Sequence: Synthetic coding sequence
atggccgctgcaactggcgacccaggtctgagcaagctccagttcgccccattcagctcagctctggatgtgggattttggcacgagctcacccagaaaaaactgaatgagtatcgactggacgaagccccaaaggacattaagggatactattacaacggtgactccgccggactccccgctcggcttactctcgaatttagcgctttcgatatgtcagccccaaccccagcgcgatgctgcccggctatcggcaccttgtacaactag

SEQ ID NO: 29944 - DNA, 2025 bp, Artificial Sequence
  Description of Artificial Sequence: Synthetic coding sequence
atgcagaccagtagtagtaggagcgtccacctttcagaatggcagaagaactacttcgcgatcacctcgggcatctgcaccggcccaaaagctgacgcttaccgggctcaaattctaagaatccagtacgcttgggctaactccgaaatctcccaggtatgtgccaccaaattgttcaaaaaatacgctgagaaatacagcgcgataatcgattccgataatgtggagtctggtctgaataattatgccgaaaacatcctgactttggcagggagccagcaaactgactcagataagtggcagagtgggttgagcatcaataacgtcttcaaaatgtctagtgtgcagaagatgatgcaggccggaaaaaagttcaaagattcgcttctggaacccgctctggcgtcagtggtgatccacaaggaggccactgtgttcgatctccctaagttttctgtatgtggttcaagccaggagagcgacagtttgccaaactccgctcacgacagagaccgcactcaagatttccccgagtcaaatcgcttgaagctccttcagaatgcccagccccctatggtcaccaatactgccagaacatgccccacgttttcggcccctgtaggagaaagtgccactgctaagtttcatgtcacacctctttttggcaacgtgaaaaaagagaatcattcctctgcaaaggaaaacatcggacttaacgtctttttgtccaaccagagctgctttcctgccgcttgtgagaacccacagaggaaatctttttacggttccggaacgattgacgccttaagcaatcctatacttaacaaagcgtgctccaagacagaagacaatggccctaaggaggatagtagtctccctacatttaagactgcgaaagaacagctttgggtggaccagcaaaaaaagtatcatcagccacaacgggctagcggctcgtcttatggtggcgtgaagaagtccctgggagcatcgagaagtcgaggaatcctgggaaagttcgtgccgcctatacccaagcaggacggcggagagcagaatggagggatgcaatgcaagccttacggcgcaggtcctacagaaccagcacaccccgttgacgaacgcctgaaaaaccttgaacccaaaatgatagaattgattatgaatgaaatcatggatcatgggcctcctgttaattgggaagacattgccggtgttgaatttgccaaggccactatcaaggaaatcgtcgtgtggcctatgctccgccctgacatcttcaccggccttaggggaccccctaaaggcattctgctctttggaccccctgggacaggaaagactttgatcggcaagtgcattgcatcacagtctggcgctacattcttttctatttcagcctcttctttaacttctaaatgggtgggagagggagagaaaatggtccgtgcattgtttgccgtggcgagatgccagcaacctgctgttattttcatcgatgagatcgactccctgcttagccagcggggagacggtgaacacgagagcagccgaaggatcaaaactgaatttcttgtgcagttggacggagccaccactagctcagaggatcgcatcctcgtagtgggagccaccaacagacctcaggagatcgacgaggctgcacgtagacgtctagtgaagcgtctttacattcctctgcctgaagcctccgccagaaagcaaatcgtaatcaatttgatgtcaaaggagcagtgctgtcttagcgaagaagagatcgaacagattgtccagcagagtgacgcattttccggagcggatatgactcagctctgccgtgaggctagcttaggacccatacgctcactacagactgccgacatcgctactatcacccccgaccaagtccgacctattgcttatattgactttgagaacgcattccgcacggttcggcctagcgtgagtcctaaagatctggaactctatgagaattggaacaaaacattcgggtgtggtaagtag

SEQ ID NO: 29945 - DNA, 1923 bp, Artificial Sequence
  Description of Artificial Sequence: Synthetic coding sequence
atggaaaaccagctcgccaaatccaccgaagagcgcacattccaataccaagactccctcccttcactgcctgtgccatcactggaggagtcactgaagaagtacttagagtccgtgacaaggacttgttatcagatccggggactggatcccgatgctaaacgagggtttttggatctgacgagggaagggatccaggtgaaaccatttgcaaaccaggaggaatacaagaaaaccgaggagattgttcagaaatttcaatctggcattggcgagaagctgcaccagaaattgctcgaacgcgcaaaagggaaaaggaattggctggaggaatggtggctgaatgtcgcctacctcgacgtccgcatcccgtcacaactaaatgtcaactttgccggtccagctgctcacttcgagcactattggccgccaaaggaggggacgcaactggaacggggatccattaccttatggcacaacttgaactactggcagctgctgaggaaggagaaagtgcccgtgcacaaagtgggtaacacacccctggacatgaatcaatttcgtatgttgttttcaacttgcaaagttccgggaatcacacgcgatagcataatgaattacttcagaaccgaatctgaaggcagaagccccaaccacattgtggtcctttgtcgaggacgcgctttcgtctttgatgttatccacgagggctgcctagtcactcccccagagcttcttcggcaattgacctacatacacaaaaaatgccattctgagcccgacggccctggcatagctgcccttacctccgaggagcgcaccaggtgggccaaagctcgggagtacctcattggcttagatccagagaaccttgctttgctggaaaaaatccaaagttctctgttggtgtactccatggaggactcatctccacacgtaacgccggaagactactccgaaatcatagcagccatcctcattggtgatcccacggttcggtggggagacaaatcttacaatctgatctcattctctaatggagtctttgggtgcaactgcgatcacgcgccatttgatgcaatgattatggtgaatatctcgtattacgttgatgaaaaaatattccagaatgaagggagatggaagggctcagaaaaagtgcgagacatcccacttcctgaagagcttatcttcattgtggacgagaaagtgctgaatgatattaaccaggcgaaagcccagtacttgcgggaagccagcgatctgcaaatagccgcatatgccttcacttcatttggaaaaaaattgaccaagaataagatgctacaccccgacacgtttattcagctggccttgcaactggcttattaccgtctccatggtcaccccggatgttgttacgagaccgccatgacaaggcatttctaccacggcaggacggagaccatgaggtcatgtacagtggaagctgtcagatggtgtcagtcaatgcaagacccctctgtcaatctgcgtgaaaggcagcaaaaaatgctccaggcctttgcaaaacacaacaaaatgatgaaggactgtagtgcgggtaaaggctttgaccgccatcttctcggtctgttactgattgctaaagaggagggcctgcctgttcccgagttattcactgacccccttttcagtaaaagcggcggtggcggaaattttgtattgtcaacctccttggtgggatacttgcgagtgcagggtgtcgtcgtgcctatggtccacaatggatacgggttcttttaccacattagggacgatcgttttgtggtggcttgtagcgcctggaaaagctgcccggaaacagacgcggaaaaattagtccaactgactttttgtgccttccacgatatgatccaactcatgaacagtactcatctgtag

SEQ ID NO: 29946 - DNA, 474 bp, Artificial Sequence
  Description of Artificial Sequence: Synthetic coding sequence
atggcaacctccgccccactgcggagcctggaggaggaggtcacatgttccatttgcttggactatctacgcgaccctgtgacaattgactgcgggcacgtcttttgcagaagttgcacgaccgacgtgcgcccaatttcgggctcgcgtcccgtctgccccctgtgtaagaaaccttttaagaaggaaaacatccgacctgtgtggcaactggcatctctggttgagaacatcgagagactcaaggttgacaaggggagacagcctggggaagtgacaagagagcaacaagacgctaagctgtgtgaaaggcatcgggagaaactgcactattactgcgaagatgatggaaagcttctgtgtgtgatgtgccgggagtcccgagaacaccggcctcacaccgcagtcctgatggaaaaggcagcacagccccaccgagaaaaaatactcaaccatctctcaacactaaggtag

SEQ ID NO: 29947 - DNA, 432 bp, Artificial Sequence
  Description of Artificial Sequence: Synthetic coding sequence
tgaactcggcactttaaggaatctataaagttcatccacgagtgccgtttgcgcggtgaaagctgtctcgtacactgcttggctggtgtttcaagaagtgtcacgctggtcatcgcctatattatgaccgtgacagatttcggatgggaggatgccctgcatacagttcgtgctggacgctcctgcgcaaatccaaacgtggggttccagcggcaattacaagaattcgagaagcacgaggtgcaccagtaccgccagtggctgaaggaagaatatggggagtcgccactgcaagatgcagaggaagcgaaaaatatcctcggaaagtataaggaacaggggcgaaccgagcctcaaccaggagctagacggtggtctagctttcctgcgttggccccactgacatacgataattacacaactgaaacctag

SEQ ID NO: 29948 - DNA, 495 bp, Artificial Sequence
  Description of Artificial Sequence: Synthetic coding sequence
atggtgaactccgtgatcttctttgatatcaccgttgacggcaagccactgggcaggatctctataaaacaatttgctgataaaatacccaagacagcagaaaactttcgagctctaagtacaggtgagaaaggtttccgttacaagggtagttgtttccatcgcattattcccggttttatgtgccaggggggtgacttcacacatcctaacgggacaggggacaagtccatttacggagagaagttcgacgacgaaaatctgattagaaagcacacggggtcaggaatactttccatggctaacgcagggccaaacacaaacgggtcacagttttttatctgcactgccaagacagaatggctggatggaaagcacgtggcgttcggtaaggtgaaagagagagtgaatatcgtcgaagctatggagcactttgggtaccggaattctaagacgtcaaagaaaattaccatcgctgactgtggccagttctag

SEQ ID NO: 29949 - DNA, 468 bp, Artificial Sequence
  Description of Artificial Sequence: Synthetic coding sequence
atgagcgaaggggaaagccagactgtgctgagtagtggcagcgaccctaaagtagaatcaagttcaagcgccccagggctcacaagtgtgtcacccccagtgacctccactacctctgccgcttcacctgaagaggaggaggagtctgaggatgagtctgagattctggaagagtctccatgcggcagatggcagaagaggcgcgaggaggtgaaccagaggaacgtgcctggaatagactcagcttacttggccatggataccgaggagggagtggaggtcgtgtggaatgaagtgcagttcagcgagaggaagaattacaagctacaagaagagaaagttcgagcagtctttgataatctgatccagctcgaacatttaaacatcgtcaaattccacaaatattgggccgacatcaaggaaaataaggcgagggtaatttttataaccgaatacatgagttcttag

SEQ ID NO: 29950 - DNA, 837 bp, Artificial Sequence
  Description of Artificial Sequence: Synthetic coding sequence
atgtggcctttcccatcaagatctctgtttccaccccctactcaggcctggctgcagaccgttagcagcgatcctgaggctcagggttggggcgcttggaacgaaactaaggagatcttgggccctgagggtggcgaagggaaagaagagaaagaagaagaggaggacgcagaggaggatcaggatggggacgcaggttttttactgtcccttctggagcaggaaaacctagcggaatgtcctctgccagaccaggaactcgaggccatcaagatgaaggtatgtgccatggaacaggcggaaggtactccaagaccacccggtgtgcagcaacaggcagaagaggaggaagggaccgctgcaggtcaactgttaagtcccgaaacagtgggctgcccactgtcagggacaccggaggagaaagtagaagccgaccatcgcagtgtgtacgtgggtaacgtagattatggcggaagcgccgaagaactcgaagctcatttctctcgatgcggggaagttcaccgcgtaacaattctgtgcgacaagttctctggacaccctaaagggtatgcttatatcgagttcgctaccaaaggcagtgttcaagcagccgtggagctagaccagtcgctctttcgtggaagagtgatcaaggtcctgccgaagaggaccaatttccctggcatctcttcgacagacagaggagggctgaggggccaccccggatctaggggggctccatttcctcactcaggcctccaggggagacctcggcttcgcccacaggggcagaatagggcacgcggaaagttctccccctggttcagcccctactag

SEQ ID NO: 29951 - DNA, 132 bp, Artificial Sequence
  Description of Artificial Sequence: Synthetic coding sequence
atgtcagagcaaggcgatctgaaccaggccatagctgaagaaggaggtaccgagcaagaaaccgccacaccagagaatgggatcgtaaagtcagaaagcctggacgaggaagagaaactggaactgcaatag

SEQ ID NO: 29952 - DNA, 390 bp, Artificial Sequence
  Description of Artificial Sequence: Synthetic coding sequence
atggcagacgaggaattagaggctttgcgcaggcaacgtctagccgagctccaggccaaacatggcgacccaggggacgccgcacagcaggaagccaaacatcgtgaggctgagatgagaaacagcattttagcccaggtattagaccagtccgcaagagctaggctctctaatcttgctctcgtgaaacctgaaaaaaccaaggccgtggaaaactacctcattcagatggccagatacggacaattgtcggaaaaggtttcactggacagtctggaggaactttactgctacctcctgtaccagaatatggccagtaagggacagctgcacctgcactggataaccgagtttcttctcaccctgcgcaggaactgttggcgggagtag

SEQ ID NO: 29953 - DNA, 2286 bp, Artificial Sequence
  Description of Artificial Sequence: Synthetic coding sequence
atgaggaagcaggaggtgaggacagggagagaggctggtcagggacacggcacaggctcacctgccgaacaggtcaaggcactgatggatctcctagccggtaaaggctcacagggatcacaggccccacaggccctggatcgcacacctgacgcccctctgggcccttgctctaacgacagtagaatccagcgccaccgaaaagcattactatctaaggtcggagggggacccgagttgggcggaccttggcaccgactcgcatctttgcttttggtcgagggtttgaccgatctgcagctgagggaacacgactttactcaagtcgaagctacaagaggcggaggccacccagctcgcacagtggccctcgatagactgttcctcccgctctctcgagtgtcagtaccgccaagggtctctatcacgatcggggtagccggaatggggaagactacgcttgtgaggcactttgtgaggctctgggcgcatggtcaggtcggaaaggacttttctttagtcttacccctcacattcagagacctgaatacacacgagaaactctgcgccgatcggctgatttgttccgttttcccacatgtaggcgaaccatccctcgctgtggccgtgcctgctagggccctcctgatcttagatggattggatgaatgtcggactcctctcgatttctcaaatactgtcgcatgtaccgatccaaaaaaggaaatccccgtcgaccatctgattacaaacatcatccgcggaaatttgtttcctgaggtctctatctggatcacttcgcgaccgtccgcaagcgggcagatacccggtgggctcgtcgaccgaatgactgagatccgcggatttaacgaggaggagatcaaagtttgtctggagcagatgttccctgaagaccaggccctcctcggatggatgctgtcccaggtgcaagcggatcgggctttgtatctgatgtgtactgtaccagctttctgtagactcaccgggatggccctcggacatctgtggcgttcccggactggaccacaggacgctgagctgtggcctccccgaactctatgtgaactgtactcttggtatttccgcatggccttgtccggcgagggacaggaaaagggcaaagcctcaccaaggattgaacaggtcgctcacgggggtagaaagatggttggaactctaggtcgacttgccttccacggtctattaaaaaagaagtacgttttttatgagcaggacatgaaggccttcggcgtcgacctggccctcctgcaaggagccccttgttcctgcttcctgcagagagaggagaccctggcatccagtgttgcttattgcttcacccacctctcactgcaggagttcgtggcagctgcatattactacggagcctcacggagagctatttttgatctcttcacggagtctggcgtgtcctggcctcgcctcggatttctgacccactttcggagcgccgctcaacgggctatgcaggcagaggacggacgccttgacgtcttcttgaggttcctcagcggcttactgtcccccagagtgaatgccctgctggccggaagcctactggctcagggagagcatcaggcatacaggacccaggttgccgagctgctgcaggggtgtcttagacctgacgccgcagtgtgcgctcgcgctatcaatgtgttgcattgtctccatgagctccagcatactgagctagccagatctgttgaggaagcaatggagagtggcgcattagctagactcaccgggcctgcccatagagcagcactcgcgtacctgttgcaggtgagtgacgcctgtgctcaagaggcaaacctctcactcagtttaagccagggggtgctccaatccctcctgccccagttgctgtattgtcgcaagctgagactcgacactaaccagttccaggaccccgtcatggagcttttgggttctgtcctttcaggcaaggactgccggattcagaagatctctctggccgaaaatcagatctccaataagggagcgaaagcgctagcaagaagcttgctggtcaacaggtcactgacctccttggacctccggggtaattccatcggcccacagggagcgaaagccctcgcagacgccttgaagattaacagaactctgacatctttacgcgtgaaatttatgtaccataaaattgactgcttccggagagtccccgaagcggacgcatgtaacccatctactctcgggggacagggccgatggattacttag

SEQ ID NO: 29954 - DNA, 474 bp, Artificial Sequence
  Description of Artificial Sequence: Synthetic coding sequence
atggcaacttccgcccctctgcgcagtctcgaagaggaggtgacttgttctatttgtctggattatctgcgggaccctgttacaatagactgtggacatgtattctgtcgttcatgcactactgacgttagaccgatctcaggttcccgccctgtgtgtcctctgtgcaagaaaccattcaagaaggagaacattcggcctgtctggcagcttgccagcctcgtcgagaatatcgagagactgaaggtggataaagggaggcagccaggggaagtaaccagagaacaacaggatgccaagctctgtgagagacaccgtgagaaacttcactattattgcgaggatgacggcaaactattgtgtgtgatgtgccgagaatcgcgcgagcaccggcctcatactgccgtgctgatggagaaagcagctcagccacaccgagaaaaaatcttgaaccacctgtctaccctgaggtag

SEQ ID NO: 29955 - DNA, 1473 bp, Artificial Sequence
  Description of Artificial Sequence: Synthetic coding sequence
atgacgattggtaggatggagaacgtcgaagtgtttaccgcagagggcaaaggcagaggtctgaaggccacaaaggagttctgggcagctgatattatcttcgccgagagagcttacagtgccgtagtgtttgactccctggtcaatttcgtctgtcatacatgtttcaagcgacaggaaaagttgcatcgttgcggtcagtgcaaattcgcccattattgcgatcgtacgtgccagaaagatgcttggcttaatcataaaaatgaatgctccgcgattaagagatacggtaaggtgcccaatgaaaatattagactcgcagctcgaattatgtggcgcgtagaaagagaaggtactgggctgactgagggttgccttgtctccgtggacgacctccaaaaccacgtagagcacttcggcgaagaggaacagaaagatctccgtgtggatgtcgacacctttttgcagtattggcccccacagagtcagcagttcagcatgcagtacatatctcatatctttggggtgatcaattgtaatggttttaccctcagcgaccagcggggactgcaagcggtgggcgttgggatcttccctaatctgggcctagtcaatcatgattgttggcccaattgtaccgtaatcttcaataatggtaaccatgaagcagtgaagagcatgttccacactcagatgcgcatagagcttcgagctctggggaaaatatcagagggggaagaattgactgttagttacatcgatttcctgaacgtttctgaagagagaaaacgacagctgaagaagcaatattatttcgattgtacctgcgaacattgtcaaaagaagttgaaggatgacttatttctcggtgtcaaggacaatcccaaaccctcgcaggaagtggtgaaagaaatgattcaattttctaaggacaccctcgagaaaattgacaaagcaaggagcgaaggcttataccacgaggtcgttaaattgtgcagggagtgcctggaaaagcaggagcctgtatttgcagatactaatatctatatgctgcggatgttaagcatcgtgagtgaggttcttagctatcttcaggcctttgaagaggcttctttctacgctagacgtatggtagacgggtacatgaaactttaccatcccaacaatgcacagttaggcatggcggtcatgagggctgggctgactaattggcacgctggcaacatagaggtgggtcacggaatgatctgtaaggcctatgccattctacttgtgacccacggcccaagtcatccgataacaaaagaccttgaggctatgcgggtgcagacagagatggagttgcgcatgtttagacagaacgagttcatgtactacaagatgagagaggcagcattaaataaccagccaatgcaggttatggctgaaccaagtaacgaaccatctcccgctctattccacaaaaaacaatag

SEQ ID NO: 29956 - DNA, 1491 bp, Artificial Sequence
  Description of Artificial Sequence: Synthetic coding sequence
atgtggggcagattcctcgcgcctgaggcctccgggcgagatagcccgggtggcgcacggtcctttcctgcaggtcctgattattccagcgcttggctcccagctaatgaatccctgtggcaggcaacaacagtcccatccaaccatcggaataaccatatcagaaggcattccattgcgtcagactcaggggacactgggatcggcacatcctgctccgactccgtggaggaccacagtactagctctggcaccttatctttcaagcctagccagagcctgatcaccttgccaacagcccacgtgatgcccagcaatagcagcgcgtccatatccaaactgcgagaatctctgaccccagacgggagtaaatggagtacgagtctgatgcaaacgctgggcaaccattcgcgaggagagcaagattctagcctggatatgaaggacttcagaccgttgaggaagtggtcaagcctctccaaactgacagccccagacaattgtggccagggtggaactgtgtgccgcgaggagtcccgcaacggactggaaaaaattggcaaagcgaaggcactgacgagccagttgcgcactatcggcccaagttgcctgcatgactccatggagatgttacgcctggaagataaggaaattaataagaaacgctcttccactctcgactgcaaatacaagttcgagtcttgctctaaggaagactttcgagcctcaagtagcacactgcgacgccagcctgtcgatatgacatacagtgctttaccggagtccaagcctatcatgacatcttctgaggcattcgagcctccaaagtacctgatgctaggtcagcaggccgtgggtggcgtgcctattcagccgtccgtgcgaactcagatgtggctcacggaacagctccggactaacccactagaagggagaaacacagaagactcgtattccctggccccatggcaacagcagcagatcgaagatttccgacagggaagtgagacaccaatgcaggttctgacaggatcctcgcgccagtcttatagtccgggataccaagacttttctaaatgggagtctatgcttaagatcaaagaaggcttactgcgacagaaggagattgtgattgaccggcaaaaacaacagattactcacctgcacgagcgaatccgtgataacgaactccgggcacagcacgcaatgctcgggcattacgttaattgcgaagattcttatgttgcttcactacagcctcagtatgagaacacttccctccaaacaccattttccgaggagagtgtctcacacagccagcagggcgagttcgagcaaaaactggcctccacagaaaaagaggtcctccagctgaatgaattcctcaagcagagactctctttattctcggaagagaagaaaaaactggaagagaaggttggcttctccaacaaggtggagctgggacagcagcattttctcagtatctag

SEQ ID NO: 29957 - DNA, 1083 bp, Artificial Sequence
  Description of Artificial Sequence: Synthetic coding sequence
atggccgagctccaacagctacaggagttcgagatccccactggccgagaggctctgcggggtaatcacagcgcgcttcttagggttgcagattattgcgaagacaattacgtccaagccacagacaagagaaaggccctggaggaaacgatggcatttacgacccaggccctggcaagcgtggcttatcaagtcggcaacctggcaggtcacactcttcgaatgttggacctgcagggagccgctcttcggcaggtcgaggcacgcatggtgaatatgcatatggagaaagtcgcgcgacgagaaatcgggactctggcgaccgtgcagcgcctgcccccagggcagaaggtaattgcaccggagaacttaccaccgctaaccccatactgccgcaggcccttaaattttggctgcttggacgatatcgggcacgggataaaggatctcagcacccagctgtcccggaccgggacactgtctcgtaagtcgatcaaggctcctgccacccccgctagcgcaacacttggtaggcccccaagaattcctgagccagtacatctccctgtggtgccagatgggcgattgtcggccgctagtagcgctttcagccttgcctctgccggtagcgctgagggtgtagggggagcacccacacccaaaggacaagcagctcctccagcaccaccgcttcccagtagtctcgacccgccacctccgccagctgctgtcgaggtgttccaacggcctccaacactggaagaactcagtcctccgcctccagacgaggagctgcctttacccctggatctgccccctcccccacccctggatggagacgaactcggtttgccaccgccacccccaggtttcggtcctgacgaaccctcctgggtgcctgcatcatacctggagaaagtcgtgactctgtatccctacacctcccagaaagacaacgaactgtctttctctgagggtactgttatctgtgtcactagacgatactcggacggttggtgtgagggtgtgtcctccgagggcaccggcttttttccaggtaactatgttgaaccatcctgttag

SEQ ID NO: 29958 - DNA, 201 bp, Artificial Sequence
  Description of Artificial Sequence: Synthetic coding sequence
atgctgcggtgcggccagatgatcttcgcacaggccctggtctgccggcacctaggtcgggattggcggtggacccagcggaaacgacaacccgatagctacttcagtgtgctgaacgccttcatcgatcgcaaagactcctactattctatccatcagattgctcagatgggagttggcgagggaaaatcgattgggtag

SEQ ID NO: 29959 - DNA, 1476 bp, Artificial Sequence
  Description of Artificial Sequence: Synthetic coding sequence
atggaacagccccctgctccgaagagcaagcttaagaaacttagtgaagactccctgaccaaacaacccgaggaagtctttgatgttcttgaaaagttgggggaagggagctatgggtctgtgtttaaagccatacacaaggagtccggccaggtcgtagccattaaacaggtccccgttgagtccgacctgcaggagatcatcaaggagatttccataatgcaacagtgcgacagtccttacgtggtaaaatactacggatcttacttcaagaacaccgacctgtggattgtcatggaatactgcggcgctggatctgtgagtgatatcattcgtctccgaaacaagacactcatcgaggatgagattgcaaccatcctgaagtcaaccttgaagggcttggagtaccttcacttcatgcgcaagatccatagagatatcaaggctgggaacatcctcttaaacacagagggacacgccaaactggcagattttggagtcgcaggtcagctgactgacacaatggctaaaagaaacacagttattggaactcctttttggatggccccagaggtgatccaggagattggatacaactgtgtagccgatatttggtctttaggcataacctctatagagatggcggagggaaagcctccgtacgcagatatccacccaatgagggccatctttatgattccaacaaacccacctcccaccttccgaaaacccgagctgtggagcgacgactttaccgacttcgtgaaaaaatgtctggtcaagaacccggaacagcgggctacagccactcagcttctccagcacccttttattaaaaacgcaaaacccgtttcgatcctccgcgacctgatcacagaggctatggagatcaaggccaaaagacacgaggagcaacagcgagagctcgaggaggaagaggaaaacagcgatgaagatgagctggacagtcataccatggtgaagacttcagtggaatcagtcggcacaatgcgcgctacttctactatgtctgagggagctcagaccatgatcgaacacaactccacgatgctcgagagcgatctagggactatggtcatcaacagcgaagatgaggaagaggaagacgggactatgaaacgcaacgccacgagcccacaagtgcagcgcccatccttcatggattatttcgacaaacaggacttcaagaataaatcacacgagaattgcaatcagaatatgcacgaacccttccccatgtctaagaatgtgtttcccgataactggaaagtgcctcaggacggcgacttcgacttcttgaagaacctctcactagaagaactgcagatgcgcctgaaggctttagatcctatgatggaacgggagattgaagaattgcggcaacggtatacagcaaaacgtcagccgatattggacgccatggacgccaagaagcgcagacaacagaacttctag

SEQ ID NO: 29960 - DNA, 126 bp, Artificial Sequence
  Description of Artificial Sequence: Synthetic coding sequence
atgtccagcaagggcagttcaacagatggcagaactgatctggccaatggtagtctgtctagttctcccgaagagatgagcggcgcagaggagggaagagaaacaagttctggaattgaggtttag

SEQ ID NO: 29961 - DNA, 945 bp, Artificial Sequence
  Description of Artificial Sequence: Synthetic coding sequence
atgcctaatgtcgcggaaaccgaaaggtctaatgattcaggtaatggagaacacaagagtgagcgaaagagcccggaggagaatctgcaaggagcagtgaaatcattctgcacctctgcctccggggcacctctgggtcccaaaggtgatggtcactatccctggtcctgccccgtcactcatactagagaaaagatttacgcaatctgttccgactatgccttcctcaatcaggccaccagtatttataagacgcctaacccgagcaggtctccttgtctgcctgatagcacttccttatccgccggtaataactcatctcgatatattgggatcccaacctctactagcgaaataatctacaacgaggagaactctctggaaaacctatccaacagcctgggcaaactgccattggcctgggagatcgacaagtcagagttcgatggcgtaacgactaactctaagcacaaatctgggaatgcgaaaaaacaggtgtccaaaaggaagacatccgacaagaagggacggtaccagaaggagtgtccacagcactcaccactggaggatataaaacaaaggaaggttctggacctgaggaggtggtactgcatcagtaggcctcaatataagacatcctgtggcatcagcagtctgatcagttgctggaatttcctatatagcaccatgggtgcaggaaatcttccaccaatcacccaggaggaggccctacacattctagggttccaaccccctttcgaggatattaggttcggccctttcaccggaaatacaacgctgatgcggtggttccgccagatcaatgatcacttccatgtgaagggatgctcatatgtgctctacaaaccacatggtaaaaacaaaacagctggcgagacagccggtgatttgtcccaccatcggaaactgaacatcgggagctag

SEQ ID NO: 29962 - DNA, 1500 bp, Artificial Sequence
  Description of Artificial Sequence: Synthetic coding sequence
atgcctgaaatcagggtgactcccctgggcgctggacaggacgtgggtcggagctgcatattggtgagcatcgccggtaaaaacgttatgctcgattgtggaatgcacatggggttcaatgatgatgtggatgacgaacttgaaatcaaagcatattatgccggtcacgtgctaggagctgcaatgtttcagatcaaggtaggctccgagagtgtggtgtacactggtgattacaatatgactccagaccggcacctcggtgccgcttggatcgataaatgcagacccaacctgctgattacagaaagcacctatgctacaaccatccgtgacagcaagaggtgtcgcgagagggattttttaaagaaagtgcacgaaactgtggagcggggtgggaaggtcctgattcctgtatttgccctggggagggcgcaagagctatgcatactcctcgagactttctgggagcgaatgaatcttaaggtgcccatttactttagtactggcttgacagaaaaagctaatcactactataaactgtttattccctggaccaatcagaagatccggaagaccttcgtccaacggaacatgttcgagtttaagcacattaaagcgttcgacagggcttttgcggataatccgggacccatggtggtttttgcaacacctggcatgctccacgctggacaaagcctccagatatttcgtaaatgggccggtaatgaaaagaatatggtgatcatgcccggttactgcgtccaggggacggtgggacacaaaatcctttccgggcaaaggaagttggagatggaaggcaggcaggtgctggaagttaaaatgcaggttgagtacatgtcgttttccgcccatgctgatgccaagggaatcatgcagctggtaggccaggcggagccagagagcgtactcctggtacacggtgaagccaaaaaaatggagtttctgaaacagaaaatcgagcaggagctgcgcgtgaactgttacatgcccgcaaacggagaaactgtcaccttgccaacaagcccaagtatccctgtggggataagcttgggacttctgaaaagggaaatggcgcaagggcttctgccagaggcaaaaaagcccaggcttctccacggtactttgataatgaaggactctaatttcagactcgtgtcttctgaacaagctttgaaagagttggggcttgccgagcatcagctgcgtttcacgtgtcgcgtgcaccttcatgacacaaggaaagaacaggaaacagcccttcgtgtgtactcccaccttaaaagtgtgctgaaagatcactgcgtgcagcacctgccagacgggtccgtcacagtggaatcagtactccttcaggccgcagccccaagcgaagacccaggcacgaaggtcttgttggtctcatggacttatcaggatgaggagctgggcagcttcctcacttccttactcaaaaaaggcctaccccaagctcccagctag

SEQ ID NO: 29963 - DNA, 396 bp, Artificial Sequence
  Description of Artificial Sequence: Synthetic coding sequence
gggacaatcagctgtagcactggcaccctccaacgccgaaatctaggacccgagcggcagaccggccttctgctgctcggcatgaaagagaaccaagagcttaagacaatccaggccaatctctccaggcagcgggtagaacatcagtgtttatcctccgaggagctcaagcagaggtttcctaatatccgtctgccaaggggcgaagtggggttgctggacaattcggggggtgtgatatatgcctataaagccctccgcgcactacaggatgctataaggcagctcgggggtattgtccgcgatggagaaaaggtagtggaaatcaatcctggcttgctggttaccgtaaaaactacgagtagatcataccaagcgaagagcctcgtcatatag

SEQ ID NO: 29964 - DNA, 687 bp, Artificial Sequence
  Description of Artificial Sequence: Synthetic coding sequence
atgagcagagagcggggatccaggtccgaggaaccaggcgctggaaatcgggaatccggatctcgcgaaccgggactcgccgcagccgcaatgtcaaccgtggacttggcaagggtgggggcttgtatcctcaaacacgctgttactggtgaggccgtcgagctgaggtccctatggcgagagcacgcttgtgtggtagccggactcaggcgatttggatgcgtggtgtgccgctggatagctcaagacctgtcaagtctggctggtctcttggatcagcacggcgtgagactggtaggggttggccctgaagcactaggtctgcaggagtttctcgacggggactacttcgcaggggagttatacctcgatgagagcaaacagctctacaaagaactgggctttaaaaggtacaattcactttcaatcctcccagcggctctcggtaagcccgttcgcgatgttgccgcaaaggccaaggccgtggggattcagggcaatctaagcggtgacttgcttcagagcgggggactcctggtggtatctaagggaggtgataaggtgctcttacactttgtgcagaagtcacctggagattacgtacccaaggagcatatcctgcaggtgctgggcatttccgccgaggtgtgtgcaagtgacccccctcagtgtgacagggaggtgtag

SEQ ID NO: 29965 - DNA, 654 bp, Artificial Sequence
  Description of Artificial Sequence: Synthetic coding sequence
atgaacttcagcgaggtatttaaactgtcctccctactgtgcaagttctccccggacggcaagtatctggccagttgcgtgcagtaccgactcgtggttagggatgtaaacacactccagatactgcagttgtacacgtgcctggaccagatccagcatattgagtggagtgcagattcactctttatcctgtgcgcaatgtacaagcgaggactggtgcaggtctggtccctggagcagcctgaatggcattgcaagatcgacgaaggatccgccggactcgttgcgtcttgttggtctccagacggcaggcacatcttgaatacgactgagttccacctgagaatcactgtgtggagcctttgtaccaagagcgtgtcatatatcaagtatccaaaagcttgcctacagggtattacctttacccgggatggtcgatacatggcacttgcagagcggcgagattgtaaagactatgtgagcatcttcgtgtgctccgattggcagctgctccgttacaaaattctgctgtactctttagatgggagactgctgtccacctactcggcgtatgagtggagccttggtataaaatccgtggcatggagtcccagtagccagtttttggcagtgggctcatacgacggaaagtag

SEQ ID NO: 29966 - DNA, 483 bp, Artificial Sequence
  Description of Artificial Sequence: Synthetic coding sequence
atggaagcagagcggcctcaggaggaggaagacggggagcaaggccctccccaggatgaggaaggttggcctccaccaaacagtacgacccgcccttggcggtcggccccacccagcccacctcccccaggcacccggcacacagcattagggccacggagtgcgtccttactgagtctccagactgagctgcttctggatctggtcgcagaagcccagtctcgacgccttgaagagcagagagcaactttctatacaccacagaacccttcatcactggctccggcaccactacgccctctagaagatcgcgagcagctctatagcacgatactgtcccatcagtgccaacggatggaagcccagaggtcagaacccccattgcctcccggaggccaggaactgctcgaactgctgctgcgggtccagggtggcggaaggatggaggaacaacgatcaagaccgcctactcacacatgttag

SEQ ID NO: 29967 - DNA, 951 bp, Artificial Sequence
  Description of Artificial Sequence: Synthetic coding sequence
atggaggaaaataatctgcaatgttccagcgtggtggacggcaactttgaagaagtgccgagagaaacagccattcagttcaaacctcccttatatcgccagcggtaccagttcgtcaagaacctggtggatcagcacgaacctaaaaaggtggctgatctggggtgtggcgacactagcctgctgagattgctaaaggtgaacccatgcatcgaactgctcgtaggggtggatatcaatgaggacaagctacgatggcgcggagactctttggccccttttctgggggactttctgaagccacgcgatctcaacttgaccataaccttgtatcatggaagcgtggtggaacgggattctcggttactgggctttgatcttattacatgcattgagctgatcgagcacttggacagtggcgacctggcaagattccccgaagtggttttcggatatctctcaccctctatgatcgtcatttctacaccgaactccgagttcaaccccctattccctagtgttacacttcgtgatagcgatcataagttcgagtggacgcgcatggaatttcagacttgggccttatacgtggccaacagatatgattactctgtggaattcaccggagtgggggagcctcctgccggtgccgaaaacgttggatattgtacccagataggtatcttcagaaaaaatggcggaaaagctacagagagctgtctgagtgaacagcacgaccagcacgtttataaggctgtgttcaccacatcatatcccagcttacaacaggagcggttcttcaaactggtgcttgtcaatgaagtctcacagcaggtggagtccctccgggtctcccatctgcctcgtcggaaggagcaggccggagagagaggggacaaacccaaggacattggcggatctaaagcccctgtgccatgtttcgggccttag

SEQ ID NO: 29968 - DNA, 1056 bp, Artificial Sequence
  Description of Artificial Sequence: Synthetic coding sequence
atgtggacaccaaggcccgcactgcatgtgcacgtcattctgtacagccccattcaccgttgttatgcaagggccgaccccactatgggacgaatttgggttgacgcagccgttccctgcctggaagagtgcggcttcttgcttcactttcgggatgggtgctatcacctggagacaagcacccaccacttcctctctcatgtagaccggctgtttagccagccatcaagccagactgccttccatatgcaggtgcggccagggggtctcgtggcactatgcgacggagaaggcggaatgctatatccacagggaacgcacctattactgggcatgggctgtaatcctatgaggggtgaggagtggtttattttacagcattgtcctacctgggtcagcttgcgcagtaagactggacgtttcatttccgtgatctatgatggcgaggtacgggctgcatcggagcgcctgaacaggatgagcctgttccagttcgaatgtgatagcgagagtccaacggtccaactcaggtctgctaacggctattatctgagtcagcggcgtcaccgtgcagtgatggccgacggccacccactcgagagcgacacttttttccgcatgcattggaactgcggacgaattatattacagtcatgtaggggaaggttcttgggcattgccccaaacagtctcctgatggccaatgtgatcttgcccggaccaaacgaagaatttggaatcctgttcgctaacagatcttttctcgtcctgcgagggaggtacgggtacgtgggctccagttctggccacgacctgatccagtgcaatcaggaccaacctgaccgaatccatcttctgccctgtcgacctgggatctaccactttcaggggggtatcctcctggtaaataatatcctatggcacctttctcccctgggccaggtctgcccccagttactgtaccgggcttcaggcgagcagctgactcactgtacaggccctcagtggctgttgcacgcttctcggccaaagtggcatccagttggccgtcaatag

SEQ ID NO: 29969 - DNA, 333 bp, Artificial Sequence
  Description of Artificial Sequence: Synthetic coding sequence
atgcaaatttcaagcgagaaggaagaggatgacaatgagaaacgtcaggacccgggtgataattgggaggaggggggaggcggtggcggtggcatggagaagtcctctggcccatggaacaagaccgctcctgtccaagccccacctgccccagtcattgtcactgagactcctgagcccgcaatgacttccggggtatacagaccccctggcgctaggctgactaccacacggaaaactccacagggccctcccgagatttactctgatactcaatttccctcattgcagtccacggccaagcacgtggaaagccggaagtacctcaagtag

SEQ ID NO: 29970 - DNA, 972 bp, Artificial Sequence
  Description of Artificial Sequence: Synthetic coding sequence
atggaaggccacgatcctaaggagcccgagcaactgcgaaaactcttcatcggagggctgagctttgagaccactgatgattctttaagagaacacttcgagaagtggggaaccttgacggactgtgttgtcatgagagaccctcagactaaaagaagcagaggcttcggattcgttacatactcatgtgtggaagaggtggacgctgccatgtgcgccagaccacacaaggtcgatggcagggtcgtggaacccaagcgcgcagtgagtcgggaggattcagtcaaacccggtgctcaccttactgttaagaaaatctttgtcggcggtatcaaggaggacaccgaagaatacaacctgagggattacttcgagaagtatggaaagattgaaaccatcgaggtgatggaggatagacaaagtggcaaaaagagggggttcgccttcgtcaccttcgacgaccacgacactgtggataagattgtcgtgcagaagtaccacacaattaacggacacaattgcgaggtcaagaaagctctgtccaagcaggagatgcagtccgctggcagccaaagaggcaggggaggtggtagtggcaattttatgggacgtggcggtaactttggtgggggaggaggtaatttcggtcgtggtggcggaaattatggtggaggacccggatactcctctagagggggatacggaggaggagggcctggttacggaaatcagggtggtggatacggtgggggagggggatacgatggttataatgaaggcggtaacttcggcggagggaattacgggggaggcggtaattataacgactttgggaattattccggccagcaacagtcaaactacggccctatgaaggggggatcatttggagggaggtcatccggttctccttacgggggtggctatggcagtgggggtggaagtgggggttatgggtctagaagattctag

SEQ ID NO: 29971 - DNA, 291 bp, Artificial Sequence
  Description of Artificial Sequence: Synthetic coding sequence
aacattcaattggtcgctgatggctgttgtaacctgcagaagcagatccaaattacacagctcttcggggtgcctgtcgttgttgctttaaacgtctttaaaacagacactcgggcagagattgacctggtctgcgagctggcaaaacgtgcaggggctttcgacgcggtcccgtgctaccactggtcagtgggaggcaaaggtagcgtcgatctcgcacgagcagtgcgggaggccgcaagcaaacgctcgcgctttcaatttctctatgacgttcagcctttcagctag

SEQ ID NO: 29972 - DNA, 483 bp, Artificial Sequence
  Description of Artificial Sequence: Synthetic coding sequence
atgaccgacgtaccagccacatttactcaggcagagtgcaacggagacaagcccccagaaaacggtcagcaaactataaccaagattagcgaggagcttactgacgtcgactcccccctgcctcattaccgtgtggaaccatcactggaaggcgcattaaccaaggggtcccaagaagaacgcagaaaactccagggtaacatgttacttaatagtagcatggaggataaaatgctgaaggagaaccccgaggagaagcttttcatcgtgcacaaggcaatcaccgatctgagcttgcaggagacatctgctgatgagatgactttccgcgaggggcaccagtgggaaaaaatccctctctctgggagcaaccaagaaatcaggagacagaaggagcgtattaccgagcagccactgaaggaggaggaggacgaagacagaaagaataaaggccaccaggctgccgagatagagtggctctag

SEQ ID NO: 29973 - DNA, 480 bp, Artificial Sequence
  Description of Artificial Sequence: Synthetic coding sequence
atggctaccagcgcgccactgaggtcactcgaagaagaagtcacttgctcaatctgcctggattatctgcgagaccccgtaacgatcgactgtggtcatgtgttttgtagaagctgcactactgatgtgcgcccaatatcgggcagcaggcctgtgtgtccattgtgcaagaagccttttaagaaagaaaatatcaggccagtttggcagctcgaaaaaatcctcaaccacctgtctactttgcggagggatagggacaagatccagggattccaggcaaaaggagaagcggatattctcgcggctttaaagaagttgcaggaccagagacagtacattgtggctgagtttgagcagggccaccaattcctgcgtgagcgggaagagcaccttctggaacaactggccaagctggagcaggagctgactgaaggcagggaaaaatttaagtcaagaggcgtgggggagctcgctagatag

SEQ ID NO: 29974 - DNA, 432 bp, Artificial Sequence
  Description of Artificial Sequence: Synthetic coding sequence
atggactcaagccagcagaaaacctttcgcggacatgatgcccctgtgctgtccttgtcctttgatccaaaagatatcttccttgcatcagccagctgcgacggcagcgtgagagtttggcaaattagcgaccaaacttgtgctattagctggcctctcctgcagaaatgcaacgacgtgatcaacgcaaaaagtatctgccggctggcgtggcagccaaagtcaggaaaactgctggcaatcccagtcgagaaatccgtcaagttgtaccggagagagtcatggtcccaccagttcgatctgtctgataacttcatcagccaaactttaaatatcgttacatggtccccctgcggccagtatctcgctgctggttctataaatggcctgattattgtatggaacgttgagacaaaagattgtatggaatag

SEQ ID NO: 29975 - DNA, 2109 bp, Artificial Sequence
  Description of Artificial Sequence: Synthetic coding sequence
atgactgagagatgcagcctgtggtctgcactgtctgccgcagcctgttgcttctaccgcggttctttcgtgcaggtgcagtttagtaaggagaagtatattctcgactctagcccggagaaactccacaaggagctggaagaggaactgaagctcagcagcacagacctccggtcccatgcctggtatcatggccgtattcccagagaagtgtccgaaaccttagtgcagaggaacggcgacttcctgatcagagactccttgacatccctcggtgattacgttctcacatgtaggtggcggaatcaggctctgcattttaagatcaacaaagttgtggtaaaggccggagaatcctacactcatatacagtacctcttcgaacaagaatcctttgaccacgtcccggctctcgtcagatatcatgtgggcagtagaaaagctgtgtctgagcagtcaggggctataatctactgcccagtgaacagaacttttcccctgagatacctggaggcctcttatggattgggacaagggtcatcaaagcccgcttcccctgtaagtccaagtggacctaaaggctctcacatgaaaaggcgctccgtgacaatgaccgatgggctgaccgctgacaaggttacgcgcagcgatggatgtccaacaagtactagcttacccaggccgagagattccatccgatcatgcgccctgagcatggatcagattccagacttgcactcccccatgtcgcctatctccgagtccccctcatcgcccgcatatagcacagttacccgcgttcatgctgcacctgccgctcccagcgccacagctctgcccgcaagtcccgtcgcacgtagaagcagcgagcctcaactgtgccctggaagcgctccaaagacccatggagaatctgacaagggaccacacacttccccctcccacaccctgggcaaagcctcccccagccctagcctgtcatcgtatagtgatcctgatagcggacactactgccaacttcagcctcctgtccggggatcgcgcgagtgggcagccactgaaacaagcagtcagcaggcgagatcatacggagaacgactgaaggaactatctgaaaatggcgcaccggagggagattggggtaaaacttttaccgtacctatcgttgaagttaccagttcatttaaccccgctacattccagtctctgctgattccacgcgacaatcgaccgctcgaggtgggtttgctacgcaaagtgaaagaactcctggcagaggtggacgcaagaacactggcacgccatgtcactaaagtggactgtctggtggcacggattttgggagttaccaaagagatgcagactctaatgggagtacgctggggaatggagttgctgacactgcctcatgggaggcagctgaggcttgacctgctggagcgttttcatacaatgagcatcatgttagctgtggacattctgggatgtacgggctcagctgaagaacgagccgcactgctgcataagaccatacaactagccgctgagcttcggggaaccatggggaatatgttttcatttgctgccgtaatgggagcccttgatatggctcagatttcccgactggagcagacatgggtcacactgcggcagagacatacagagggcgctattctgtatgagaagaagcttaaaccgttccttaagtctcttaatgagggtaaggaaggccctcccctgtccaatacaactttcccgcacgtcctgccccttatcaccctgcttgagtgtgacagtgcgcctccggagggtcccgagccatggggatcgacggagcacggggtcgaagtggtgctcgctcatttagaggctgctaggacggttgctcaccatggaggactctaccatactaacgcagaagtgaaactgcagggatttcaggcccgacctgagttgttggaggtcttctcaactgaatttcagatgcggttgctttggggtagccagggagcttcgagctcccaggcacggcgttacgagaaattcgacaaggtgttaaccgccctttctcacaagcttgaacctgctgtccgctccagtgagctgtag

SEQ ID NO: 29976 - DNA, 585 bp, Artificial Sequence
  Description of Artificial Sequence: Synthetic coding sequence
atgaccgaagacagccagaggaattttcgcagcgtctactacgaaaaggtgggttttcgcggagtggaggagaagaaatcactggagattttgctcaaagacgacagactgggcattctgccaccacatcacgagtcacacgccaaagtgatgatgtataggaaggagcaatatctcgatgtgctgcatgccctgaaggtggtcagatttgtttctgatgccactccccaagccgaagtctatttgcggatgtaccagttggagtcaggtaagctacccaggagcccttcatttcctctagaacctgacgatgaagtgtttctggcaatcgccaaggcgatggaggaaatggtggaagacagcgtggactgctattggataacgaggaggtttgtcaaccaattgaacactaagtacagagactccttaccacaactaccgaaggcttttgaacagtacctgaacttagaggacggtcgactcctcacccacctgcgcatgtgttcagccgctccaaagctgccttacgatctgtggttcaaaagatgctttgctgggtgcctccctgagtcgagtcttcaatag

SEQ ID NO: 29977 - DNA, 2334 bp, Artificial Sequence
  Description of Artificial Sequence: Synthetic coding sequence
atggaacccaaggaggccacagggaaagagaatatggtcaccaaaaagaagaatctggcattcctgaggagcaggctctacatgcttgaaagacggaagaccgatactgtggttgaaagctccgtgagtggggatcactctggcacgcttcgccgatctcaatcagatagaaccgaatataaccaaaaattgcaggagaaaatgaccccccagggggagtgtagcgtggctgaaacactgacacccgaggaggagcaccacatgaaacggatgatggccaagcgcgagaaaataattaaagagttgatccagactgaaaaggactacctgaatgatttagagctgtgcgtgagagaggtggtgcaaccgctgcgaaacaaaaaaaccgataggctggatgtcgatagcctcttctccaacatagaatccgttcaccagatttctgcgaagttgctgtctttactggaggaggctacaaccgacgttgaacctgctatgcaggtgataggtgaagtattcctacagattaagggcccactggaagatatctataagatttactgctaccatcacgacgaggcacatagtattctggagtcttacgaaaaagaggaggaactgaaggagcacctttcccactgtattcagagcctcaagaagatttacatgcaggaaggaaaaccgaatctcttggacatgggcagtctgatgattaagcctatccagagagtgatgaaatatccgctcctcttgtgtgaactgagaaactccacacccccttcccaccccgactaccgggctctggacgacgcattcgccgctgtgaaagatattaacgttaacatcaatgagctcaagcggagaaaggatttggttttgaagtataagaagaatgatgaggatgaaagtcttaaggataagctcagtaagttaaatatacactccatctctaagaaatccaagcgcgtgaccaaccatctcaaaattcttacacgtggtgaatcccaagttaaggataacacatttaaccgtgaagaaaagttgttcagagcactcgagaagacagtccggctgtgtgttaagaatatctctctatgtcttcaacacatacaagacgctatgccactggccctgcagagcgtgatggaccttcaggaaatctcttataataaggacgatgaaatggactatagcgagactctgtccaatgctctaaatagctgtcatgacttcgcgagccatcttcaacgactcattctaacccctttgtcagccttgctgagcctcttccccggtccccacaagctgatacaaaaaagatacgacaaactgctggattgcaactcttacctgcagcgctctaccggggaggagagtgatctggctaaaaaggagtacgaggcactcaacgcccaactggttgaggagctgcaggcattcaaccaagctgcccgaaaaatcctgctgaattgcctttgttcattcatcaccttgttacgagatctgatgttggtcgcccaacaggcctacagcaccttggtgcccatgcctctgctggttagctctattagtgagatccagaatcaagtgctcgaggaaatccagaacctgaattgtgtcaaggagaactcagctacattcatagagagaaaattgtcctttgagaaaaaaaaacccgtgcagatactccctgagatgcctcatcaaacagatatacatcggtccaagctgctcagcacttactcagcagaggaactgtaccaggcgaagcggaagtgtaacgctactcaggaatatgatatcaacttgctagaaggcgatttggtggccgttatagaacagaaagatcctctcggaagcacgtcccggtggcttgtggacactggcaacgtcaaaggatatgtgtactcttcttttctgaagccctataatcccgcaaagatgcagaaagtggatgctgagaacagattctgcgacgatgatttcgaaaatattagcctttttgtatcctctagaccagcctcggacagtgtgaccgggacctctgagtcttccataggcgactcttcctcaagcctgagtgggacttgtggtaagtttgagactaacggcactgacgttgattcctttcaggaagtcgacgagcagattttttacgccgtgcatgcctttcaggctcgcagcgatcacgaactgagcctgcaggagtaccagcgtgttcacatcctaaggttttgtgatctcagcggaaataaagaatggtggctggctgaggcccaaggacagaagggttacgtccccgcaaactacctcggaaagatgacgtatgcatag

SEQ ID NO: 29978 - DNA, 543 bp, Artificial Sequence
  Description of Artificial Sequence: Synthetic coding sequence
tagtcccagccaaagagttttgagaattctcccggagacctgggcaatagctctcttcccaccgcgggatataagcgagcccagacaagtggaattgaggaagagacggtaaaagagaaaaaacgcaaaggaaataagcagtcgaaacatgggcctggcagacctaagggtaacaagaatcaagaaaatgtgtcacatctaagcgtgtctagcgccagcccaacaagctccgtggctagcgcagctgggtctataacctctagcagccttcagaaatcgcccactctattgagaaacggaagtcttcagtctctgagcgtgggttcctcgccggtaggaagcgaaatttctatgcaatacagacatgacggagcctgtcctactacaagcatctataatagcaacgatgttgcggtcagcttccctaacgtggtctccggctcgggcagttccactcctgtctccagttcacatctgccgcagcaaagctctggacacctgcagcaggtaggcgctttatcgccctccgcagtgagctcgtag

SEQ ID NO: 29979 - DNA, 384 bp, Artificial Sequence
  Description of Artificial Sequence: Synthetic coding sequence
atgacaacgaaaaacctcgaaacaaaggttacagtcacatcttctcccatacggggtgccggagacggcatggaaacagaagagccccctaagtcggtagaagtcacctccggagtccagagccgcaagcaccactctctgcagtctccgtggaaaaaagctgtgccaagcgagtctcccggagtgctccagctggggaaaatgctgacagagaaagccatggaggtgaaggctgtacggattctggtgccaaaagccgcaatcacccacgacatccccaacaaaaataccaaagtgaagtctctcggccaccataagggtgaatttctgggtcagagcgaaggggtgatcgagcctaacaaggaactctccgaagtgaaatag

SEQ ID NO: 29980 - DNA, 1683 bp, Artificial Sequence
  Description of Artificial Sequence: Synthetic coding sequence
atgagtgagcactctcgtaactccgaccaggaagagttacttgacgaagaaataaatgaggacgaaatcctagctaacttgtctgccgaagagctgaaggaactgcaaagcgagatggaagttatggccccagatccaagcctgccagtgggcatgattcagaaggatcagaccgataagccccctaccggcaattttaatcataaatcacttgttgactatatgtattgggaaaaggccagcaggagaatgctggaagaggagagagtgccagtgaccttcgtcaaaagcgaggagaaaacccaggaggagcacgaggaaatcgaaaaaaggaataaaaatatggcgcagtacctgaaggagaaactcaataatgaaattgttgccaataagcgtgagtccaagggttcttccaatattcaggagacagacgaggaagatgaggaggaagaagacgacgatgacgacgatgaaggagaggacgacggggaggagtctgaggaaactaatcgggaggaagaaggtaaggccaaagagcaaattcggaactgcgagaacaactgtcagcaggtaacggacaaagcctttaaagaacagcgcgataggccggaggcccaagaacagagcgagaagaagatctccaaattggaccccaagaaactcgccctggatacctcttttcttaaagtttcaactcgcccaagcggcaaccagacagatctcgacgggtctcttaggagagtgcgcaagaacgatcctgacatgaaagagctcaacctaaataacatcgaaaatattcccaaagaaatgctgcttgactttgtgaacgcaatgaagaaaaacaaacatatcaagacattcagcttggccaacgtcggtgcggacgagaacgtggccttcgcgttggctaatatgctgcgtgagaacagatccatcaccactttgaatattgagagcaactttatcacaggaaagggtattgtggcaattatgcgctgtttacagtttaatgaaaccctcacggagctccggttccacaaccaaagacacatgctggggcatcacgctgagatggaaatagccaggttgctcaaggccaataatacgctgctaaaaatggggtaccactttgagcttccaggccctcggatggtggtcacgaacttgttgacccgcaaccaggacaagcagcggcagaaacggcaggaagagcaaaagcagcagcaactgaaggagcagaagaaactgatcgctatgttagaaaatggcctgggcctgccgcctgggatgtgggagctcctgggcggacctaagcccgacagccgcatgcaggaatttttccagccccctcctccgcgaccgcctaatccccaaaatgtgcctttttctcagcggtccgaaatgatgaagaagccttcccaagctccgaagtacaggacggaccctgacagcttcagagttgtcaaactcaagaggatccaaaggaagtccaggatgcccgaggcccgagaaccaccggaaaagaccaacctgaaggacgtgataaagacactgaagcccgttcccaggaaccgccctcccccactggttgagattaccccgcgagaccaactgcttaatgatatccgccattcttccgtcgcctacttgaaacctgttcaattaccaaaagagcttgcctag

SEQ ID NO: 29981 - DNA, 51 bp, Artificial Sequence
  Description of Artificial Sequence: Synthetic coding sequence
atgtgtaccagtgagacctttcaggccctagatacctttgaggctcgatag

SEQ ID NO: 29982 - DNA, 513 bp, Artificial Sequence
  Description of Artificial Sequence: Synthetic coding sequence
atgccgatcctcctgttcctgattgacacctctgcatcgatgaaccaacggtcacacctcggtacaacatacttggacacggccaagggggcagtagaaacttttatgaaattgagagcacgggaccccgcttctaggggagacagatacatgctggttaccttcgaagaacccccttacgctatcaaggccggttggaaagagaatcatgcaacatttatgaacgaactaaaaaatctccaggccgaagggctcacgaccctgggtcaaagtctgagaactgcgttcgaccttttaaatctgaatcgtctagtaacgggaatcgacaattacgggcagggcaggaatcctttctttcttgaaccggctatcatcatcaccatcactgatgggagtaagttgaccactaccagcggcgtgcaggacgaggcagtgcatatcctatgtgtattgcaagaatgcctcatctcagtgtggagcccttggtgccggaagtataaagtgggctggtag

SEQ ID NO: 29983 - DNA, 204 bp, Artificial Sequence
  Description of Artificial Sequence: Synthetic coding sequence
atgtccaggcggaggtttgattgcagaagtatttccgggttgctgacaaccacaccccagattcctatcaagatggaaaacttcaataacttttacatcttgacctctaaagaactcgggaggggcaaatttgctgtggtccgccagtgtatttccaagagcaccggacaggagtacgccgcaaagtttctcaagaagcgctag

SEQ ID NO: 29984 - DNA, 1107 bp, Artificial Sequence
  Description of Artificial Sequence: Synthetic coding sequence
atgttgtccaaacgagggtgtcacgccaggatctacgctgacttccccattaggcgactcatcagccagcgaagcagcctggagaccttggaagatatcgaggagaatgctcccctgagaagatgcaggacactttctggcagccctcggcctaaaaattttaaaaaaattcattttataaagaatatgcgtcagcatgataccagaaatggtaggatcgtgctcatttccgggaggcgatcgttttgcagcatattttctgttcttccttacagagattctacacaagtcggagatctgaaactggacggcggacgtcaatcgacgggagctgtgagtctgaaggagattattgggctggaaggggtggagttgggggctgacggtaagacagtcagctatacccagtttcttttgccaacgaatgcatttggcgctagacgcaatacaattgactcaaccagcagtttttcgcagttcaggaacctgtcgcaccgtagcctttcaattggcagggcctcaggtacccagggcagtctggacaccggatctgacctaggagatttcatggattatgatcctaacctgctggacgacccacaatggccctgcggtaagcacaagagggtcctcattttccctagctacatgactacagtcatagattatgttaagccttccgacctgaagaaagatatgaacgagacttttaaagaaaagtttccgcatatcaagctgaccctttcaaagataaggagtctgaagagagagatgagaaagttagcccaggaggattgtggactcgaagagcctaccgtcgctatggcatttgtctacttcgaaaagcttgccctgaagggcaagttaaacaagcagaatcggaaactgtgcgctggtgcctgtgtgctgcttgcagccaagattggctcagacttaaagaagcatgaggtgaagcacctgatcgacaaactggaggagaagttcagactcaaccgtcgtgagttgattgcttttgaattcccggtgctggtcgccttagaatttgccttacatttacccgaacacgaggttatgccacattatagacgcttagtccagtcctcgtag

SEQ ID NO: 29985 - DNA, 795 bp, Artificial Sequence
  Description of Artificial Sequence: Synthetic coding sequence
atgacagatgtgccagcgacattcacacaggctgagtgcaatggagataaacccccagagaacggacaacagacaattaccaagatctctgaggaacttaccgatgtggacagtccccttcctcactacagggtggaaccctccctggagggcgcattgacgaaggggtcgcaggaagaaaggcgaaagctgcagggaaatatgctcttaaacagtagcatggaggacaagatgcttaaagaaacctctgcggatgaaatgaccttcagagagggccatcagtgggagaagattcctctgagcggctctaatcaagaaatccgaaggcagaaggaacgtattacggaacagcccctgaaagaagaggaagacgaagaccggaagaataagggacatcaggccgctgagattgagtggctgggtttccggaaaccgtcccaagcagacatgctgcactctaagcatgacgaagagcagaaagtgtgggatgaagaaatcgatgacgacgacgacgataattgtaacaacgacgaagacgaagtgcgagtgatagaattcaaaaagaaacatgaagaagtatcccaattcaaagaggagggcgacgcttcggaagactctcctctgtcgtcagccagtagccaggcggtaacccctgacgagcagcccaccctgggaaaaaagtccgatatatcaagaaatgcatactcacgctacaatacaatatcttatcgtaagattcggaaagggaatactaaacagcggatcgatgaatttgagtcgatgatgcacttgtag

SEQ ID NO: 29986 - DNA, 4302 bp, Artificial Sequence
  Description of Artificial Sequence: Synthetic coding sequence
atgtggtcgctcaccgcttccgagggcgagtctaccactgcccacttctttctgggtgccggtgacgaggggctggggacacgcggaatcgggatgcgccctgaagagtccgatagtgagctgctcgaagatgaggaggatgaggtcccccctgaacctcagattattgtcggcatatgcgcgatgacaaaaaagtcaaagtccaaacccatgactcagattctggagcgtttgtgcaggttcgattacctgaccgttgtgatactcggggaagacgtcatattgaacgaaccagtggagaattggccctcttgccactgtttaatcagttttcactccaaaggctttccccttgacaaggcagttgcctacagcaagttgcggaatccgtttttaataaacgacctggccatgcagtattatattcaggacaggcgggaagtgtacaggattttgcaagaggagggtatcgatttgcctagatacgcagtgttaaaccgagaccctgctcgaccagaagaatgcaacctgatcgaaggcgaggatcaggttgaggtcaacggagctgtgtttcctaaaccctttgtcgagaagcccgtcagtgcagaggaccataatgtgtacatctattatccatcttcagcgggtggcggatcccaacggttgtttcgcaagatcggttccaggagcagcgtatactctccggaatcctccgttcggaaaaccggtagctatatttatgaggaatttatgcccaccgacggtactgatgtaaaagtgtacaccgtgggccctgactatgcccacgctgaggcgaggaagtcccccgctctagacggcaaagtcgagcgcgactcagaaggcaaagagatccgttatcctgtgatgttgacggccatggagaaattagtggctagaaaggtctgcgtggcatttaagcagaccgtgtgcgggtttgatctgcttagagctaatggtcatagctttgtctgtgacgtgaacggattttcttttgtgaaaaactcaatgaaatattatgacgattgcgcgaaaatcctcggcaacaccataatgagagaattagctccacagttccagatcccatggtctatacccacagaggcagaggacatccccatcgtgccaaccacctctggaaccatgatggagctgcggtgtgttatagctattatcagacatggtgatagaaccccaaaacaaaagatgaaaatggaagtgaaacaccctagattcttcgccctttttgagaagcatggaggctataaaactgggaagctcaagctgaaacgccctgagcagctgcaggaggttctagatattacccgtctgcttctcgccgagctcgagaaagagccgggaggcgaaattgaagaaaaaacggggaagctcgagcagctgaaatctgtgctggaaatgtatgggcatttctctggaattaacaggaaagtgcaactgacttattacccccatggtgtgaaagcaagtaacgaggggcaggatcctcagcgcgagacactggctccgtcgctccttctggtgctcaaatggggcggagagctgacccccgcaggacgagtgcaggctgaggagctgggcagagctttccgctgcatgtatccgggagggcagggcgattatgcaggcttcccgggttgtgggctccttcgtctgcacagcacttttcggcacgacttgaagatctatgcctcggatgaagggagagtgcagatgacagcggctgcttttgcaaaaggcttgttggctctggagggagaactgacacccattctcgtacagatggtgaaaagcgccaacatgaacgggctcctggactcggacggagactctttgtcctcgtgtcagcatagagtgaaagcccgactccaccacatcctgcagcaggatgcgccatttgggccagaagactatgatcagttggcaccgactaggtccacaagcctccttaacagtatgacgattatacaaaacccggtgaaagtgtgcgaccaggtcttcgctttgatcgaaaatttgacgcaccaaatacgcgagcgcatgcaggatccacgctccgtggaccttcagttgtaccattcagaaaccctagagctgatgcttcagcggtggtcgaagctcgagcgagactttagacaaaagtccggaagatacgatatatcaaagatcccagacatctacgattgtgtcaagtacgacgtccagcataacggatctctgggtctccaaggaaccgcggagcttctgcgcttgtcaaaggccctggccgacgtcgtgataccgcaggagtacgggatctctagagaggaaaaattggagatagccgtgggcttctgtctccccctgctgagaaaaatcctgcttgatcttcagaggacccacgaggatgagtccgtgaacaagttgcacccactgtgctatctgcggtactcccgtggagtgctgtcaccagggagacacgtgagaactcggttgtattttacttcagaatcacacgtccactcactcctctctgtatttaggtatgggggactgcttgacgagacacaggacgcccagtggcaaagggctcttgattaccttagcgcgatctcagaattgaactacatgacccagatagttataatgctatatgaagataatactcaggaccccctgtctgaggaacgtttccatgtagagctccattttagtcctggcgtaaaaggagtggaagaagaagggtccgcccctgcgggatgtggctttcgaccagcctcttcggagaacgaggaaatgaagaccaaccaggggagtatggaaaacctgtgcccgggaaaggccagtgacgagccggatagagctcttcagaccagcccgcagccccctgaagggccaggtttgcctaggcggagcccattaatacggaaccgcaaagccggaagtatggaggtattgagcgagacctcttcgtcccgcccaggtggctacaggctgtttagctcctcccggcctcccaccgaaatgaaacagtcagggttggggtcacaatgtactggtctgttctctacaacagtgctcggtggatcttcttctgctccaaacttgcaagactatgccagatctcacggcaaaaagctgccaccggctagtttaaagcaccgtgacgaactgctttttgtgccagcagtcaagagattttcagtttcctttgccaagcaccctaccaatggattcgagggatgctcaatggtcccgactatctacccactggagaccttgcacaacgcactgagcctgcgacaggtgtccgaattcctttcaagagtctgtcagcgtcataccgacgcccaggcgcaggcctccgcagccctgttcgactctatgcactcaagccaggcctcggataacccattcagtccccctcgcactctgcatagcccccctctacagctccagcaacggtccgaaaaacctccttggtatagtagtggaccaagtagtactgtaagttcggcgggaccgagctctccaacaactgtggatggaaactcccagttcggcttcagcgaccagccgtccttgaattcacacgtggctgaggaacatcagggtctgggattacttcaggaaacgccgggatctggggctcaagagctcagtatcgagggagaacaagaactgtttgaacccaatcagtctccacaggttcctcctatggaaacttcccaaccttacgaagaagtgagtcaaccctgccaagaggtgccggacattagtcagccttgtcaggatatctccgaagccctgagtcagccttgtcagaaagttccagacatctctcagcagtgccaggagaatcacgacaatggcaatcacacatgccaggaagtaccacatattagccaaccatgtcagaagtcctcccagctgtgtcagaaagtctccgaggaagtgtgccagctgtgtcttgagaattctgaggaggtgagtcagccctgccagggcgtttcagttgaggtcgggaaactcgtccataagttccacgtcggggtgggatcactggttcaagagaccctggtcgaagtgggatcccccgcagaggagattcctgaagaggtgatccaaccctatcaggaattctccgtcgaggtgggcaggctagcgcaagagacttcagctattaacctccttagtcaggggatccccgagattgataagcctagccaggagtttccggaggaaatagatttacaggcccaggaggtgccggaggaaattaattag

SEQ ID NO: 29987 - DNA, 810 bp, Artificial Sequence
  Description of Artificial Sequence: Synthetic coding sequence
atgtttcccgctttggaaacacacctgaagcagactatacccgacccatatgaggatttcatgtaccggcatctccaatactatgggtacttcaaagctcagcgagggagtttgcctaacagcgctacacatcagcacgtacggaagaacaaccctcagtgccttctgaatggctctctaggagaaaaagacgatttaatccccgacactctccaaaaagagaagctgctgtactctcatatgctgagcctgcctcatctgcgatccagacagcttttgtacgacgagttagatgaagttaacccacgactacgggaaccacaggagctgttctccatactttcaacgaagcgccctctccaggcccctcgctggcccatagagtgcgaggtgatcaaagaaaatatacaccacattgagtgggccccaccacagcctgagtatttttaccaacccaagggcaatgaaaaggtccccgaaatcgttggggaaaagaagggcaccgtcgtctatcagctggactctgtgcccatcgaagggtcgtatttcacctcttcccgcgtggggggaaagcgtgggatcgtgaaggaattggccgtgaccctgcagggcccagaggacaacacactgctcttcgagagtcggttcgaatctgggaacctgcagaaagctgtgagggtggatccaatgagtatgaattctccatgcgaactgacgagcaccctgaccaatacacttagcggctttatcttcgttttcaggacgccggagaagatgctgcccatcgcctcaccacttagtacatgctag

SEQ ID NO: 29988 - DNA, 975 bp, Artificial Sequence
  Description of Artificial Sequence: Synthetic coding sequence
atgccactccaggtttctgattattcttggcagcagacaaagacagcggtcttcctctcgctgccattgaaaggggtgtgtgtgagagacaccgacgtcttttgcactgaaaattacctgaaggtgaacttcccaccatttctattcgaagcttttttatacgccccaatcgacgacgagtcatcaaaagcaaagatcggaaatgatactatagtctttacactgtacaaaaaggaggccgctatgtgggaaacccttagtgtaacaggggtggataaggagatgatgcaacggatccgggagaagtccatcttgcaggcccaagagagggctaaggaagctacggaggctaaggccgctgctaagagagaagaccagaagtatgccctaagcgtgatgatgaagattgaagaagaggagaggaagaaaattgaagacatgaaggagaatgagaggattaaggccaccaaggctctggaagcgtggaaagaataccagaggaaagccgaggaacaaaagaaaatccagagagaagaaaagctgtgccagaaggaaaagcaaatcaaggaggagaggaagaaaatcaagtacaaatccctcaccagaaacctcgccagtaggaacttggctccaaaggggaggaactctgaaaacatttttactgaaaagctgaaggaggacagcatccctgcacctcgctctgtggggagtatcaaaattaacttcactccgagggtgtttcccacggccctgagggagagtcaggtggccgaggaggaggagtggctgcacaaacaggccgaagccagaagggctatgaacacggacattgcggagctgtgcgaccttaaagaggaggaaaagaatccagaatggttaaaggacaagggtaagcccgagcgctgcctcaagatccctgtcaccgtcattcatctggtcgtgggcctgtcttcagttatgcgtgggcagatttag

SEQ ID NO: 29989 - DNA, 162 bp, Artificial Sequence
  Description of Artificial Sequence: Synthetic coding sequence
atgcagacatcttccagccgaagcgtgcacctcagcgaatggcaaaaaaactattttgcaatcacaagcgggatttgcaccggaccaaaggctgacgcataccgagcgcagattttgagaatccagtacgcttgggctaattcggaaatatcgcaagtgtag

SEQ ID NO: 29990 - DNA, 2079 bp, Artificial Sequence
  Description of Artificial Sequence: Synthetic coding sequence
atggtgacaaccctcgggcctaaaatggccgctgagtggggtggcggagtcgggtactccggcagtggcccagggagatcacgctggcggtggtctgggtccgtctgggtgaggagcgtgctgctccttctgggaggactgcgggcatctgctacctctactcctgtctccttgggatcatcacccccttgccggcatcatgtccctagcgatactgaagtgataaataaagtgcacttgaaagcaaaccacgtcgttaaacgggacgtggatgagcatttgagaattaagacggtgtacgacaagtcagtggaagaactgctccccgaaaaaaagaacttagtcaaaaataaactgttcccacaagcgatatcctacctggagaaaacttttcaggtgcgaagacctgccggtacaatcttattgagtcgccagtgtgcaacaaatcagtacttaagaaaagagaacgatccgcaccggtattgcactggggagtgcgccgctcacaccaaatgcggaccggtcattgtgcccgaagagcacctgcagcagtgtcgggtataccggggtggaaaatggccacacggggctgtgggcgtgcccgaccaggagggcatcagcgatgcagactttgtgctctatgttggcgcactggcaacagagcgatgctcccatgaaaacattatatcttacgccgcatactgtcagcaagaagctaacatggatcggccaattgcagggtacgctaatttatgcccaaacatgatctccactcagccacaggaatttgtaggcatgctgtctaccgtcaagcacgaggtcatccatgcccttggattcagtgcgggtttatttgccttctaccatgacaaagatggcaaccccctgacttcccgctttgctgacggactgcctcccttcaattacagcctcggactttatcaatggtcagataaggtggttcggaaggttgaaaggctgtgggacgtgcgagataataaaatcgttcgacacactgtctacctgctcgtgaccccgagggtggtcgaagaagcacggaaacattttgattgccccgtgctcgaggggatggaattggagaatcagggtggcgtgggaaccgagctgaatcattgggaaaagcgtctgctcgagaacgaagccatgacaggttcgcacacccagaacagggttctgagcaggatcacactggcactcatggaagataccggatggtataaagcaaactactccatggcggaaaagctggactggggtagggggatgggctgcgatttcgttaggaagtcatgcaagttctggattgaccagcagcggcaaaagagacagatgctgtccccttactgtgacacgctgcggtctaatcccctccagctgacgtgtcggcaggatcaaagagctgtggcggtttgtaacctccagaagtttcccaagcctctgccgcaagagtatcagtactttgacgaactgtctggcatccctgccgaggatttaccctattacggcggtagcgtagagatcgcagattactgtcccttcagccaggagtttagctggcacctctccggcgagtatcagagaagtagtgactgtcgcatcctcgagaaccagccagagattttcaagaactatggagccgaaaaatacggtccgcattccgtttgtctgatccagaagtcagcctttgtcatggagaagtgcgaacgcaaattgagctatcccgactgggggagcgggtgctaccaagtctcctgcagcccgcaggggttgaaggtgtgggtgcaagacacgagctatctatgctccagggcgggacaagttctgcctgtgagcattcagatgaatggctggatccacgatggtaatctcctgtgtccctcctgttgggatttttgcgagctctgtccaccagagacggatcctcccgcaacaaatctcaccagagcactgccattggatctatgttcttgctcatcaagtcttgtagtaaccctttggctactactgggcaacctgtttccattgctagccggatttttactgtgcatttggcactag

SEQ ID NO: 29991 - DNA, 3021 bp, Artificial Sequence
  Description of Artificial Sequence: Synthetic coding sequence
atggattccagccaacaaaagaccttccgcggacatgacgctcccgtgctgagtctcagctttgatcctaaggacatcttcttggcttctgcaagttgtgacggcagcgttcgggtgtggcagatctccgatcagacctgcgcaatatcctggcctttattacagaagtgtaacgacgtgataaacgcaaaatcgatctgccgcctggcatggcagcctaaatctggaaaactgctcgccattcccgtggagaagtctgtcaagctgtataggagggagtcttggagccaccagtttgatctgagtgacaatttcatcagccagaccctcaatatcgtcacatggtccccctgtgggcaatacctagccgcaggatccatcaatggcctgattattgtgtggaatgtggagaccaaggattgtatggagagggtcaagcacgagaagggctacgcaatctgtggactggcatggcatcccacatgcggaagaatctcatatactgatgcagagggaaatttgggcttactcgaaaacgtctgtgatccatcaggcaagacatcctcatctaaggtgtcaagtagggtagagaaggactacaacgacctgtttgacggtgacgatatgtctaatgctggcgacttcttgaacgataatgcagttgagatcccaagctttagtaaggggattattaatgacgatgaggatgatgaagatttgatgatggcctcgggcagacccaggcagaggtcacacatcctggaagacgacgagaacagtgtggatatctccatgctgaagacaggatcatcgctgttaaaggaagaagaagaagacggccaggagggctcgattcacaacctgccgctggtgacctctcagaggcccttttatgatgggcctatgcccacacctcgccagaagccattccaatctggcagtactccgcttcacctgactcatcgtttcatggtgtggaattcaattgggattatccggtgctacaatgacgaacaagataatgcaattgacgtagaatttcatgatacatctatccatcatgcaactcatctgagcaataccttaaactatactatcgccgacttatcacacgaagcaatcctgcttgcctgcgagtctactgatgaactggcttcaaagttgcattgtctccacttctcctcttgggatagttccaaagaatggatcatcgacttgccacagaatgaggacatcgaggcaatctgcctcggacaagggtgggcagccgctgcaacctcagcccttctcttacggctgttcaccattgggggagtgcagaaagaagtgttttctctggcaggaccggtcgtgtctatggcaggacacggggaacaactttttattgtgtatcaccgcggaactggatttgatggcgaccagtgtcttggggtgcaacttctggaactgggaaagaagaaaaaacaaatactgcatggagaccccctgccccttactcgaaaaagctaccttgcatggattggattcagtgccgaaggtaccccctgttatgtcgattcggagggaatcgtgaggatgctgaatagagggctgggcaatacctggacaccaatttgcaatacacgcgagcactgcaaaggcaagtccgaccattactgggtcgtcggcatccatgagaacccgcaacagcttagatgcataccatgcaagggcagcaggttccccccaactctgccgaggccagccgtggccatcctgtctttcaaattgccatactgtcaaatcgcaacggaaaaagggcagatggaggaacagttctggagaagcgtcatttttcacaatcatttagactatttagccaaaaacggttacgagtacgaggagtctaccaaaaatcaggcgacaaaggagcaacaggaactgctgatgaagatgcttgctcttagttgtaagttagagagggagttccgatgcgtggagttggcagatctcatgacccagaatgccgttaatctggcaattaagtatgcctccagatctaggaaactgatcctggcccagaagttgtcagagttggcagtggagaaggccgcagagctaactgccacacaggtggaagaagaagaggaggaggaggattttagaaagaaattaaacgccggatattctaatacagccaccgaatggagccagcccaggttcaggaaccaggtcgaagaggatgcagaggacagcggagaagccgatgatgaggagaagcctgagatccataagcctggccaaaactcatttagcaagagcacaaattccagcgatgtgtccgcaaagtccggagctgtgacattctcctcccaaggtagggtgaatcccttcaaagtctcagcttcttcgaaagagcccgctatgtctatgaattccgccaggtccacgaatatcctggacaacatgggcaagagcagcaaaaaatccaccgccctctcaagaacaacaaacaacgaaaagtcccccataataaagcccctaatccctaagcctaagcccaaacaggccagtgcagccagttacttccagaagcgaaactctcagaccaataagacagaagaggtgaaagaagaaaacctcaagaacgttctttctgagactccagccatttgtccaccccaaaataccgagaaccagcgcccaaagaccggatttcagatgtggctggaagagaaccgttcaaacattctttcggataatcccgatttttccgatgaggcagacatcatcaaagagggaatgatcaggttcagggtcctttccaccgaggaacgcaaagtttgggccaacaaagccaaaggtgaaacagcaagcgagggcaccgaggccaaaaaacgcaagagggtcgtcgacgaatctgacgagaccgaaaaccaggaagagaaggctaaggaaaacctaaatctgagcaagaagcagaagccattagacttcagcacaaaccaaaagctgagtgcgttcgcctttaaacaagagtag

SEQ ID NO: 29992 - DNA, 540 bp, Artificial Sequence
  Description of Artificial Sequence: Synthetic coding sequence
atgactgaggactctcagcggaattttcggtcggtgtactatgaaaaggttggatttcgaggggttgaagaaaaaaagagcctggaaatcctgctcaaggacgacagattggacaccgagaaattatgcaccttttcgcagagatttcctttgcccagcatgtacagggcacttgtgtggaaagtgttactcggtatcttaccccctcaccatgaatcccatgcaaaggttatgatgtataggaaggagcaatatctggacgttctgcatgcgttaaaagtggtaaggttcgtgtctgacgccacaccgcaggccgaagtgtatctacgaatgtaccagttagaaagcggaaagctgcccaggtctcctagtttccctctggaacccgacgatgaagtgtttctcgcgatagcaaaggccatggaggagatggtggaggactccgtcgactgctattggatcactcgccgtttcgttaaccagctgaacacaaagtacagagatagcctaccccagctggaggggattaatgtaggatag

SEQ ID NO: 29993 - DNA, 3189 bp, Artificial Sequence
  Description of Artificial Sequence: Synthetic coding sequence
atgatctccaaaggcggatcggaagccctgctgcagaccctcgtcgacacggccagaaccgctcccccagattacgacattcttctgccactgttcagactcttggcgaaagtcggactgcgcgacaagaagataggacggaaggctttggagttagaggcgctagacgtcactttgatcctggctaggaaaaatctctcccacggtcaaaatctgctacattgtctctgggcactcagagttttcgcctcatccgttagtatgggcgcaatgctgggcatcaacggcgctatggagcttttatttaaagtaattacaccctatactcggaaaagaacacaggcgattagggctgcgacggaggtgctggcggcacttctgaaatccaagtccaatggtcggagagcagtaaatcgtggttatgtaacgagcctactgggactgcatcaggattggcattcacacgacacagcgaatgcatacgtgcagattagaaggggccttttgttgtgtcttcgccatatcgccgcacttcgatcaggcagagaagccttcttggcagctcaagggatggaaatcctcttctcgaccacacaaaactgcctcgatgataaatcgatggaaccggtcattagcgtcgttctgcagattttacggcagtgttatcctacatcacctctgcccctagtaacggccagcagtgcctatgctttccctgtgccaggctgcatcaccacggaaccacctcacgacctccccgaggaggattttgaagacgatggtgacgacgaagttgacaaggatagtgataccgaagacggaaaggtcgaggacgatgatctggagaccgacgtcaataaactgtcaagtaagccaggactggaccggccagaggaagaattaatgcagtatgaggtcatgtgcttggaactctcctattccttcgaggagctccagtccaagctgggagatgatctcaatagtgaaaagactcaatacgccaaccaccaccacatccctgcggcagcctctagcaaacagcattgctatagcaaagatcagagctcctgtggccaggaacgtgagtacgccgttcagacatctttgctgtgtagagtgaaaaccggcagatccactgtccaccttggaagcaaaaaaaatcctggcgtgaacctctatcagaacgtccagtcaaacagccttcgtcgagattcttccgaatccgaaatccctgatattcaagcgtcgcccaaggccgatgcgtgggacgtcgatgcaatcttctgtcctcggatgtcagcttctttcagcaactcgactaggacccgggaagtggttaaggtgattgacaagctgctgcaaacccacctcaaacgggtgccttttcacgacccgtatctctacatggcgaaggctcgaaggacttcaagcgtagtggacttcaaaatgatggcgtttccagatgtctggggacattgccctccaccaacaacacagcccatgctggaacgcaagtgcggagtgcagagaattcgcattttcgaggacattcggagactcatacagccaagcgatgtgattaataaggtagtgttctcccttgatgaaccctggcccttgcaggacaacgcctccaattgtctcagatttttcagcaaatttgaatctggaaatttgcggaaggccatccaggtacgagagttcgagtatgaccttctagtgaacgctgacgtcaattctacccaacaccagcagtggttttatttcaaagtgtccggtatgcaggctgccataccttatcactttaacataattaattgtgagaagccaaacagccaatttaactatgggatgcaacccactctgtacagcgtgaaagaggccttgcttgggaagcccacatggattcgaactgggcatgagatctgttactataagaatcattacaggcagtctactgctgttgctggaggggcttcagggaagtgctactatactctgacgttcgccgtaactttccctcacagcgaagacgtgtgctatctggcctaccactacccttatacctacacagccttaatgacgcacctagacattctcgagaagagtgttaacctaaaagaggtgtattttagacaagatgttctgtgccaaactctgggcggaaatccgtgtcctttagtgaccatcactgctatgccagagtccaacagcgacgaacacttagagcagtttcggcacaggccatatcaggtaataaccgccagggtgcaccccggagaaagcaacgcgagctgggtgatgaagggaacccttgagtttctcgttagttccgatcccgtcgctaggctcctccgggaaaacttcatatttaaaatcattcccatgctgaaccccgatggcgtgattaatggcaaccaccggtgtagcctctcaggcgaagacttgaaccgtcagtggctcagccccagtgcccaccttcagcctaccatatatcatgccaagggcctgctgtaccacctgagctccataggtcgatcccctgttgtgttttgcgactttcacggccactcccagaaaaaaaacgtgtttctttacggctgttccataaaggaaacgctgtggcaggccgcatgcacggttggcacctctaccatactggaggaagtgaactatagaacgctgccaaaaattcttgacaaattagcgccagccttcactatgagctcctgctcattccttgtcgaaaaatccagggcctcaactgccagggtggtcgtctggcgggaaatgggagtatccagatcatataccatggagagcagttattgtggctgtaaccagggtccgtaccaatgtactcagaggttgctggagcgaaccaaaaatgaaagggcccatcccgtggacggactgcagggtttacaattcgggacaagagaactggaggagatgggtgctatgttttgcctgggtctcctcatcctggagctgaaatcggcctcgtgttcacatcagctcctggcccaggcagcgacactgctctccgcagaggaggacgcattggaccagcatctgcagcgactgaaaagttcaaatttcctgcccaagcacatctggttcgcataccactttttcgcaatcacaaattttttcaagatgaatcttttgcttcatgtcagtccatag

SEQ ID NO: 29994 - DNA, 738 bp, Artificial Sequence
  Description of Artificial Sequence: Synthetic coding sequence
atggccgctgcgccaccctcctactgtttcgtggctttccctccacgtgcgaaggatgggcttgtggtctttggtaagaatagtgccagacctagggatgaggtgcaggaagtggtgtacttttcggccgctgatcatgagcctgagtctaaagtcgagtgcacctacattagcattgatcaggtcccacgcacttacgccatcatgattagccggccagcatggctatggggagccgaaatgggtgctaatgaacacggggtgtgtattgccaatgaagcaataaacacccgcgaacccgcagcggagattgaagcgctgctggggatggatttggtgcgcttaggactcgagcggggagagaccgcaaaagaggcccttgacgtgattgtatcactgcttgaggagcatgggcaggggggtaattacttcgaggacgctaattcttgtcacagcttccagtctgcatatctcatcgtagaccgcgatgaagcgtgggtactggagactatcggtaaatactgggcagccgagaaggttacagagggtgtgagatgcatttgttcacaactgtcacttacaaccaagatggatgccgaacacccagaactccgcagctatgcccagtcccaaggctggtggacgggtgagggggaattcaactttagcgaggtattcagtcctgtcgaagaccacctggattgtggcgctggtaaggatagtctggaaaagcagtag

SEQ ID NO: 29995 - DNA, 99 bp, Artificial Sequence
  Description of Artificial Sequence: Synthetic coding sequence
atgtctgaacagggggatttgaatcaagccatagccgaagagggtggcacagaacaggaaaccgccacccctgagaacggtatcgtcaagagtgagtag

SEQ ID NO: 29996 - DNA, 132 bp, Artificial Sequence
  Description of Artificial Sequence: Synthetic coding sequence
taagtgctgggatcacctaaacccgaggagattccgttaacatggatccagcctgggaccactgtgctcaactgttcccacgattttctgagcgagtctctcataattatccgtagaatggccatattttag

SEQ ID NO: 29997 - DNA, 339 bp, Artificial Sequence
  Description of Artificial Sequence: Synthetic coding sequence
atgttcgccaagttaaagaaaaagattgccgaggagacagctgtggctcagcggccaggcggtgccacgcggatccctagatccgtgagtaaggaatctgtcgcatctatgggagcagattctggagatgattttgccagcgacggctccagctctcgtgaagacctctcctcccagcttttacgccgtaacgagcagattagaaaacttgaggcacggctttcagattacgcagaacaggtgaggaacctacagaagattaaggagaagctcgagattgccctcgaaaagcaccaagattcaagtatgagaaaatttcaggaacagaatgagacatag

SEQ ID NO: 29998 - DNA, 579 bp, Artificial Sequence
  Description of Artificial Sequence: Synthetic coding sequence
atgggaaagggctgtaaagtggtagtctgtggcctgctctctgtagggaaaactgccattctggaacaactgctctatggtaaccataccattggcatggaggactgcgaaactatggaagacgtgtacatggccagcgtcgagactgaccgaggagtaaaagagcagctgcatctctacgatactagaggtcttcaagagggagttgagctgcctaaacactacttcagctttgctgatggatttgttctggtatactctgtcaacaatctcgagtcatttcagagggtggaactgctaaagaaagaaatcgataagttcaaggacaagaaggaagtcgcaatcgtggtcctaggcaataagattgacctctcagagcagagacaggtggacgccgaggtggctcagcagtgggcgaaatccgagaaggttcggctctgggaggtaactgttaccgatcggaaaaccctgatcgaacccttcacactgctggccagcaaactgtcccaaccacagagcaaatcgtcctttccacttccgggacgcaagaataagggaaacagcaacagcgagaactag

SEQ ID NO: 29999 - DNA, 1458 bp, Artificial Sequence
  Description of Artificial Sequence: Synthetic coding sequence
atggcccctcgtctgcaacttgagaaagccgcatggcgatgggccgaaaccgtcaggcctgaggaggtaagccaggaacacatagagaccgcctatagaatatggctcgagccatgtattagaggagtctgtaggagaaactgcaagggtaacccaaattgtttggtgggcatcggcgaacacatttggttaggagagattgatgaaaatagctttcataacatcgatgaccccaactgcgagaggaggaagaagaatagcttcgtgggcctaaccaatctgggcgcaacatgttacgtgaatacttttctgcaggtgtggttccttaacctggagctgcggcaggccctctatctgtgtcctagcacttgcagcgattacatgctcggagatggtatccaggaggaaaaagactacgaaccccagactatctgcgagcatttacagtacctgttcgctttgttgcagaacagcaacaggcggtatattgatccgtctggctttgtgaaagcccttggactagacaccggccagcagcaggatgcccaagagttttcaaagttgtttatgagcctgctagaagatactctcagcaaacagaagaatccggacgtgcggaatatcgttcagcagcagttttgtggagagtacgcctacgtgaccgtttgtaaccagtgcggccgagagagtaagttattgtccaaattttatgagctggaattaaacattcagggacataaacagcttacagattgtataagcgaattcctgaaggaagaaaaattagaaggagacaacaggtacttctgcgagaactgccagagcaaacagaatgcaactcgcaagattaggctgctgagcctgccctgtactctcaacctacagctcatgaggtttgtgtttgacaggcaaactggccataaaaagaaacttaatacatacattggttttagtgaaatattggatatggagccctatgtcgaacataaggggggatcctacgtctatgagctttccgctgtgctgatccatcggggagtgagcgcttatagcggccactatattgcccatgtgaaggacccccagagcggagagtggtacaagttcaacgacgaggacattgagaaaatggaaggcaaaaaattgcagttgggaatagaagaggatttggccgaaccctcaaagtcccagaccaggaaacccaagtgcggcaagggcactcactgcagccggaacgcttacatgctggtgtacaggctgcagacccaagagaaaccgaatactacagttcaggtgcccgcatttctccaagagctcgttgatagggacaattctaagttcgaggagtggtgcatcgagatggctgaaatgcgcaagcagagcgtcgataagggaaaagcgaagcacgaagaggttaaagagctgtaccagcgactgcccgctggggcaggcctgtag

SEQ ID NO: 30000 - DNA, 1119 bp, Artificial Sequence
  Description of Artificial Sequence: Synthetic coding sequence
atggatgttctctcgcccttgtcctttatcaaggtatctcatgtgcgcatgcagggtattctcctgctggtgtttgcaaagtaccagcatctgccctacatccagattctatccacaaaatctacacccaccgggctgtttgggtactggggtaacaaaggcggtgtcaacatctgtctcaagctctacggatattatgtctccatcattaactgccatttaccaccccacattagtaacaattatcagcggcttgaacacttcgacaggattctcgagatgcagaattgcgaagggagggatattccaaacatattggatcatgacctcatcatctggtttggcgatatgaacttccgcatcgaggacttcggactacatttcgtgagggaaagtattaagaacagatgctatggcggtctatgggagaaagaccaactgagcatcgctaagaagcatgacccactgctgcgagaattccaggaaggcaggctgttgttccccccaacttacaaatttgatcgcaatagtaacgactatgataccagtgagaagaagcgaaagcctgcctggacagacaggattctctggcgactgaagagacagccatgtgcgggaccggataccccgattccaccagcctcccattttagcctctcacttcgcggatactcatctcatatgacctatgggatttctgatcacaaacccgtttccggaacctttgacctcgaactgaagccacttgtcagtgcgcctctgattgtattgatgccagaagatctgtggaccgtagaaaacgacatgatggtgagttactcttccacctctgatttcccatctagtccatgggattggataggcttgtacaaggtggggctccgcgatgttaacgattacgtgagctacgcctgggtgggtgactctaaagtgagttgctccgataacctgaaccaggtgtatatcgatatatccaatatccccaccacagaagacgagttcctactgtgctactacagcaactccctgcggtccgtggtcgggatctcacggccatttcaaataccaccgggatctctaagagaagatcccctcggggaggcccagccccagatctag

SEQ ID NO: 30001 - DNA, 1548 bp, Artificial Sequence
  Description of Artificial Sequence: Synthetic coding sequence
atgtccgaaggggagtcccaaacctccgtgtctcccccagttacttcaactacatcagccgcttcccccgaggaagaggaggagagcgaggacgagagtgaaatactcgaagagtctccttgcggtcggtggcaaaaacgacgagaggaagtgaaccagcggaacgtccccggtattgatagtgcatacctcgccatggataccgaggagggagtggaggtggtatggaatgaggtgcagttcagcgaaaggaagaactacaaactccaggaggagaaagtgcgagctgtcttcgataatctgatccaactcgagcacctgaacatcgtcaagtttcataagtattgggcggacatcaaggaaaacaaggctagggtgatatttataaccgagtatatgagcagcggttccctgaaacaattccttaaaaagactaagaaaaaccataaaacgatgaacgaaaaggcttggaagcgctggtgtacccagattttgtctgcactcagttacctgcatagctgtgacccaccaattattcatgggaatctcacatgtgacaccatattcatacaacacaatggactcataaagatcggaagtgttgctcccgacacaataaataaccatgtgaagacttgtagggaagaacaaaaaaacctccattttttcgctcctgagtacggtgaggtcactaatgtgacgaccgccgtagacatctactccttcggaatgtgtgccctggagatggccgtgctcgaaattcaagggaatggggaatccagctacgtgccacaagaggcgatcagttccgccatccagctgttggaggaccccttgcagagggagtttattcagaagtgcttgcaatctgagccggctagacgcccaactgctagggaactcttgtttcacccagccttgtttgaagtacccagtctgaagctgctggcggctcactgcatcgtgggccaccagcacatgatcccagaaaatgccctcgaagagattactaagaacatggacacctcagcggtgctggccgagatcccggcagggccagggagggaacctgtccagacactgtactcccagtctcctgccctggaactagataagtttctcgaggatgttagaaatggaatctatccactcaccgcgttcggcctcccacgaccccagcagcctcagcaggaagaggtaacctctcccgtggtccccccttccgtgaaaaccccaacaccagaaccagccgaagtggagactcgcaaggtagtgctcatgcagtgtaacattgagtccgtagaggaaggggtcaagcaccatttgacgctgctgttaaaactggaggacaagttgaacagacacctctcctgcgacctgatgccaaatgaaaacatccccgagctggcagcagaactggtacagctgggcttcatctccgaagcagaccagtcaagactgacatctctgctggaagagacactcaacaagtttaatttcgctcggaactccacactcaattcagccgctgtcacggtcagttcatag

SEQ ID NO: 30002 - DNA, 435 bp, Artificial Sequence
  Description of Artificial Sequence: Synthetic coding sequence
atgagctcaccacttgctagcttgtccaagaccaggaaggttcctctgccaagtgagcccatgaatcccggacgacggggaattaggatttacggagacgaagacgaggtagatatgctctccgacggatgtgggtccgaagagaaaatttccgtcccttcctgctacgggggtataggagctccggtatcccgccaggttccagcttcacatgatagcgaactgatggccttcatgacaaggaaattgtgggacctggagcaacaggtcaaggcgcagactgacgaaattctctccaaagaccagaaaattgcagctctcgaagatctggtgcaaacattacgtccccatccagcagaggcgaccctgcaaagacaagaagaactggagactatgtgtgtgcagctgcagcggcaggttagagaaatggagtag

SEQ ID NO: 30003 - DNA, 1047 bp, Artificial Sequence
  Description of Artificial Sequence: Synthetic coding sequence
atgcctgctcccccttgcgctagctgccatgcagccagggccgcactgagacgacccctctctggccaggctctttgcggtgcctgtttctgcgctgcattcgaagccgaagtgctgcataccgtcctggcgggacggctcctgccacccggagccgtggttgccgtgggagcttcaggcggaaaagacagcaccgtgttggctcacgttctccgggctctggcccctcggctcggcatttcccttcagctggtggctgtcgatgagggcatcgggggttaccgggatgccgctctcgccgcagtcaggcgccaagccgcaaggtgggagctgcccttgactgtggtggcatatgaggatttgtttgggggttggaccatggacgccgtggccagatcgacagctgggtctggcagatcacggagttgctgcacattctgcggagtgcttaggcgcagagccttggaagaaggcgcacggcgagtcggcgctactcacattgtgactggacataacgccgacgatatggcagagactgttctgatgaacttcttgcgaggcgatgccggacgactggctagaggagggggacttgggtccccaggggagggaggagccttgcccagatgcagacctctccagttcgcatcccagaaggaagtggtgttgtatgcacattttcggcgtctcgactacttttctgaggaatgcgtgtacgcacctgaggcctttcgcggacatgccagagaccttttgaagaggctcgaagccgcaagaccctccgcagtattggatctcgtccatagtgctgagcgcctagcactggcccctgctgcccgacccccacgccctggagcctgcagtcgctgcggggcattggcctccagggcactatgccaagcttgcgctctcttggacggactcaacagaggacggcctaggctagcaattggcaaggggaggagagggttggatgaagaggctacacccggtaccccaggagacccggcacgccctccagcttctaaagctgtcccaactttttag

SEQ ID NO: 30004 - DNA, 321 bp, Artificial Sequence
  Description of Artificial Sequence: Synthetic coding sequence
atgcctgaggatcaggtcggtaagctcgaggccacagagaacactatcagcgcaatggccgctgccgctgcagaacagcagcagttctacctgctcctgggaaatcttctgtcccctgataatgttgtgcggaagcaggcggaagaaacctacgagaatatcccaggacagtcaaagattacattcctgttacaagccattcgcaataccacagccgctgaagaggctaggcaaatggccgcagtcttactaaggcgattgttatcctcagcattcgacgaggtgtacccagccctaccatccgatgtgcaaaccgcatag

SEQ ID NO: 30005 - DNA, 198 bp, Artificial Sequence
  Description of Artificial Sequence: Synthetic coding sequence
atggagctgcgctgcggcggtcttctattctcgtctagattcgattctggcaaccttgcacatgtcgagaaagtcgagtccctatcctctgatggggaaggggtagggggtggcgctagtgccctcacttccggcattgccagtagcccggattacgagttcaacgtttggacccgccctgactgcgccgagacatag

SEQ ID NO: 30006 - DNA, 1371 bp, Artificial Sequence
  Description of Artificial Sequence: Synthetic coding sequence
atggcggattctctcgaatcaacccccctcccttctcctgaagacagactggcgaagcttcaccccagtaaggagctgctcgagtactatcagaagaagatggccgagtgcgaagcagagaacgaggatctgctgaagaagctcgagctctataaggaagcttgcgaggggcagcataaactggaatgcgacttgcagcagagggaggaagaaatagctgagctacagaaggcattgtcggacatgcaggtgtgtctgttccaggagagagagcacgtgcttagattatactccgagaacgatcgccttcggatcagggaattggaggataaaaaaaaaatccagaatctgctggccttagtgggcactgatgctggagaagtcacctacttctgcaaggagccccctcataaggtaacaatactgcagaaaacgatccaggccgtcggcgagtgtgaacaatctgagtcatccgcatttaaagctgatccaaagatttccaaaagacgaccatcccgggagcggaaggagtcgtcagagcattaccagcgcgacatccagacattgatccttcaggtcgaggcgctccaagcgcagttaggagagcagaccaagctgtcaagggagcagattgagggcctgatcgaagacagaaggatacatctggaggaaatacaggtgcaacatcagagaaaccagaacaagatcaaagagctgactaaaaatctgcaccacacacaggaattactctatgagtctaccaaagatttcttgcagctcagaagcgagaaccagaataaagagaagtcatggatgctggagaaggacaatctgatgagcaaaatcaaacagtacagggtccaatgtaagaagaaggaggacaaaattggaaaagtcctaccagtcatgcacgaatctcaccacgcgcaatctgagtacataaagagcctaaaagataaactggttcaggaaaaaaaattatccaatatgtaccaagaacagtgtatatccctggaggaagagctagccaggatccgtgaggaggaagggatgcgtcgggaaatcttcaaggatcgtacaaataagatggggaagcgattgcagattatgaccaaaagatatgaagcacttgagcggaggagaatactggaggtggagggtttcaaaacagatataaaagttttgcggcaaaaattgaaggacctagagcagatgttgtataaggctaccgtgaacgctagggccaatcaagaccttgccctgctttgtgaggtaagggattctaaccgaagagcacacaagatccagggggaacttaaaaacctgaagagcaaagtgttcggcctagaaaatgaactccgcctgtgctag

SEQ ID NO: 30007 - DNA, 1275 bp, Artificial Sequence
  Description of Artificial Sequence: Synthetic coding sequence
atggatcagccatcaggacgaagctttatgcaagtgctgtgtgaaaaatactctccagaaaactttccttatagacgcggacccggtatgggcgtgcacgtgcccgctaccccacagggaagcccgatgaaggatagactgaacttgccatcagtcctggtgctgaacagctgcggtattacctgtgcaggagatgagaaagagatcgccgcattttgtgcacacgtgtcagaactggatctgtccgacaataagctggaggactggcacgaggtgagtaaaattgtgtctaacgtgcctcagctggagttcttgaatttgtccagcaacccattgaacttatctgtgctagagcgcacctgtgcaggatcattttccggagtgcgcaaactcgtgctgaataacagtaaagcctcttgggaaaccgtacacatgatcctccaggagctgccggatctggaggaactgttcctgtgtctgaatgactacgaaaccgtgtcttgtccatcaatctgttgccacagcctgaaactcctgcacatcacagataataacttgcaggattggacagagattcgcaaactgggtgtcatgtttccatcacttgacactctggtgctggctaataatcacctgaatgccatagaggagccagacgactctctcgctagattgtttcctaatcttcgatctatttctctgcacaaaagcggcttgcagtcctgggaagacatcgacaaattgaactcgttccccaagctcgaggaggttagacttctaggaatccctctcctgcaaccttacaccacagaagagcggaggaaactggtgatagcaaggctgccctcggtctctaaactaaatgggtccgtcgtcactgacggggagcgcgaagatagtgaaaggttctttataaggtattacgttgacgttccacaggaggaggtgccttttaggtaccacgaactcatcactaaatacggtaagctggagcctctggcagaggtcgatctcagaccccaaagctcagcgaaagtggaggttcacttcaatgaccaggtcgaagagatgtccatccgtctcgaccagaccgtcgctgagttgaagaagcaactgaagacccttgtccagctgcctacttccaacatgctactgtactacttcgatcacgaggcaccatttgggccagaggagatgaagtacagcagtcgcgcactgcattcatttggcatccgtgacggagataagatctacgtggagtcaaagaccaaatag

SEQ ID NO: 30008 - DNA, 264 bp, Artificial Sequence
  Description of Artificial Sequence: Synthetic coding sequence
atgagtattagcagcgacgaagtaaactttctagtgtacaggtacttgcaggagagcgggttcagtcattccgctttcacattcggaatcgaaagtcacatctcacagagtaacatcaacggggctttggttccaccagccgcactaatttccatcatccagaaagggctgcagtacgtagaagcagaagtttcgattaatgaagacgggacccttttcgatggaagacccatcgaaagcctgtctctcatcgacgctgtctag

SEQ ID NO: 30009 - DNA, 360 bp, Artificial Sequence
  Description of Artificial Sequence: Synthetic coding sequence
atggtccgcacaaaaacatggacactaaaaaaacactttgtggggtaccccactaattcagatttcgagctgaagacagctgagctgcccccactgaaaaacggggaagtgttgttagaggcactgtttctgactgtggacccttacatgcgggtggtcgagagtaaaaatgtcgcactccccaaaggaacaattgtgctcgcaagccctgggtggacaacgcatagtatcagtgacggtaaggatctagagaaactgcttacagagtggcctgataccatacccctttcacttgctctcggaactgtcggaatgcctggcctgaccgcctacttcggactgcttgaaatctgtgggtag

SEQ ID NO: 30010 - DNA, 23907 bp, Artificial Sequence
  Description of Artificial Sequence: Synthetic coding sequence
atggatcagccccagtttagcggtgcgcctagattcctgaccaggcccaaggcattcgtagtgtctgttgggaaggacgctactctctcctgtcaaattgtgggtaaccccacccctcaagtctcctgggagaaggaccaacaaccagtcgccgctggcgctcgctttcggctagcgcaagacggtgacttatatcggctgacgattctggaccttgctctgggagatagcggccagtacgtgtgcagagccaggaacgccatcggtgaggcttttgccgcagttggtctgcaggttgacgctgaagccgcatgcgctgagcaggcccctcatttcctcctcagaccaacgtccatacgggtgagggaggggagcgaagccactttcagatgccgtgtggggggaagccctcgcccagcagtgtcctggtccaaggatgggaggagactaggagagcccgatggcccaagagtgcgcgtggaggagctgggtgaggccagcgccctgagaattcgtgcagcacgccctcgagatggcggtacatacgaggttcgagcggaaaatcccctgggtgccgcttcggcggctgcagcactcgttgtggactctgacgcagctgacaccgcttcccgccctggcacaagtacagccgcactgctggcccacctccagagacgacgcgaggctatgagggccgagggagcccctgcctcgcccccttccaccggtactcgcacatgtacagtgactgagggcaaacacgcacggttgtcttgctacgtaactggtgagccgaagcctgagacagtctggaaaaaggacgggcagctcgtgaccgaaggcaggaggcacgtggtgtacgaggacgcacaggagaatttcgtcctgaagattctgttttgtaaacagtctgaccgcggactctacacctgtacagcctctaacctcgtgggtcagacatattcctctgtcctggtggtcgtcagggagccagcggtcccattcaagaaacgcttgcaggatctggaggttagggaaaaggagtcagccacttttctctgtgaggtgccccagccttccaccgaggccgcatggttcaaagaagaaacaagactttgggcctcagccaaatatggcatcgaagaggaaggcactgagcgcagacttacagtgcggaatgtcagtgccgatgacgacgctgtctacatttgcgaaaccccagaaggcagccggaccgtggctgagcttgcagtgcagggcaatctgctccgcaagctgcctagaaaaactgcagtcagagtcggagacacggccatgttttgcgtagagttagccgtgccagtggggccagtccattggctgcgtaatcaggaggaggtcgtggccggaggtcgggtggcgatttctgcggaggggactcgtcacacactcactattagccaatgctgtcttgaggatgtgggacaggtggcctttatggcaggcgactgtcagacctccacacagttttgcgtctctgcccctagaaaacctcccctgcagcctccagtcgacccagtggtcaaggccaggatggagtcatcggtcattctgtcttggtctcctcccccacacggagaaagaccggtgactatcgatggctacttggtcgagaaaaaaaaattgggcacctatacctggatccgatgccatgaggcagagtgggtggccacaccggagcttacggtggccgatgtcgccgaagaaggcaatttccagtttagagtgtctgccctcaacagctttggccagtctccctacttagagttccccggaaccgttcacctggctccgaagctggctgtgcgtacccccttgaaggcagttcaggcagtggagggaggagaggtgactttctccgtggacctaacagtggcctcagcgggtgaatggtttcttgatgggcaggcacttaaggcaagctcagtatacgagattcattgcgacaggacacggcataccctgaccattcgggaggtgccagcctctcttcacggcgctcagctgaagttcgtggcgaatgggattgagtcaagcatccgcatggaagttcgtgcggctcccggtctgacggctaacaagccacctgctgccgctgctcgagaagttttggcacgcctgcatgaagaagcccagctcttggcggaactgagtgaccaagctgccgcagtgacgtggctaaaagacggtaggaccctgagcccaggtcctaagtatgaagtgcaggccagcgcgggtcgccgagtcttactcgttcgcgacgtagccagagacgatgctggcctgtatgagtgcgtgagcaggggcggtagaatcgcctaccaactgtcggttcaaggcctagcaagattcttacataaggacatggccggttcatgtgtcgacgctgttgcaggtggccctgcccagtttgagtgtgaaacaagtgaggcgcacgtccatgtgcactggtacaaggacggcatggaacttggacactccggcgagaggttcctccaggaagatgtgggaacccggcaccggctagtggcagccacagtgactcgccaagacgaggggacatactcgtgtcgcgtgggcgaggacagtgtggatttcagactgagagtttcagagccgaaggttgttttcgcgaaagaacaactggctaggcgcaaacttcaggctgaggcaggcgctagtgcaacactgagttgtgaggtcgcccaggcacaaactgaggtcacttggtacaaagacggtaaaaagctgtcatccagctccaaagtgtgtatggaggcaactgggtgtacccgcagattggtggttcaacaggccggacaagctgacgctggggaatactcctgtgaggccggagggcagcgccttagcttccacctagatgtcaaagagcctaaagttgttttcgctaaagatcaggtcgcgcactccgaggtgcaggcggaagccggagcaagtgccacgctgagctgtgaggtggcacaagcacaaaccgaggtcatgtggtataaagacggcaagaagcttagcagtagtctaaaagtacacgtcgaagctaagggatgtaggagacggctggtggtgcagcaagcaggtaagacagacgcgggtgactacagctgcgaggcccgagggcaacgggttagctttcgcctccatattaccgaacccaaaatgatgttcgccaaagagcagagcgtacataacgaggtgcaggctgaagcaggcgcaagcgccatgctttcctgcgaagtggcccaggcccaaaccgaagtgacatggtataaggatggcaagaaactgtcctcatcaagtaaggtggggatggaagtcaaggggtgcaccagaaggctggtgctcccgcaggccggtaaagccgacgccggagaatattcttgtgaggctggcggtcaacgcgtgtcgtttcatctgcatataactgaacctaaaggcgtgtttgcaaaagagcagtctgtgcacaacgaggtgcaggccgaggccggaaccaccgctatgctcagctgtgaagtggcccagccccagaccgaagtcacatggtataaagacgggaagaaactgagctcctctagcaaggtccgaatggaagtaaaggggtgcaccaggcgcctcgttgttcagcaggttgggaaggctgacgcaggagaatattcgtgcgaggcgggaggccaacgggtgtctttccagctgcacattactgagcctaaagccgtgtttgcgaaagagcagctggtccacaacgaggttcggaccgaggcaggcgcttcagctactctgtcttgtgaggtggctcaggctcagacagaggtgacttggtataaagacggtaaaaaactaagttcttcttccaaagtcaggatcgaggccgctggctgtatgcgccagctcgtggtgcaacaagcaggccaggcggacgccggtgagtatacgtgtgaggctggcggacagcggctgtccttccacctcgacgtgagtgagccaaaggccgtgttcgccaaggaacaacttgcacaccgcaaggttcaagccgaagccggagccatcgctacattgtcttgtgaggtggctcaagcccaaacagaggtaacctggtacaaagacggcaagaagcttagcagctcttccaaggtcaggatggaagctgttggctgtacccggcgactcgtcgttcagcaagcctgtcaagctgacacaggcgagtactcttgtgaagccggagggcagcggctgagcttctccctggacgtggcagagcccaaagtggtcttcgcgaaagaacagccagtacaccgggaagtgcaagcccaggcaggagcaagcacgacactgtcgtgtgaggtcgcacaggcacagacagaggtaatgtggtataaggacggaaagaaactcagctttagcagcaaggtcaggatggaggctgtcgggtgtacccgccgactagtggtacagcaggcaggccaagctgtggccggtgagtatagttgtgaggccggttcacagaggctctcttttcacctgcacgtggctgaacctaaggcggtgtttgccaaggaacagcccgcatcccgagaggtccaagctgaggcagggacttctgccaccctctcttgtgaagtggcgcaagcacagacagaggttacttggtataaggacggcaaaaagttaagtagctccagtaaggtgcggatggaggccgtcgggtgcacgagacgactcgttgttcaggaggccggacaggcagacgctggcgaatactcctgcaaagctggggatcaacggctgagtttccacttacatgttgcagaaccaaaggtcgtcttcgccaaggagcagccagcccacagagaggtgcaggcagaggccggtgccagcgcaaccttatcttgtgaggtcgcccaggctcagaccgaagtcacatggtacaaggacggcaaaaaactgagctcatcaagtaaggtgcgagtcgaggctgtgggctgcacgcgaagactggtcgtgcagcaagccggacaggccgaggccggagaatatagctgcgaggccggaggccagcagctctcgttccggttgcaggtagctgagttggagccccaaatatcagagagaccatgccgccgagagccactcgtggtcaaggagcacgaggatattattctgaccgcgacccttgcaactccttccgccgcaactgtgacgtggcttaaggacggagtcgagatacggaggtccaaacgacatgaaacggcatcacaaggggacacacataccctgaccgttcacggcgctcaggtacttgattccgccatctacagttgccgcgtaggagctgaagggcaggattttcccgtgcaagtggaggaagttgccgcaaagttctgccgccttctggaacccgtgtgcggagagttggggggtactgtcaccctcgcatgcgaattgagtcccgcatgtgcagaagtagtgtggcgatgtggaaatactcagctccgcgtgggcaaaaggtttcaaatggtagcggagggaccagttaggagccttacagtgctggggcttagagctgaagatgcaggcgaatatgtgtgcgagtccagggatgatcacacatcggcccagctcactgtcagcgtacctcgggttgtgaagttcatgtccggcctttccacagtcgtagccgaggagggaggagaggctaccttccagtgcgtcgtttcaccatccgatgtcgcggtcgtgtggttccgggacggcgcactactacagccttcagagaagtttgcaatctcacagagtggagctagccattcattgacaatcagcgatcttgtgcttgaagatgctggccagattactgtggaagctgagggcgcttctagttccgctgctctccgggttcgagaagctccagtattgttcaagaaaaaactggagccacaaaccgtggaggaacgcagttccgttacactggaagtagagctgacaagaccatggccggaactaaggtggactagaaatgccactgcattagcccctggaaagaatgtcgagatccatgccgaaggtgcgagacacaggctggtactacataacgttgggtttgccgatcgtggatttttcggatgtgagactcccgacgataaaacacaggccaagctgactgtggagatgagacaggttcgcttggtgagaggactccaggccgtcgaggcgagagagcagggaactgccaccatggaggtgcagctcagccatgcggatgtcgacgggtcttggaccagagacggcctgcgcttccagcaaggtcccacatgccacctcgctgtgcgaggacctatgcatacactgacactttccgggctgcgccctgaagattcgggtcttatggtcttcaaggctgaaggggtccacacgtccgccagactggtcgtgaccgagctgcctgtctcattttcccggcctctgcaggacgtcgttactactgagaaagagaaagttacgctggaatgtgagttgtcacgacctaacgtggacgtgcgatggctgaaagacggggtcgagttaagggctggaaaaacaatggcaatcgctgcacagggagcatgtagatccctcacaatctatagatgcgagttcgccgaccagggagtgtacgtctgcgatgctcacgatgcccagagttccgcttctgtgaaagtgcaaggacggacctacactttgatctacaggagggtgctggctgaggatgccggagagattcagtttgtcgcagaaaatgccgaatctagagcgcaactgagggttaaagaactgcccgttaccttggtccgaccattgcgggataagattgccatggaaaaacacagaggggttctggaatgccaagtcagtagagccagtgcgcaggtgagatggttcaagggatcgcaggaactgcaaccagggcctaaatatgagctggtatccgacggactatataggaaactgatcatcagcgatgttcatgccgaagacgaggacacatacacttgtgatgccggagacgtcaaaacttccgctcagttcttcgtggaggagcagtccatcaccatcgtcaggggactccaagatgtaaccgtgatggagcctgcgccagcatggtttgaatgtgagacatctattccctcggttcgccctcccaagtggttgcttgggaaaaccgtgttacaagcaggcggtaacgtcgggctcgaacaagaaggcaccgtgcaccggttgatgcttaggagaacttgcagtactatgaccggtccggtccacttcaccgtcgggaaaagtcgaagctccgctaggttagtggtgtctgatattccagttgtgctgacgcgacccctggagcccaagactgggagagaacttcagtccgtggtgctgtcttgtgactttcgcccagccccaaaggccgtgcagtggtacaaagatgacacgccccttagcccttccgaaaagtttaaaatgtccctcgaaggccagatggctgagctgcgaattctgcggttgatgccagctgatgctggagtctatcggtgccaagcgggaagcgcacacagctcaacagaagtgactgttgaagcgcgagaggttactgtgacaggtccactccaagatgcagaggcaaccgaagaggggtgggccagcttcagctgcgagctgagccacgaagacgaggaagtggagtggtcactgaacggcatgccactgtataacgacagctttcacgaaatctctcataagggcagacgtcataccctggtcctgaagtcaatccagagggccgacgcagggattgtgcgagccagtagtctgaaggtgtccacctccgcgagacttgaagtgcgggttaaacctgttgtatttcttaaggcactggatgacctttcagccgaggagcggggaaccctcgccctgcagtgcgaagtgagtgaccctgaagcacatgttgtgtggagaaaggatggagtccagctgggcccatctgataagtacgatttcctgcacactgccggtacacgcggtctggtggttcatgatgtgagcccagaggacgccggactgtatacttgccacgtgggaagcgaagagactcgcgcacgcgtgcgggttcacgacctgcacgtaggcatcactaaacgactgaaaacaatggaggtgctggagggagaaagttgctctttcgaatgcgttctcagccacgagagtgccagtgatcccgctatgtggactgttggcggtaagaccgtagggagctcttcacgctttcaagcaacgcgacaaggccgtaagtacattttggtggtaagggaggccgcaccatccgatgccggtgaagtagtgtttagcgtgcggggtttgaccagtaaggcaagccttattgtgagggaaagaccggctgctataatcaagccgctggaggatcagtgggtcgctccgggtgaagacgtcgagttgcgctgtgaactgtctcgtgcaggcaccccagtacactggctcaaggataggaaggccattagaaaatctcagaaatacgatgtggtttgtgagggtacaatggccatgctcgttataagaggagcttccctcaaggatgccggagaatacacctgcgaggtggaagcctcaaagtcgacagcaagtctgcacgtcgaagagaaggccaactgttttactgaagaattgaccaaccttcaggtggaagagaaggggacagcagtatttacttgcaaaaccgagcatccagctgctacagtgacatggcggaagggcctgctggagctgcgggcaagcggaaaacaccagcctagccaggaaggcctgaccctgcggctcaccatttcggctctcgagaaggctgacagcgacacttatacttgcgatatcggtcaggcccagtcccgcgctcagctacttgttcagggccgtcgcgtgcacataattgaagatctggaagatgtggacgtgcaagaaggatctagcgctacgtttagatgcagaatttctcctgccaattatgaacccgtacactggtttcttgataaaaccccattgcacgctaacgagctaaacgaaatagatgctcaaccaggcggatatcatgtgctgacactaagacagctagccctgaaagacagcggtaccatctacttcgaagcaggcgatcagcgggcatctgccgcactaagggtgacagaaaagccctcagttttttctcgagagttgactgatgccaccatcactgaaggagaggacttaacccttgtgtgcgagactagtacttgcgacatacctgtctgctggaccaaagacggaaagacgctgcgtggcagcgccagatgccagctctcgcacgaggggcacagggcccaactgcttataacaggggcaacactgcaggatagtggtagatataagtgtgaggcaggaggtgcatgctcatcttctattgtgagggtccatgccaggccagtaagatttcaggaggcactgaaagacctggaggtccttgaaggcggtgctgctacactgcgttgcgtcctatcatccgtcgcagctcctgtcaagtggtgttacggaaataacgtgctgcggccaggcgataaatactcactccgacaagagggcgctatgctagagttggtcgttagaaatttgcgtccacaggactcgggacgctattcttgtagctttggcgatcagaccacgtcagcaaccctaaccgtcacagctttacctgcccagttcatcggcaaactacgaaataaagaggcgacagaaggcgcaacagccaccctgcgctgcgaactgtccaaggccgctccagtggagtggcggaaaggctcagagacccttagagacggggaccgctattgccttagacaggacggagccatgtgtgagctgcagatcagaggtctcgctatggttgatgcggcagagtactcttgcgtgtgcggggaggagcggacaagcgcctccctcactatccgacccatgccggcacatttcattggaaggttgagacaccaagagtccattgagggcgctacagctacgctgcgttgcgaactgtctaaggcagcaccggtggagtggaggaaggggcgtgaaagcctgcgtgacggggacagacactctctgagacaagatggcgctgtgtgcgagctgcaaatctgcggcttagctgttgccgatgcaggggaatacagctgcgtgtgcggagaggagcggacttccgccacactgacagtaaaagctcttcctgcaaaattcacagagggactgcggaatgaagaagccgtggagggcgcaaccgcgatgctttggtgcgagttgtctaaagtagcgcctgtcgaatggcgaaagggcccagagaaccttcgcgacggggatcgctacattctgcgacaggaaggcacccggtgcgagcttcagatatgcggcttggctatggccgacgcaggcgaatatctctgtgtctgcgggcaagaacggacatcagctacgctgaccatccgcgctctgcctgctaggttcattgaagatgtgaagaatcaggaagcccgagaaggtgccactgccgtgctacagtgcgaactgaattcagctgcccctgtagaatggcgcaagggttcggagacactccgcgatggtgacaggtatagcttgcgccaggacggcacgaaatgtgaacttcaaatccgaggcctggctatggccgatacaggggagtattcctgtgtgtgcggccaagaacgtaccagtgctatgctgaccgtccgagcgctgcccatcaagtttacagagggcttaaggaacgaagaggccacagaaggagctactgccgtgcttagatgtgagctgagtaaaatggctcctgtggaatggtggaagggtcacgagacactgcgagatggggataggcatagcctgaggcaagatggcgcacgatgtgagctgcagatcagagggctcgtcgcggaggacgccggtgaatatctgtgtatgtgcggaaaagagcgaacgagcgcgatgcttactgttcgtgccatgccctcaaagtttattgaggggctcagaaacgaggaggccacagagggagatacggcaactctctggtgtgaactgagtaaggctgccccagttgaatggagaaaggggcacgagacgctcagggacggggacagacactctctccggcaagacggaagccgatgtgagctgcagatccgtggtctggccgttgtcgatgcgggagagtactcttgcgtgtgtggccaagagaggacatctgcaacgctcacagtgcgcgctctccccgctaggtttattgaagacgtgaaaaatcaggaggctagggagggggctacagccgtgctccagtgcgagctgtccaaggccgcacctgtagagtggcggaaaggctcagagactctacggggaggcgacagatactccttgagacaggatggcaccaggtgcgaattacagatacacggcctaagtgtggctgataccggggaatactcatgtgtttgtggacaggagcggacaagtgccaccctcacagttcgggctccccagccggtcttccgggaaccactccagagtcttcaggccgaagaaggctcaaccgctacccttcagtgtgaattgtccgagcctactgccaccgtcgtgtggtccaaaggcggactccagttgcaggcaaacggccgtcgcgagcctcggctccagggatgcactgccgagcttgtccttcaagatctgcaacgagaggacaccggagagtacacgtgtacatgcggatctcaggcaacttctgccactctgactgtaaccgccgcacccgtacgctttctaagggagctacagcaccaggaggtcgatgagggtggcactgctcatttgtgctgcgagctcagtagagctggtgcttctgttgaatggagaaaaggcagcctgcagctgttcccgtgcgccaaatatcaaatggtccaagatggagccgctgcggaacttcttgttagaggtgtggagcaggaggacgccggtgactacacttgcgacacaggacacacccaaagtatggctagtctgtccgtaagagtgccacgcccaaagtttaaaacccgcttgcaaagtctggaacaggaaactggcgatatcgcacgcctctgctgccagttgtcagatgctgaatcgggcgcagtggtgcagtggctgaaagaaggtgtggagctgcacgctgggcctaaatacgagatgcgaagtcaaggagctaccagggaacttcttattcaccaactggaagctaaggatacgggagagtacgcctgtgttaccggtgggcagaaaactgccgcatcgctgagagtgacagagcctgaggtcacgatagtcaggggactcgtcgacgcagaagtgaccgctgatgaggacgtagaattcagttgcgaggtgtccagagccggtgccaccggcgtgcagtggtgtcttcagggattaccgctgcagagcaatgaggtgacagaagtcgcagttagagacggcaggatacatactctgcgattaaagggcgtgactccagaagacgccggaactgtgtctttccacttgggcaatcacgccagttccgctcagctaacagtgcgcgcacccgaagtcaccatcctggagccactccaggatgttcagctcagcgagggtcaggacgcgtcattccagtgcagattgagtagggccagcgggcaggaggctcgttgggctctcggcggagtgcctttgcaggctaacgagatgaatgacatcaccgtagagcagggaacgttacaccttctgaccctgcacaaggttaccctcgaggacgcgggtacagtcagcttccacgtgggaacctgctcatcggaagcacagctgaaggtaacagccaagaataccgtggtgcggggactcgagaatgtcgaagctttggaaggcggagaagctctctttgaatgtcagctctcacagcctgaggtcgcagcccacacctggctactggatgacgagcccgtgcatacatctgagaatgccgaagtggttttctttgagaacggtctcagacatctgcttctgttgaagaacctccgtccccaggatagctgccgcgttacatttttagccggtgatatggtcacatctgcgttcctgaccgtccgcggttggcgtctggagatccttgagccgctgaagaatgccgctgtgcgagctggggctcaggcctgcttcacttgcaccctaagcgaagcagtgcccgtgggtgaggcatcttggtatatcaacggcgctgccgtccagcccgacgattccgattggacagtgaccgcagacggatcacaccatgccctgcttttgcggagcgcccaaccacaccacgcaggagaggtcacctttgcttgccgagacgctgtcgcatcagctcggctcacagttcttggcctcccagatccacccgaggatgcagaggtggttgcaagaagctcccatactgtcacattgtcttgggccgcaccgatgtctgatgggggaggagggttatgtggatatagggtggaagtgaaggagggagcaacaggccagtggcggctttgtcacgagttagtgcctggacctgagtgtgtagtggatgggctcgcccctggcgagacttacagatttcgcgtcgccgctgtgggccctgtgggcgcaggtgagcctgtccatctgccacaaaccgttcgcctagccgagccgcctaagcccgtgcctccacagccgtccgcccctgaatcaaggcaagtggctgccggagaagacgtctcacttgagctggaagtcgtcgctgaggccggtgaggttatctggcataagggcatggaaaggatccaacctggaggtcgcttcgaagtggtgagtcaagggagacaacagatgcttgtgatcaaaggtttcacagcagaagatcagggtgagtatcattgtggattagctcagggttccatctgccctgctgcggcaactttccaggtcgcgcttagtcccgcatcggtcgacgaagcccctcagccttctctcccgccagaggctgcccaggagggcgatctccacctactgtgggaggcccttgcacgcaaacgcaggatgtctcgcgagcccacactggacagtatctctgagctcccggaggaggatggaagatcccaaaggctgccgcaagaagctgaggaagttgcacccgatttatcagaaggatatagcaccgctgatgagcttgccagaacaggggacgctgacttgtctcacacatccagcgatgatgagtctcgcgctggaacgccaagcttagtgacctacctgaaaaaggccggacgtccaggcacttcgccattggcatccaaagtgggtgcccctgcagcacccagcgtcaagccgcagcagcagcaggaacctttggctgccgttaggccacctctgggcgacctctcgaccaaggacttgggagatccgagtatggacaaagccgctgtcaagatccaggccgctttcaaaggttacaaggtgcgcaaagaaatgaaacagcaagagggccctatgttttcccacacgttcggagatacagaagcccaggtgggtgacgcactcaggttggagtgtgtggtggcgtctaaggctgatgtgcgcgctagatggttaaaggatggggttgagctcaccgatggcagacaccaccacattgatcagttgggagacgggacctgctctctgttaattaccgggcttgacagagccgacgcaggctgctacacctgtcaagtttccaataaattcgggcaagtgacccactctgcctgcgtggtcgtctcaggatccgaatccgaggccgagagttcatctggaggcgaattggacgatgctttccgaagagccgctcgcagactgcataggctctttcggactaagtctccagccgaagtgtctgacgaggagctttttctgagtgccgacgaagggccagcagagccagaggaacctgcagattggcagacataccgcgaggacgaacactttatttgtatcagatttgaagcacttacagaggcccgtcaggctgtgacacggttccaggagatgtttgctacactgggcattggtgttgaaattaaactggtcgagcagggccctcgacgcgttgaaatgtgtatttccaaggagaccccagcccctgttgttccgcctgagccattgccctccctgcttacttccgatgccgcacccgtttttctaaccgaactgcaaaatcaggaagtgcaggacgggtaccccgtttccttcgactgcgttgtgactggccagccaatgccttccgtcaggtggttcaaagacggaaaactcctcgaggaagatgaccactacatgattaatgaggaccagcagggaggacatcaactcatcattaccgcagttgtccctgcggatatgggcgtgtacagatgcctggcagaaaacagtatgggagtttcctcgacgaaggccgagcttagggttgatttaaccagcactgactatgatacagccgcagacgctaccgagtcaagctcgtatttcagcgcccaaggctatctgagcagcagggagcaggagggcacggagagcacaacagatgagggtcagttgccacaggtggtcgaggaactgcgggatctccaggtcgcacctggaaccaggctagcaaagtttcaactgaaggtcaagggctatcccgcacccaggctgtattggtttaaggatgggcagcccctgacggcttccgcccacatacgaatgacagataagaagattctgcacaccctggagatcatatccgttacccgtgaagactccggacagtatgccgcatatattagcaacgccatgggggctgcttacagcagcgctaggctgctggtccgtggtccggacgagcccgaggagaagccagcaagcgacgtacacgagcagcttgtgccacctcggatgttggagcggtttacccctaagaaggtgaagaaaggttctagtattaccttttctgtcaaagtggagggaagacccgtgcctacagtccactggctgcgagaagaggccgagaggggagtgctatggatcggcccagacacacctggctatacagtcgcttcctccgctcagcagcactctctggtgctgctagacgtgggcagacagcaccagggcacgtacacatgcatcgcctcaaacgccgctggccaggccctctgttcagcctctttgcacgtctctggccttcctaaagttgaagagcaggaaaaggttaaggaggccctgatctccacgtttctacagggtactactcaggctattagcgcacaggggctcgagacagctagtttcgccgaccttggcggacagagaaaagaggagcccctggccgcaaaggaggctctcggtcatctgagcctagctgaggtcgggactgaggagtttctacagaagctcacatcccagattacagaaatggtctcggccaaaatcacccaagctaaattgcaggttcccggaggtgattccgatgaagattccaaaactccttcagctagccccaggcatggacggtcacgcccatcttcctctattcaagagagcagctcagaaagtgaggacggagacgcgcgtggggagatctttgatatctatgtagtcacagccgactatctaccacttggtgctgaacaggacgcaattacactgagggagggacagtacgtggaggtgctggacgctgcacacccactgcggtggctggtaagaaccaagcctaccaaatccagcccctcccgtcagggatgggtgtcacccgcttatctcgataggaggctgaagctttcccccgagtggggcgcagccgaagccccagagtttcctggagaggccgtgagtgaagacgagtataaggccaggctgagctcagtcattcaggagctcctgtcatcagaacaggcctttgtggaggagctgcaattcctccagagccaccacctgcagcatcttgaacgctgccctcacgtacccattgcagttgccggacagaaggccgttatcttccggaacgtgagggatattggacgctttcattcatcttttctgcaagaactccaacagtgcgacaccgacgatgacgttgccatgtgctttatcaagaatcaggctgcttttgagcagtatctcgaattcctggtagggagagtacaggcagagtctgtggtggtctccaccgctattcaagagttttacaagaagtacgccgaggaggcgctcctggcaggcgatcctagtcagcctcctcctcctcctctgcagcactacttagaacaaccagtggagcgagtgcagcgttaccaagctcttcttaaggagctcatacggaacaaagccaggaaccgacagaactgtgctttgctggagcaagcttatgccgtcgtttccgccttgcctcagcgcgctgagaataagctgcacgtgtctctgatggagaattatccgggaaccttacaggccctgggggaaccgataaggcagggacacttcatcgtgtgggaaggtgccccaggggctaggatgccctggaagggacataacaggcacgtttttttattcaggaaccacttggtcatttgcaagccgagaagagattcaaggaccgataccgtgagctatgtgtttcgaaacatgatgaagctgtcctcaattgacttaaacgaccaagttgaaggcgatgacagggccttcgaggtatggcaggagcgcgaagattctgtcagaaagtacttacttcaagccaggacggcaatcattaagtcatcttgggtcaaggagatttgcggaatacagcagagactcgccctccccgtgtggcggcctcccgatttcgaggaagagctggccgactgcaccgcggaactgggtgagactgtgaagctagcatgtcgggttaccggaactccgaaacccgtcatctcctggtacaaggacgggaaggcagtacaagtagacccgcaccatattctgatcgaggacccggatggctcctgcgccctgatcctggactctttaaccggcgtcgacagcgggcaatatatgtgttttgctgccagtgctgcaggaaactgctcaactttagggaaaattttagtgcaagtaccacctcggtttgttaacaaggtgcgggcttctccattcgtggagggggaagacgcccagttcacttgtactatagaaggggcaccttatccccaaatcaggtggtataaagatggcgctttgttgactacgggcaataaattccagactctctcagagccacgctctggcctgctggttcttgtgatacgcgcagcttctaaggaagatctgggcctctacgagtgtgagttggtaaatagactcggaagcgccagggcctctgctgaactcaggatccagtcccccatgctccaggctcaagaacagtgtcacagagagcagttagtggcagccgtcgaggacacgactttggagcgggcagaccaggaggtcacctcggtgttaaaacgactgctggggccaaaagcacctgggccatccaccggcgacctcaccggccctggaccctgtccacggggtgccccagccctgcaggagaccggcagtcagcccccagtcactggtacatcagaggctcccgctgtccccccacgggtcccccagcccctgttgcacgaaggaccagaacaggagccagaggctatagcacgcgctcaggaatggacagttccgatcaggatggagggcgcagcatggcctggagcgggaacaggcgagctgctttgggacgttcacagtcacgtggtgcgagagaccactcagagaacctatacttaccaggcaatcgatacccacaccgctcgccctcccagcatgcaggttacaatcgaagatgtgcaggcccagactgggggtaccgcccagttcgaagcaataattgagggggatccccagcctagcgtcacctggtataaggattctgtccagttagtggattctacccgactttctcaacaacaggagggtaccacctattcattggtcctgaggcacgtggcctccaaagatgcgggagtctacacatgcctagcacaaaacacggggggacaggtcctgtgtaaagccgaattactcgtactgggcggtgacaacgagcctgattctgaaaagcaaagccacaggaggaaacttcatagcttctacgaggtcaaagaggagattggccgtggggtattcggtttcgtgaaacgggtacagcataaaggaaataagattctttgcgccgcaaagtttatccctctgcggagccgtacacgggcacaggcatacagagaaagggatatactggcagccctgtcacaccccctcgtgaccggcctgttggaccagttcgaaacccggaaaacactgatccttattttagagctatgcagttcggaagagctactggatagattataccgtaagggtgtcgtgaccgaagcagaggtgaaggtgtacattcaacaactggtggaaggcctacactacctgcacagccacggagtgctccatctggacataaaacccagtaacatcctaatggttcatccagcacgtgaggacattaaaatctgcgactttggctttgcccaaaacattacacctgcagagctccagttctcccagtacggctccccagagtttgtatcccccgagataatacagcagaaccccgtcagcgaggcctccgacatctgggcaatgggcgtgattagttatctgagtctcacatgcagctctccctttgcaggcgaatctgaccgggcaaccctcttaaacgtcctcgaaggccgagtctcatggtcctcaccaatggccgctcacctttcagaggacgctaaggattttataaaggctacactacagcgggctccacaggccaggccatctgctgctcagtgcttgagtcacccctggtttcttaaaagcatgcccgcagaagaagctcacttcataaacacgaaacagctcaagttccttctcgcaagaagtaggtggcaaagatcattgatgtcttataaaagtattctagtcatgcgcagcatcccggaactcttgaggggtccacccgattccccatcactcggcgtagcgagacacttgtgtagggacacgggtggatcttcatctagcagctcaagcagtgacaatgagctcgctccatttgcgcgtgcaaagtccctgcctccgtctcccgtgactcactccccactcttacatccccgaggattccttcgcccttcagcttccttgcccgaagaagctgaagccagcgagcgcagcaccgaagccccagcccctcccgctagcccggagggagccggacctcccgctgcacagggatgcgtgccgaggcacagtgtcatacgatccctcttctatcaccaagctggtgagtctccagagcatggggctctggcaccaggaagcaggaggcaccccgctaggcggagacacctgctcaaaggtggatacatcgcaggagcactgccaggtttgcgcgagcctttaatggagcacagggttctcgaagaagaggccgcacgcgaggaacaggccactctgctcgcaaaggcccctagtttcgaaaccgccctccgtctgcctgcaagtggcacccacctggctccaggacacagccacagtttagaacatgattccccctccactccccgaccctcttccgaggcttgtggtgaggcccaacggcttccctctgccccatccgggggagccccaattcgggatatggggcatcctcaagggtctaagcaattgccctctaccgggggacacccagggacagcacaacccgagaggccttcgccggattcaccctggggacagcctgcgcctttctgtcacccaaaacaaggcagcgctccgcaggagggatgttctccccaccccgctgtggccccttgccccccaggatcttttccacccggatcgtgtaaagaggccccactggttccgagcagtccctttcttgggcagcctcaggcaccacctgccccagcgaaggcctcccccccacttgattctaaaatgggacctggcgatatttctttgcctgggcgtcccaaaccaggcccatgctcctcacctggtagcgcaagtcaggcatcctcatctcaagtgtctagcctacgcgtagggtcaagccaggtgggcaccgagcctgggcctagcctggatgccgaagggtggactcaggaggctgaggacctgagcgacagtacccctaccctccagcgccctcaggaacaagccacgatgagaaaatttagcctgggaggcaggggaggctatgcgggagttgcagggtatgggacattcgccttcggtggggacgcaggcggaatgttgggtcagggcccaatgtgggctcggatagcttgggcagtctcacaatccgaggaggaggagcaggaggaggcccgagctgaaagccagagtgaagaacaacaggaagctagggccgagtctcccctgccacaggtgtcagcccgaccggtgcctgaagttggaagagctcccacacgaagttccccagagcccactccctgggaagatatcggccaggtgtccctggtccaaatacgggatctcagtggtgatgctgaggccgcagacactattagcctcgatataagtgaggtggatcccgcttatctgaacttaagcgatctgtatgacataaaatacctacctttcgaatttatgatctttcgaaaagtcccgaagtcggcacagccggagcctccctcgcccatggcagaagaggaactcgcagaattcccagagccaacctggccatggcccggtgagttgggacctcatgccggtctggaaattaccgaggagagcgaagacgtggacgccctgctcgctgaggctgcagtgggaagaaagaggaaatggagttcgccctctagatctctgttccacttcccaggcaggcatttgcctcttgacgagcccgctgaactcgggctgcgagagagggttaaggcttcagtggagcatataagccggattctgaaggggaggccagagggtcttgaaaaggaaggccctcctcggaaaaagcccggtctcgctagctttagactgtctggcctgaagtcatgggatcgcgcacccacctttctgagggagctgagcgacgagacagtggttctgggacaatctgttacactggcctgtcaggtgagtgctcagccagccgctcaggccacgtggtcgaaggacggagcaccgctggaaagcagctcaagggtcttaatcagcgcaacactgaagaatttccagctcttgacaatcctcgtcgtcgtggctgaggacttgggagtgtacacttgctctgtgtcaaacgctctaggaacagtcacgacaacgggcgtcctgaggaaagccgagcgcccttcgagcagcccttgtccagacattggggaggtgtatgccgacggagtcctgctagtatggaaaccagtcgaatcgtacggcccagttacttatattgtgcaatgctctctggagggaggcagctggaccaccttagcctcagatatctttgactgctgctatctcacctccaagttaagccgtggcggtacctacacctttagaaccgcctgcgtgtctaaggcgggtatgggcccatattcttccccctcggagcaggtcttgttggggggaccctctcacttagcttcggaagaggaaagtcaggggcgttcagcacagccactgccgtcgaccaagactttcgccttccagactcagatacaacgtggcagatttagcgtggtcaggcagtgttgggaaaaagcctccggtcgggcactcgcagcgaaaatcatcccttatcacccgaaggacaagacggcagtgttaagggagtatgaggccttaaagggacttcgccaccctcatctggctcagctacacgccgcatacctctcccctcggcacctggtgctgatcctggaattgtgtagcggtcctgagctgctgccttgtctggctgaaagagcatcctacagcgagtcagaggtgaaagactacctgtggcagatgctgtctgctacacaatacctgcacaatcagcatattctccatctggacctcagatccgagaatatgattatcaccgagtataacctgctgaaggtggtggacctggggaacgcccaatccttgagccaggaaaaggtcttaccttccgataaattcaaggactacctggagactatggctcccgagctcctggaaggacagggtgctgtgccccagactgacatttgggcgattggcgtgacagcgtttatcatgctgagtgccgagtaccccgtttcctcagaaggtgccagggatcttcagagaggacttaggaaagggctggtaagacttagccggtgctatgccggtctctctgggggtgctgttgcattcctccgctccaccctgtgcgcccagccgtggggtcgtccttgcgcctcgagctgtctccaatgtccgtggctcaccgaggagggccctgcttgctcccgcccagcccctgtgacgttccccacggctagactgagggtgtttgttcgcaaccgcgaaaagcgcagggcgctcctctacaagcgccacaatctcgcacaggtcagatag

SEQ ID NO: 30011 - DNA, 750 bp, Artificial Sequence
  Description of Artificial Sequence: Synthetic coding sequence
atgactgaggattctcagcgaaactttaggagtgtgtactatgaaaaagtcggttttcgcggagtggaggaaaagaaatccttagagatactgcttaaggatgacaggctcgatactgaaaagctgtgcacctttagccagcgctttccgttgcctagcatgtacagggcactggtgtggaaggtgctcctgggaattttacctcctcaccacgagtcccacgctaaggtaatgatgtacagaaaggagcagtatcttgacgttctgcacgccctcaaggttgtgaggttcgtgagtgatgctaccccccaggctgaggtctatctgcgcatgtaccagcttgagtctggtaagttaccaagatccccctccttccccctagagcctgacgatgaggtgttcttagcgatcgccaaagccatggaagagatggttgaagactcagtggattgttactggattacccgacggtttgtaaaccagctgaatactaaatacagagactctctcccccagcttccaaaagcttttgaacagtacttaaacttggaagacggtaggttgttaacacacctacgcatgtgcagcgctgcccctaagctcccttatgacctttggttcaagcggtgcttcgcagggtgcctgcctgagtcgtccctgcagcgagtttgggacaaggtcgtctctggcagctgcaaaattctggttttcgtggccgtggaaatcctactaacattcaaaatcaagtag

SEQ ID NO: 30012 - DNA, 417 bp, Artificial Sequence
  Description of Artificial Sequence: Synthetic coding sequence
atgtcgtcccttggtgccagctttgtccagattaaatttgacgacttacagtttttcgagaattgtggcggaggttccttcgggtccgtgtacagagcaaaatggataagtcaggataaggaggttgccgttaaaaagctgctgaaaatcgaaaaggaggctgaaattctgagcgtgctgtctcatcgaaatatcatccagttctatggtgtgatactggagcctcccaattacgggattgtaactgagtacgctagtttgggtagcctttatgactacattaacagcaatcggagcgaagaaatggatatggaccacattatgacatgggccacggatgtcgcaaagggcatgcactacctccacatggaggcccctgttaaggtgatacacagggacctgaaatccagaaattag

SEQ ID NO: 30013 - DNA, 1122 bp, Artificial Sequence
  Description of Artificial Sequence: Synthetic coding sequence
atggcatccagttccgtcccgccagctacagtttctgcggctactgctggtcccggtccaggcttcggcttcgctagtaagactaagaaaaagcactttgtgcagcaaaaggttaaggtgtttcgagccgcagaccccctggtgggggtgtttctgtggggcgtcgcccactctattaacgagctgtcgcaagtgcctcctcccgtgatgctgctgccagacgactttaaggcgtcatccaagataaaggtgaacaatcatctattccacagagagaatttgccctctcacttcaaattcaaggaatattgcccacaggtctttcgcaacttgagagacagatttgggatcgacgatcaagattatctttacatcgtcaagtgtcatggtaatactctgcttccgcagttccttggcatgtatagggtttcggtagacaacgaagactcttacatgctggtgatgcgaaacatgttcagccatcgtctcccggtacaccgcaaatatgatttgaaaggctcccttgtttcaagagaagcgtcagataaggagaaagtgaaggaattgccaactctcaaggacatggacttcctaaacaagaaccagaaggtgtacatcggagaggaagaaaaaaagatttttctcgagaagcttaaaagagacgtcgagtttcttgttcagctcaagattatggattacagcctcctgttggggatccatgacatcattcggggatcagagcccgaagaggaggcaccggtgagagaggacgaaagtgaagtggatggagattgctctctcacagggcctcctgctcttgtcggctcttacgggaccagccccgagggaattggaggttatatccactctcatcgcccacttggccctggggagtttgagagttttattgatgtatacgccatccggagcgccgaaggcgcacctcaaaaagaagtttatttcatggggcttatcgatatcctcacacaatacgacgcaaagaaaaaggctgcccatgcagctaaaacggtgaaacacggggctggcgcagagatttctacagtgcacccagagcagtatgccaagcgcttcctggatttcataactaatatctttgcatag

SEQ ID NO: 30014 - DNA, 549 bp, Artificial Sequence
  Description of Artificial Sequence: Synthetic coding sequence
atggaggaaatccccgctcaggaggctgccggatctcctcgggtccaatttcaaagcctggaaacacagtcagagtgcttgtcacccgaaccgcagttcgtccaggacaccgacatggaacagggattaacaggtggattccctatttctaagccagacggaatctcacagctcgagcaagatctgcaagtcttcgacctcgagactaagactcgcgaggtgctgcgagacgactgtagtgacggggagactagagaagaaaataagctgctgatccctaaacagaaaatcagcgaggaagttcacagctataaagtcagagtgggcaggctgaaacatgacatcacccaggtcccagaaacccgggaagtgtataaaagcgaggaccgtctagagcgcttgcaggagatactgagaaaatttctttatttagaacgggagttccgtcaaattaccattagcaaagagactttcacgagtgaaaagaacaatgagtgtcatgaacctgaaaagtcattcagcctggactctaccatcgacgctgactag

SEQ ID NO: 30015 - DNA, 2253 bp, Artificial Sequence
  Description of Artificial Sequence: Synthetic coding sequence
atgtctttgggcaaagcatacggcgtcgagagccacgttttgtcccccgctgagaccaagaccttgtaccccttgatgaatgtcgacgacctgtacggcacactttatgttccgcacgacggaaccatggaccctgcaggcacttgtacaactctggccagggccgctagcgcaaggggcgcacaggtaattgaaaattgtccagtcacaggcatcagagtgtggacggacgatttcggagtgcgccgagtggctggcgttgagacacagcacggctcaatccagacaccatgtgtcgtgaattgcgctggagtatgggccagcgccgtgggacgcatggccggtgtgaaggtgccacttgtcgctatgcaccatgcctatgtggtcaccgaacgcatcgagggcatccagaacatgccgaacgtccgggaccacgacgccagcgtttacctgcgtttgcagggggatgctctctcagtgggcggttacgaagctaaccctattttttgggaagaggtgagcgacaaattcgccttcggcctgtttgatctggattgggaagtgttcactcagcacatcgaaggcgcaattaaccgtgtgcctgtcctcgagaagacgggcattaagagcacggtctgcggacccgagtcatttaccccggaccataaaccgctcatgggagaggctcctgagctccggggttttttcctcgggtgcggcttcaacagcgcaggcatgatgctgggcggtggctgcggtcaagaactggctcactggatcatacacgggagaccagagaaagacatgcatggctatgatattcgtagattccatcattccctgactgaccaccccaggtggattagagaaaggtcccacgagagttatgctaagaactattctgtggtattccctcatgatgagcccctcgcaggcagaaatatgaggcgggaccccctgcacgaggagctgcttggacagggttgcgtgttccaagagaggcatggttgggagagaccagggtggttccatcccaggggcccagccccagtcctcgaatatgactattacggagcctatggttccagagctcatgaggattatgcgtacaggcgacttcttgccgatgagtataccttcgcgtttccaccgcaccacgacacaataaaaaaagaatgtctggcttgccgaggcgcagctgccgtttttgacatgtcttatttcggcaaattctatctcgttggactagatgctagaaaggccgcagactggctgttcagcgccgacgtgagcagacctcccggatccacagtgtacacctgcatgctgaaccaccggggtggtactgagtccgatttaaccgttagtcgcttagccccttcccaccaagcatcccccctcgccccagcctttgagggggacggctattacctggccatggggggtgccgtggcacagcataattggagccacataacaacagtcttacaagaccagaaatcccaatgtcagttgattgactcgagtgaagacctaggaatgatttcaatccagggccctgcgtccagggcaatcctacaagaagtccttgatgcagacctgagcaatgaagcatttcccttttctactcataaactcctccgggctgctggccacctggtaagagcaatgcgtctgagtttcgtgggcgagctcggatgggagcttcatattcccaaggcaagctgcgtgcccgtataccgggctgttatggccgctggcgcaaagcacggcttaattaatgctggctatcgggcaatcgattctctttctatcgaaaaaggctataggcactggcatgcggacctgcgtcctgatgattcccctctcgaggccggactggcattcacgtgtaagcttaagagcccggttccctttctaggccgtgaggccttggagcagcagcgcgctgcgggtctccgaaggcggttagtttgtttcactatggaggataaagtgcccatgtttggccttgaggccatttggaggaacgggcaagtggttggccacgtgagacgcgcagatttcggatttgccatcgacaagaccatagcatatggttacattcatgatccttctggcggtcctgtgtctctcgactttgtgaagtccggcgattacgcccttgaacggatgggtgtgacttacggagctcaagctcatttgaagtcccccttcgaccctaataacaagcgggtgaaggggatctattag

SEQ ID NO: 30016 - DNA, 459 bp, Artificial Sequence
  Description of Artificial Sequence: Synthetic coding sequence
atgtccgtcacatacgatgacagcgtaggagtggaagtgtctagcgattcattttgggaggtcggaaattacaagcgcacagttaaacgcattgacgatggccatcggttgtgcagcgacctgatgaattgtctgcacgagagggcacgcattgaaaaggcgtacgcacagcagctgacagagtgggcacgcaggtggcggcaacttgtggaaaagggtcctcagtacgggaccgtggagaaggcttggatggcctttatgagcgaggccgagcgtgtgtccgaactgcatctggaagttaaagcctctctgatgaatgatgattttgagaagatcaaaaactggcagaaggaggcctttcacaagcaaatgatgggcggattcaaggaaacgaaggaagctgaggacggctttcggaaggctcagaaaccttgggctaagaagctgaaggaggtgtag

SEQ ID NO: 30017 - DNA, 1620 bp, Artificial Sequence
  Description of Artificial Sequence: Synthetic coding sequence
atggccacatccgcacctctccggtcactggaggaggaagtgacatgctccatctgcctcgattacctccgagaccctgttaccattgattgcggccacgtgttttgccgatcttgtaccacagacgtgcgccctattagcgggagccgccctgtgtgtccactctgcaagaagccctttaagaaggagaacatcagaccggtgtggcagcttgcatccctcgtggaaaacatcgaaaggctcaaggtggacaaggggcgacagccaggagaggttactcgcgagcagcaggacgccaagttatgcgagcggcatagggagaaactccactactactgcgaggatgacgggaagttactgtgcgtcatgtgccgagagagcagggagcaccgtccccatactgccgtgctcatggagaaggcagctcagccccaccgcgaaaaaatcttaaaccacctgtctaccttaaggagggaccgcgacaaaattcaggggtttcaggcaaagggagaagccgatatactggcagccctaaaaaagctgcaggatcagagacagtatattgtcgctgagttcgagcagggccaccagttccttagggagagggaggagcatctgctcgagcagctcgccaaattagagcaggagctaacagaaggcagggagaaatttaaaagcaggggggtaggggaactcgcccgactggcgctggtgatttcagaactcgagggaaaggcccagcagcccgctgctgagctgatgcaggacacccgcgattttctgaataggtaccctaggaaaaaattttgggtgggaaaacccattgccagggtcgtgaagaaaaagactggcgagttttcagataagttgctctccctgcaaagaggcttaagagaatttcaagggaaactcctgagagatttggaatacaaaactgttagcgtgacactggacccgcagagcgcgtctggatatctgcagttgtctgaagattggaaatgtgttacgtacacctcactctataagagtgcctatttgcacccacagcagttcgattgtgagcccggagtattaggcagcaagggatttacgtggggcaaagtttattgggaggtggaagtcgagcgggagggatggagtgaagacgaagaagagggcgatgaagaggaggaaggagaagaagaggaagaggaggaggaagcagggtacggggatggatacgacgattgggaaaccgatgaagacgaggagtctctgggggacgaagaagaggaggaggaagaggaagaagaagaagtgctggagagctgcatggtcggggttgctcgcgactccgtcaagagaaaaggggacctgagcctgaggcctgaggatggtgtctgggcactgagactgtcttctagtggcatttgggccaacacgtcaccagaagccgagctcttccccgctctgaggccaaggcgtgttggcattgctctggactacgaaggcggaacagtcaccttcaccaatgccgaatctcaggagctcatttacacattcactgcaacttttactcggcgtctggtgccttttctgtggcttaaatggcccggaacacggctcctgctgaggccctag

SEQ ID NO: 30018 - DNA, 1266 bp, Artificial Sequence
  Description of Artificial Sequence: Synthetic coding sequence
atgatggaggacaataagcagcttgcgctcaggatcgatggagctgtccagtctgcttcacaagaggtcacaaacttaagggccgaattaaccgcaaccaatcgacggttggccgaactatcaggcggtggcggtcccggacccggacctggcgcagcggctagcgcatctgccgctggagattcagcggcaacaaacatggaaaaccctcagctgggcgctcaggtgctgctgagggaggaagtgtcaagactccaggaagaagtacacctgctgagacaaatgaaggagatgctggccaaagatctagaagagtctcagggcggtaagagctccgaagtgttaagtgcgaccgagctcagggtgcaactggcacagaaggaacaggaacttgccagagccaaggaagctctgcaggctatgaaggcagatcgcaagaggctcaagggcgagaagacagacctggtgagtcagatgcagcagctgtatgcaaccctggaaagtagggaggaacagctgcgtgactttattaggaattatgagcagcatagaaaggagtctgaagacgccgtaaaggcccttgccaaagagaaagacctgctggaacgggagaaatgggaattgagaagacaggccaaggaggctactgatcacgcgacagccctgaggagtcagttagaccttaaggacaatcgaatgaaagaactggaggctgagctcgctatggccaaacagagtctggccacactcaccaaggatgtgcctaaaagacatagcctggccatgcctggggaaacagttctcaatggtaatcaggaatgggtagtgcaggccgacctgccgctcaccgccgctatcagacagagccaacagaccttgtatcattcccatcccccacaccctgccgaccggcaagctgtgagagtgtcaccatgccatagcagacagccatcagtgatctccgatgccagcgctgccgaaggcgaccggagcagtacaccgagtgatattaactcacctaggcaccgaacgcactcactgtgcaacggggactctccaggcccagtgcagaagaatctgcataatcctattgttcaaagtcttgaagatctcgaggaccaaaaacgcaaaaagaaaaaggagaagatgggtttcggtagtatcagtcgagtcttcgcgagaggaaagcagagaaagagtctcgatccaggactcttcgacgggacggctcctgactattacatcgaggaagacgccgattggtag

SEQ ID NO: 30019 - DNA, 492 bp, Artificial Sequence
  Description of Artificial Sequence: Synthetic coding sequence
atggtgggtggcggaggcgtgggtggcggtttattagaaaatgccaacccactgatttatcagaggagcggagaacgaccagtgacagcaggtgaggaggatgaacaagtgcctgacagcatagacgccagagagatctttgatttgattcgaagcattaatgaccccgagcatccactgacattggaggaattaaatgtggtggagcaagtcagagtgcaggtctctgacccagagtccacagttgcagtggccttcaccccaactatccctcattgttcaatggctactctgatcggcctgtctatcaaagtcaagctgctccgtagcctaccccaacggtttaaaatggatgtacacatcacgcccggaacccatgcttctgaacatgccgtgaataaacagctggcagataaggaacgagtcgccgcagccctggaaaacacacacttgctggaggtggtgaaccagtgtctcagcgccagatcttag

SEQ ID NO: 30020 - DNA, 207 bp, Artificial Sequence
  Description of Artificial Sequence: Synthetic coding sequence
atgagtatctcatccgatgaagtgaactttttggtttacagatacctgcaggagagcggcttcagccatagcgcattcacctttggaatcgagtctcacatctcccagtccaatatcaacggcgcactggttccgcctgccgcattaattagcattattcagaaaggccttcagtacgtggaggccgaggtttcaatcaatgaatag

SEQ ID NO: 30021 - DNA, 534 bp, Artificial Sequence
  Description of Artificial Sequence: Synthetic coding sequence
atgtcctccaacgaatgttttaaatgcgggaggagcggtcactgggccagagagtgtcctacaggcggagggaggggcagagggatgcgctccagaggcagggggggattcactagcgacaggggatttcagtttgtgtcgagctccctgccagatatctgttatcgatgcggagagtccggacatctcgcaaaggattgcgacctgcaagaggacgcatgctacaactgtgggaggggaggtcacatcgccaaggattgcaaggagccgaagcgcgagagggagcaatgctgttacaattgtggaaaaccaggacatctcgcccgagactgtgatcatgcagacgaacagaaatgctactcttgcggagagtttgggcatatccagaaagactgcaccaaggtcaaatgttatagatgtggcgaaacaggccatgtggccattaattgtagcaaaacgtcagaggttaactgctatagatgtggagagtcaggccatctcgctagagaatgtactatcgaggcgaccgcttag

SEQ ID NO: 30022 - DNA, 429 bp, Artificial Sequence
  Description of Artificial Sequence: Synthetic coding sequence
atgacccagcttcggcaggtccttgagtccagattgcaacgccctctccccgaggatttggcgaggctttggccagttgtgatcctctgtcagcttgccaatcagctgagacctcgatcggtgccattcattcatgtgcccagcccggctgtcccaaagcttagtgcactcaaggctaggaagaatgttgagtcgtttcttgaggcttgtcgtaagatgggcgtgcccgaggcggacttgtgctcaccgtctgatctgctgcaaggaacggctagaggcctgcgtaccgcactggaagctgtaaagcgggtgggcggaaaagcccttcccccattatggccaccttccggattgggcggttttgtcgtgttctatgtggtgctgatgttgcttctgtatgttacttatactcggctgttggggtcttag

SEQ ID NO: 30023 - DNA, 1296 bp, Artificial Sequence
  Description of Artificial Sequence: Synthetic coding sequence
atggaggacttgaagggcccaacggtatccagctttttaagcggaatgaaaaccgaactgtatcctggcgtgaccgcaatcgatatgatgtataaggagggtctgcacggggtcgataacggaatcctgatcttcgataaagtcaggattccaagggagaatctgctggataagttcggatcagtcgctccagatgggcagtaccatagtccaatacgcaataaatcggcccgtttcaacgctatgctcgcagcactaactccctcgaggttggcagtggcgtttcaggctatgggtgctatgaagctgggcctgacaatagctatccgttactctcactccagacggcaattcggcccaaagaccaaagaggaggtaaagatcattgaacaccaaacgcagactctcaggcttatgcctcatctcgcaactgccctagcgctcacgtttgtgagtcgctatgccggtgcccttctggatgaggacgtgtttcagggcaaagaactggtgaatagccgcagcttgcaagcactagtagcaggtctgaaagcctattcgacatgggagaatatacgctgcctccaggattgccgggagtgcaccggtgggatggttgtaggccgtgagttgctggcccaatacaccaagcagtacgaggaaaagccactgtttggattactgcagaactgggcagaaagcgtcggggataagctgcggactagttttcttgcctttaacatggacacggttgatgatctggctttccttctgaaggctgtgaaattcagagaacgggttctgcaacggggattggtggctcgtatatactataaagttaagaccaaaaaagaggatttctttcacgcctggaacagttgcctgcatcatgtcgcttctctaagtctggcccacactcaccgagtgactctggagcagttctcgctggcagtgaagagctgtcccgaccaggaggaccagaccctgttaatgaagttttgtcttctctacggaacgaagcttgtgttccaggaacgggcttggtatctggagcataagtacttgacccccatggcctccaccaggattcgaaaccagcttctggacctgtgtgatagcgttaaggatgatgcaagacgcgtgatatcaacgttcaatatcccacatacttacttgcacgccccaatcgccggaatctccaatcccagggcagcatgggcgttttatcctgcgcctctccagcccagaccgagggaggaagctaggagcagacgccctaaactcggggcaaaactgtag

SEQ ID NO: 30024 - DNA, 1443 bp, Artificial Sequence
  Description of Artificial Sequence: Synthetic coding sequence
atggcagagctgcagatgctcctagaagaagagatacccggaggccgtagggctttgtttgactcctacacaaacctggagagagtcgcagattattgcgaaaacaactacatccagagcgcggataaacaaagagctctggaagaaaccaaagcctatacaacacagtctcttgctagcgtggcttaccttataaacacactggctaacaacgttttgcagatgctggacatccaggccagtcagttacggaggatggaatcttcaattaatcacatctcacagacagtagacattcacaaggaaaaagtggccaggcgggaaatcggaattctgaccaccaataaaaacacctcacggacgcacaagatcattgcacctgctaacctggagcgtccagtgagatacatccgcaaacccattgactatactatccttgatgatatagggcacggggttaaatggttgcttcgcttcaaagtttctacacagaacatgaaaatgggcggattgccaaggacgactccccctactcagaagccaccctccccgcctatgtccgggaaaggaaccctcggccgacacagcccttacagaaccttagagcctgtgaggcctcccgtggtgcccaacgactacgtcccatcccccaccagaaacatggctccaagccagcaaagccccgtgagaaccgcttcagtgaaccagaggaacaggacctactcgtcaagcgggtcttctgggggaagccaccctagttctagatcctcatccagagagaattctgggtcaggatccgtcggggttccgattgcggtcccaactccaagtccacctagcgtcttccccgacgctgccgctggcggtgctcagactcttgctgatgggttcaccagcccaactcccccagtggttagttctacaccaccaacaggacatccggttcagttctacagtatgaaccgacctgcctcacgacacacaccaccgaccatcgggggttctttgccatacagacggccaccttctattactagtcagacttcacttcagaaccagatgaatggcggtccattttattcacagaacccagtgtccgacacccccccaccacccccaccagtagaggaaccagtgtttgacgagtctccccctcctccaccaccaccggaggactacgaggaagaggaagcagcagtggtagagtactctgacccgtacgccgaagaggaccccccatgggcccctcggagttacttggagaaagtagtggctatttatgactacacaaaggataaggaggacgagctgagtttccaggagggcgctattatctacgtaatcaaaaaaaatgatgatggatggtatgagggagtcatgaatggagtgaccggcctctttccagggaactatgttgagtcgattatgcactacagtgagtag

SEQ ID NO: 30025 - DNA, 3102 bp, Artificial Sequence
  Description of Artificial Sequence: Synthetic coding sequence
atggacgaagaagagaaccactacgtatcacaactgagagaggtgtactcgtcctgtgataccacaggcactggttttcttgatcggcaggaattaacacaactgtgcttgaagctccacctcgaacagcaactgcccgttctgctgcaaaccttgctgggtaatgatcactttgccagagtcaactttgaggaatttaaggaaggcttcgtggcagtactgagcagtaatgcaggtgtgcgccctagtgacgaggacagcagtagcctggaaagcgccgcaagctccgctatacccccaaagtacgtgaatggatctaagtggtatggacggagaagccgtccggaactttgcgatgccgcaaccgaagcccgaagggtacctgaacagcagacccaggcaagtttgaaatcccacctgtggagatctgcttcacttgagagtgttgagtcgcccaagagcgatgaggaggctgaatctaccaaggaagcacagaatgaactatttgaagctcaggggcagctgcagacatgggactccgaagattttggatctccgcagaaatcttgcagcccatcattcgacactcccgaaagccaaattaggggcgtgtgggaggagttgggcgtggggtcttccggccacctctctgaacaggaacttgcggtcgtgtgtcaatctgtgggcttgcaaggactcgagaaggaagagctcgaagatctgttcaacaaattggaccaggatggtgacggaaaggtgtcgctcgaagagttccagctcggcttgttctcccacgaacccgctctgctgcttgagagctcgactagggtgaagcctagcaaagcgtggtcacactatcaggttcccgaagaatccggctgtcacaccactaccactagttctctggtcagcttatgttccagtctgagactgttttctagcatcgatgacgggtccggttttgcttttcctgatcaagtcttagcaatgtggactcaagaaggaattcagaatggacgggagattctgcagtctttggacttttctgtcgatgagaaagtgaatctcctggagctgacctgggcgctggataatgaattgatgacagttgactctgcggtccagcaagcagctctggcgtgctatcaccaggaactgagctaccagcagggccaagttgagcagctggccagggagcgagacaaagctcgtcaggatcttgaaagagcagagaaacgcaatttggagtttgtaaaagagatggacgactgtcacagtactctagaacagttaacggaaaagaagataaagcatttagaacaagggtatcgggagaggctaagtttgctgcggtccgaggtggaggccgaaagggaactcttttgggagcaagcccatagacaaagggctgccctggagtgggacgtcggcagacttcaggctgaagaagcagggctgagggagaagctgactctagccttgaaagagaacagccgtttgcagaaggagatcgtggaagtggtcgagaagctatcggactcagaaagattggctttgaagctgcagaaagatctcgagttcgtcctgaaggacaaactcgagccacagtcagccgagcttctcgcccaggaagaacggtttgcggcagtcctcaaggaatacgagctgaaatgtcgggatcttcaggatcggaacgatgaattacaagctgaactggaaggactatgggcaagactgccgaaaaatcgacattctccctcatggtcgcccgacggtagacgccgtcagctccctggactgggtcccgctggcattagttttttaggtaattcagccccagtaagtatcgaaaccgagctgatgatggaacaggtgaaggaacactatcaagatctccgcacacagcttgaaacaaaggtgaactactacgagcgggagatcgctgctttaaagagaaatttcgagaaggaacggaaggacatggagcaggctcggagaagagaagtcagcgtgctggaggggcagaaagctgacctggaggagcttcacgagaagtcccaagaggtgatatgggggttgcaggaacagctgcaagacacggcacgtggtccagagcctgagcagatgggcctggcgccttgctgcacccaggccctgtgtggcctagctctccgacatcattcacaccttcagcagatccgattggaatttcacaggctgtcggaggaaaacacccttctcaaaaatgatttgggcagggttcggcaggagctggaagccgcagaatcgacacacgatgcccaaagaaaagagattgaggtcttgaagaaagacaaagagaaggcgtgcagtgagatggaggtgctgaaccgccaaaatcaaaattacaaggatcagttgagccagctgaatgtccgggtgctgcagctgggccaagaggcttcaacccatcaggctcagaacgaggaacaccgggtgactatccagatgttgacacagagcctggaagaagtcgtccgctcagggcagcagcagagcgaccaaatacagaagctgagggtcgaattggagtgtctgaatcaagagcatcagagcttgcagcttccctggtcggagctgacccaaactctcgaagaatcccaggaccaggtacaaggagcccaccttaggctgcgccaagctcaggcccagcatctgcaggaggtgagactggtgcctcaagaccgcgtcgctgaactgcatcggctgctgagtcttcagggggagcaggccagacgcaggctcgacgcacagagagaggagcacgaaaaacagcttaaagccaccgaagagagagttgaagaagcagagatgatcctcaaaaacatggagatgctacttcaggagaaggttgataaactgaaagaacaattcgaaaagaacaccaaatctgatctcctcttaaaggaactctacgtcgaaaacgctcacctggtgagagccttacaagccactgaagagaagcagcgaggagctgaaaaacagagtaggctcctggaagagaaagtccgggctctgaacaagctagtctcaagaattgccccagccgctctctccgtgtag

SEQ ID NO: 30026 - DNA, 627 bp, Artificial Sequence
  Description of Artificial Sequence: Synthetic coding sequence
tgttgtggctgctccggcggatgcggatccggttgtggtggcagaggttccggatgtggcggatgcgggagtggctgtggtggttgtgggagtgggtgcggtggctgtggctctggctgcgggggatgcggcggttgcggctccggctgcgcagggtgcggagggtgcaagggaggatgcggatcctgtggcggttccaaacggggttgcgtctcttgtggggtgagcaagggagcctgcggctcctgcggcggatctaaggggggatgtggttcttgcggtggatccaaagggggatgcggcagctgcggcggaagtaaggggggatgtgggtcatgtggtggaagcaaggggggatgtggctcttacggctgctcccagtcttcctgctgtaaaccatgctgttgtagctccggttgcgggagttcatgctgccagagctcatgttgtaagccgtattgttgccagagctcatgttgcaaaccctactgttgtcagtcctcatgctgcaagccatgcagctgtttcagtggctgcggcagctcctgttgtcagagttcgtgttataaaccgtgctgctgccagagcagttgctgcgtcccggtctgctgccaatgtaaaatttag

SEQ ID NO: 30027 - DNA, 642 bp, Artificial Sequence
  Description of Artificial Sequence: Synthetic coding sequence
atggcgggatcccccgaactagtggtgctggatcccccttgggacaaggagcttgctgctgggacagagtctcaagcgctcgtgtccgcaactcctcgcgaggattttcgcgtgcgctgtacatccaagagagcagttaccgagatgcttcagctatgtggcaggtttgtacagaaactgggtgacgccctgcccgaagaaatccgggaaccagctctgcgtgacgctcaatggacctttgagtccgccgtgcaggaaaacatctcgatcaatggacaagcttggcaggaggccagcgataactgctttatggattcagacataaaggtgctggaggaccagttcgacgaaattattgttgacatcgcaacaaaaaggaaacagtacccaagaaaaatcctcgagtgtgtgatcaagaccattaaggccaagcaggagatcctgaagcaatatcatcctgtggtgcaccccctggacctcaagtatgatccagaccccgttctgaatggtaacgcgttcaattttagccctttcaatatgatgcttgctgtggacttaagctatatggtgttcatcacctcttccccgtcttacgggaagtttgaaatgcagcgaggcaacagcagcaagggggaccagtag

SEQ ID NO: 30028 - DNA, 3720 bp, Artificial Sequence
  Description of Artificial Sequence: Synthetic coding sequence
atgacaatatggcaaatgcaaaagcaagcacagaggggatccccggcaaggactcacagtatgatgagtctttcagttcggcctcagcgcagattactctcagccagagtgaaccgctctcaatccttcgccggtgtgctcgggtctcacgaacgaggccctcgaagttttcccgtgttctcccccccaggaccacctcgcaaacctcccgctttgagccgtgtgtcccggatgttctcagtggctcatccggctgcaaaagtccctcagccggagagactggaccttgtgtataccgccctgaagaggggactgactgcctacttggaggtacatcagcaggagcaggagaagttgcaggggcagataagagaatctaaacgaaactcacgcctggggtttctctatgacttggacaaacaagtcaagagcatcgaaagattcctcagacgtctggaatttcatgccagtaaaatcgacgagctctacgaggcatactgcgttcagaggcgactgcgggatggagcctataacatggtgcgggcttacaccacgggaagtcccggtagtcgcgaagcacgggattcattagcggaggctacaagaggccacagagagtacacagagtccatgtgtctgctggagagtgagctggaagcgcaattaggtgagttccaccttcgtatgaaaggcctggccggtttcgcgcgtctctgtgttggagaccaatacgagatctgtatgaaatacggacggcagagatggaaactacggggtcgaattgagggatcaggaaagcaagtttgggactctgaggaaacaatcttcctgcctctactgaccgagttcctctcgattaaggtaacagagctgaaaggtcttgcaaatcatgtcgtcgttggaagcgtgtcatgtgaaaccaaggacctctttgctgccctgccacaggtcgtggccgttgacataaacgacctgggaacgatcaagctgtctctcgaggtgacttggtcccctttcgataaggacgaccaaccttccgccgcttcctccgtgaataaggcttcaacggttaccaaacgcttcagcacttacagtcagagtcctcccgacacaccttctctgagggaacaggccttttataatatgctccggaggcaagaagagctggaaaacggaaccgcttggtccttatcctcagagtcatccgacgactcgagtagccctcaactgtctggtactgctcggcattcaccagctcccagacccctggtgcagcagcccgaaccattgccgatccaggttgccttccggaggccagagacacccagctccggacccctcgacgaagagggggctgtggcacccgttctggctaatgggcacgccccttacagcagaacactgagccacatcagcgaagctagcgtcgatgcagccctcgccgaggcatccgtagaagctgtgggccctgaatcactagcatggggtcccagcccacccacacacccagctcccacacacggagagcaccccagtcccgtcccgcctgctcttgatcccggtcacagtgcaacctcctctactttgggcaccacagggtccgttccaacctctaccgatcctgctccctccgcacatctggactcagtgcacaaaagcactgactctggaccatccgaactgccaggcccaacacacaccactactggctcgacctacagcgccattacaacaacccatagtgccccatccccactcactcatacaacaaccggctcaacgcacaaacccatcatctccactctcacaacaacgggcccaacactcaatatcattggccctgtccaaaccactactagccccacccacaccatgcccagtccaacccataccaccgcttctccgacacacacttccacctcgcccacccatactcctacgtctcctacccacaagactagtatgtcaccgcctactacgacatcaccaaccccatccggaatgggcctggttcagacagcaacttctcctacccaccccacaacttctcccacccaccccactacgtcacccattctgattaatgtgagtccatcaacaagcctggagctcgctaccctttccagtcctagcaaacattccgatcccacattgccgggtaccgactctttaccatgtagtcctcctgtgagcaattcttatacccaggccgacccaatggcccctcgcactcctcatcccagtccagcgcacagcagccgaaaacccttaacatccccagcacccgacccatccgaatccactgtgcaatccctgtcacccacaccatcccctccgaccccagcgcctcagcactccgacctgtgtctcgcaatggctgttcaaacacctgtgcctactgccgcaggcggatctggagatcgcagcctcgaagaggctctgggtgccctgatggccgctttggatgactaccggggtcaatttccggaactccagggcctcgagcaggaggttacacgcctggagtcccttctgatgcaaaggcaggggctcacaaggtcacgagcaagctccctctccataacagtcgagcatgcccttgaatcctttagtttcctgaacgaagatgaggacgaagataatgatgtcccaggtgaccgcccaccttcctctcctgaagcaggagctgaggatagcatcgacagcccctctgctcgtcccctgtccaccggctgccccgcactggacgccgctcttgtacggcacttataccactgtagcagactgctgctgaagctggggactttcggacctctcaggtgccaagaggcttgggccctggagcggctgttgcgcgaagcccgagtattagaagctgtctgcgaattttctcgccgatgggagatccccgcttcatctgcccaggaagttgtgcagttctccgcatcacggccaggcttcctgaccttctgggaccaatgcaccgagcgactctcctgcttcctgtgtcccgtggagagagttctgctgacattctgtaatcagtatggtgccagactatcccttagacagcccggactagctgaggcagtctgcgtcaagttccttgaagacgcactgggtcaaaagctccctaggaggccccaacccggacccggagaacaacttaccgtcttccaattctggtcattcgtggaaacactggactctcccactatggaggcctacgtgacagaaacggccgaggaggtgctcctcgtgcgaaatctaaacagcgacgatcaggcggttgtcctcaaagccttgcggttggcgcctgagggccgactgagacgcgatgggctgagagcccttagttctctgctcgtgcatggaaacaacaaagtgatggctgccgtctctacacagttgcgatcactgagtctgggaccaacgtttcgcgaaagggccttactgtgttttttggaccagctggaagacgaggatgtgcagacgcgggtggccggatgtcttgcactaggatgcatcaaagcccctgagggtatcgaacctctggtctatctgtgccagactgatacagaggctgttcgagaagcggcaagacagagtcttcagcagtgcggcgaagagggacagagtgctcacaggagactggaggagagcctggacgccctgcctcggatctttggacccggttctatggctagtaccgcattttag

SEQ ID NO: 30029 - DNA, 732 bp, Artificial Sequence
  Description of Artificial Sequence: Synthetic coding sequence
atggtcaccgactacggcgcatttattaaaatcccagggtgccgaaaacaggggctggttcacagaacccacatgtcatcctgcagagttgacaagccttccgagattgtcgacgtgggagacaaagtctgggtgaaacttataggccgagagatgaaaaacgacaggatcaaggtgagccttagcatgaaggtcgtcaatcaaggcaccggaaaagatttagatcctaataacgtgataatagagcaggaagaaaggcgcagacgttcttttcaagactacactggtcaaaagattaccctggaggcggtgcttaacacaacttgcaagaaatgcggctgcaagggcagggtgaagcctctgccattccctcggtttagcccatgcggttggaccctcttctggaaaaaagaggccgctcagtgtcacttcgctaaggactgcttcatgcagcccggtggtactaagtatagcctgatcccagacgaagaggaggagaaggaggaagccaagtcagcagagtttgaaaaacccgatccgacccggaacccaagcagaaagcgaaagaaggagaagaaaaagaaaaaacaccgagatagaaaaagcagtgattcagactccagtgatagtgaaagcgataccgggaagagggccagacacacttccaaagatagcaaagctgccaagaaaaagaagaagaagaagaagcacaagaagaagcacaaggaatag

SEQ ID NO: 30030 - DNA, 330 bp, Artificial Sequence
  Description of Artificial Sequence: Synthetic coding sequence
atggaggagatccccgctcaggaggccgcaggcagcccaagagttcagttccagtctctggagacgcagtcggagtgccttagccctgaaccccagttcgtccaggataccgatatggagcaggggttgacaggcggttttccgattagcaagcctgatgggataagtcagttagagcaggatcttcaggtattcgaccttgaaacaaaaaccagagaagttctgagagacgactgcagtgacggtgagacacgagaagaaaacaagttgctcattccaaaacagaagatatccgaggaagtgcattcttataaggtccgcgtgggatag

SEQ ID NO: 30031 - DNA, 4134 bp, Artificial Sequence
  Description of Artificial Sequence: Synthetic coding sequence
atgagcctggaacgggaactgcggcagctgtccaaggcaaaggccaaggcccagagagcaggccagcgcagggaggaagcagccctgtgtcatcagctgggcgagcttttggctgggcacggaaggtacgccgaggcactggagcagcactggcaagaattgcagctacgggaacgggcagatgaccccctggggtgtgccgtagcccacaggaaaatcggcgaacggttggccgaaatggaggactatcctgctgctcttcagcaccagcatcagtacctggagcttgcccacagcttacggaaccatactgagttgcagagagcctgggctacaattgggcgaacccacctagacatctacgatcactgtcagagcagggacgcccttctacaggcccaagccgcttttgaaaagtcactagccattgtcgatgaagagcttgaaggcacgcttgcccagggggaactgaacgagatgcggacgaggctgtacctcaacctaggcctcacttttgagtctttacagcagaccgccctgtgtaacgactatttcagaaagagcatcttccttgcggaacagaaccacctgtacgaggatctttttcgcgcaagatacaatctcggtaccatacattggagagcaggtcagcactcccaggccatgcggtgtctggagggagcgagagaatgtgcccataccatgagaaagcggtttatggagagtgagtgttgtgtcgttatcgcgcaggtcttacaggacctgggagacttcctggcagccaagagggcactgaagaaggcctatcgtctgggaagtcagaagccagttcagcgggctgccatttgccagaatctgcaacatgtcctcgccgtcgtgaggctgcagcaacagctggaagaagctgaaggacgcgatcctcaaggagctatggtcatttgtgaacagctgggagacctcttctctaaggccggtgatttcccgagagccgctgaagcctatcaaaaacaactgcgcttcgctgagcttctggaccggccaggagcagagcgtgcgatcatacatgtcagtcttgcaaccactctgggcgacatgaaggaccatcacggcgcagtgcgacactatgaggaggagcttcgcctgcggagtggcaatgttctggaggaggccaaaacatggttgaacatcgcattgagtcgcgaagaggccggagacgcttacgagcttttagcaccatgttttcagaaagctctctcctgcgcacagcaggcacagaggccccagctccagcgtcaagtgctgcaacatctgcacaccgtccagttaaggctgcagcctcaggaagccccagagactgaaactaggctacgtgagctatcagtagctgaagacgaggatgaagaagaggaggctgaagaggccgcagcaacagccgagtccgaagcattggaggccggagaagttgagctaagtgaaggcgaagatgacaccgacgggcttacaccacaactcgaagaggacgaggagctgcagggccacctaggccgaagaaagggcagtaaatggaatcgcaggaatgatatgggagaaactttgctgcacagagcatgcattgagggacagttacggagagtccaggatttggtccgacaagggcatccactaaatccacgcgattactgcggatggacacccctgcacgaggcctgcaattacggccacttggagatcgtgcgattcttactggatcatggagccgctgtggacgaccctggagggcagggctgcgaaggcattacacctctgcacgacgccctaaactgcgggcatttcgaggtggcagagctgctcctggagaggggtgcttccgtgacactccgaacgagaaaagcctcggcaagatggcggagatgctctagcggcaagctgtataggcgggatctggatctggaaacacgccagaaggctagggccatggaaatgttattgcaagctgccgcttcaggacaggacccgcatagctctcaagcgtttcatacaccatccagcctgctttttgatccagagactagtcctcccttgagcccctgccccgagcctccttcgaatagtacccggctgcccgaggcttcccaggcccacgtacgagtgtcccctgggcaggccgcaccagcgatggcccgacctagacgctcaagacacggccctgccagtagctcctcttcatctgagggggaggactctgccggacccgcacgcccatctcagaaacgccctcgttgcagcgccaccgctcagcgggtggccgcatggaccccgggtcctgcgtctaatcgggaggctgcaacagcgtcaactagtcgcgcagcctaccaagccgctattagaggagtgggaagcgcccagtcacggctcggtcccggaccccctcgtgggcatagcaaagccttggccccacaggccgctctaattcctgaagaggagtgtttggctggcgactggctggaacttgacatgccgttaacaaggagtaggaggcctcggcctcggggtactggagataacagacgccctagcagtacatctgggtccgatagcgaagaatcgcgtccacgcgctcgggcaaaacaggttcgccttacctgtatgcaaagttgttctgccccagtgaacgcaggtccaagctctctggcctctgagcccccaggttcccctagtaccccccgagtgtccgaaccttcaggagactcgtccgctgcgggtcagccgctgggacccgctcctcctccacctatccgagtgcgggtgcaggtccaggaccaccttttcctcatccccgttccgcattcttccgatacccactcagtcgcatggttggccgagcaggcggctcagagatattatcagacctgtgggctcttaccacggctgacgctcagaaaggagggtgccctcctggcgcctcaggacctgattcccgatgtcctgcagtccaacgatgaagtgctagctgaggtcacatcttgggacctgccacccctcacagatcgatatcgcagagcgtgtcagtcgctcggacagggggaacatcagcaggttctgcaggccgttgagcttcagggcctcggcctttccttttctgcctgcagtctcgctctggaccaggcccaattgacgccactgctgagagcattgaaactgcacaccgccctgagggagctgagattggccggtaaccgccttggcgacaaatgtgtggctgagctggtggcggctcttggcaccatgccttcgctggccttgctggatctcagctccaaccatctaggaccagagggtctgaggcagctggcaatgggattgcccggacaggcaacactgcaatcccttgaagagctggacctgtccatgaaccccctcggcgacgggtgcggacagagtctggcttctctgctgcatgcttgccctcttcttagcactttgaggctgcaggcctgtggattcggcccaagtttcttcctcagccatcagacagccctcggaagtgccttccaggatgccgaacatctcaaaaccctaagcctgtcttataatgccctgggggcacctgccctggccaggaccctccagtccctgccagcagggaccctgcttcaccttgagctgagtagcgttgctgccggtaaaggggatagtgatctgatggaacccgttttccgatacctggccaaagagggctgcgcacttgctcacctgaccctaagcgccaaccatctgggcgataaggccgtgagagatctctgtagatgtctaagtctgtgtccgagcctcatcagcttggacctctccgccaatcctgagatctcatgcgcgtcgctcgaggagttactttcaaccctgcagaagaggccacaaggcctatcatttttgggtttatcagggtgtgctgtgcagggtcctctcggactggggctatgggacaaaattgctgcacagctacgcgagctgcagttgtgtagtcgtcgtctgtgcgccgaggatcgcgatgctttgaggcagctgcagccttcccggccaggtcctggggagtgcacactggaccacggaagcaagctattcttcaggcgtctttag

SEQ ID NO: 30032 - DNA, 675 bp, Artificial Sequence
  Description of Artificial Sequence: Synthetic coding sequence
atgccaaccctgtttaagggcgtgtggggtgtcgttgagcattctagagctcttgggagattctgcccagcctgcctgccctcgggtcctcacctgcatacacaacctgccttgggaacagctgagatgacccttttgtccagccagtcttccagcctggtggctccatcggggagcgtcagtgctgagaatccagagcagaggatgcttgagaagagggcaaaagtgatcgaggaactactgcaaacagagcgcgactacattcgggatctggaaatgtgcatcgaaagaatcatggttcccatgcagcaggcacaggtgcccaacatcgacttcgaagggctgttcggcaacatgcagatggtgattaaggtgtcaaagcagttacttgccgcactcgagattagcgacgcggttggtccagtgttccttggccatagggacgaactagaaggcacttacaaaatttactgtcagaatcacgatgaggcaattgctttgttagagatttacgaaaaggatgaaaagattcaaaaacacctccaggacagcctggcggatctgaaatccctttacaatgaatgggggtgcactaattacataaacctgggttctttcctgattaaaccagtgcagcgggtgatgcgctacccattgctgctcatggagttatag

SEQ ID NO: 30033 - DNA, 354 bp, Artificial Sequence
  Description of Artificial Sequence: Synthetic coding sequence
gtctgtggagattatctcttgtcaagaatggatgtgaccagctgcattagctacagaaactttgcttcgtgcatgggggactctcgtctactcaacaaggtggacgcatatatacaggagcacttactacagatatccgaggaggaggagtttctgaaactgccccgtctgaagctcgaggtcatgcttgaagataatgtttgtctcccttccaacggaaagctgtacacaaaggtgatcaactgggttcagcgcagtatctgggagaatggcgattcgctggaggagttgatggaagaagtgagctttaaggtgaatggcatccagcccttcctgaagatcatcttgctgtag

SEQ ID NO: 30034 - DNA, 285 bp, Artificial Sequence
  Description of Artificial Sequence: Synthetic coding sequence
atgttatgctggggctattggtctcttggccagccaggcattagtaccaatcttcaggggattgtggccgaaccccaggtctgcggctttatatctgacagaagcgtgaaagaggtcgcctgtggaggcaaccactctgtatttttactggaggacggagaggtgtacacttgtgggttgaacacaaaagggcagttaggccacgagcgcgaggggaataagcccgaacagatcggcgcattggcagatcagcatataatccacgtcgcttgcggtgaatcgtag

SEQ ID NO: 30035 - DNA, 747 bp, Artificial Sequence
  Description of Artificial Sequence: Synthetic coding sequence
atggcaacctctgccccattaagatctttggaggaagaggttacatgctcaatctgcctcgactatctcagggacccggtcactatcgactgcggccacgtgttctgtcgctcttgcaccaccgatgtgcgccctattagcggctcccgccctgtttgtcctctctgcaaaaagccgtttaagaaagagaacatccggccagtgtggcagcttgcatcattggtcgagaatattgagcgcctcaaggtggacaaggggagacagccaggtgaagtcactcgagagcagcaagacgctaaactctgcgagagacatcgcgaaaaactgcactactactgcgaagatgatggcaagctcctgtgtgtaatgtgccgtgaatcacgtgaacacagacctcacaccgccgtactgatggagaaggccgctcaacctcaccgcgagaagatcctcaaccatcttagtactctgaggcgagatagagacaagattcaaggctttcaggctaaaggtgaggcggatattttagccgcactcaagaagttgcaggaccagcggcagtacattgtggccgagtttgaacagggccatcagttcctgagggaaagagaggaacacttactggaacagctcgctaagctggaacaggaattgacagaaggacgcgagaagttcaagtcacggggagtgggggaactggcacgtcttgccctggtgatttcagaactggagggcaaggcacagcaatag

SEQ ID NO: 30036 - DNA, 2814 bp, Artificial Sequence
  Description of Artificial Sequence: Synthetic coding sequence
atggagccagacattatcagaatgtatagtagctcccccccacctctcgacaacggtgctgaggacgacgacgatgacgagtttggcgaattcgggggattttctgaagtgtctccctccggagtggggtttgtagatttcgacacaccggattatacccgcccaaaggaggagttcgtgccttccaatcactttatgccgattcacgaattctcggaaaacgtggatagtctgacctcctttaagtcaatcaaaaacgggaacgacaaagacatcaccgctgaattatccgctccagtcaagggacaaagcgatgtgctgttaagcaccacaagtaaagagatcatctcatccgagatgctggctaccagcattgatggtatggagcgaccaggcaatctgaacaaggtggtggagcaaagacaaaatgttggcaccctggagagtttctcaccgggtgacttcaggacaaatatgaatgttgttcaccagaataagcagctggaatcctgtaatggtgaaaagccaccatgccttgagattttgactaacggctttgctgtattggaaacggtaaatcctcaggggaccgacgaccttgacaatgttgcagacagcaagggtcggaaacccctctccacccattccacagagtataatcttgattccgtgcccagccctgcagaggagtttgccgactttgcaacattctccaaaaaggagcgaatccagctggaagagattgaatgtgcagtcttgaacgaccgggaggcgttgactattagggaaaacaacaagattaaccgggtcaatgagctgaactccgtcaaagaagtcgctctgggcagatcccttgataacaaaggggacacagatggtgaggaccaagtctgtgtgagcgagataagtatagtcaccaaccgtggcttttccgtagaaaaacaagggctcccgaccctgcagcaggatgagtttctgcagtctggggtccagtcaaaggcttggtctctggtggacagtgcagataactccgaagccatccggagggaacagtgcaagactgaagagaaacttgatctgctgacgtctaagtgtgcgcatctgtgtatggatagcgtgaagaccagcgatgatgaggttggttcaccaaaagaggagagccgaaagttcactaactttcagtctcccaatatcgaccctaccgaggagaatgacttagacgacagtctatccgttaaaaacggagactccagtaacgatttcgtaacttgcaatgacatcaatgaggacgacttcggggactttggcgactttggctccgcttcaggatcaaccccgccttttgtcacaggcacacaggacagtatgagcgatgccacttttgaagagtcctccgagcactttccacatttcagtgagccgggagatgattttggtgagtttggtgacattaacgccgtttcatgccaggaggagacgatacttactaagagtgacctgaagcagacttcagataacttgtcggaggaatgccagcttgctaggaaatcttctggaaccgggactgaaccagttgcaaagctaaaaaatgggcaggaaggcgaaatcgggcacttcgactcagtcccaaatatacaggatgactgtaatggctttcaggattcagatgatttcgccgatttttcatctgcagggcctagtcaggtggttgattggaatgcattcgaggacgagcaaaaggattcctgttcctgggcagcctttggagatcagcaggctactgaatctcatcaccgcaaagaggcttggcaatctcacagaaccgacgaaaacatcgacaccccaggtacccccaaaacacacagcgtgccttcagctacctccaaaggagcggtggcgagtggacacctccaggaaagtgccacgtcagtccagacggctctgctgaacagactggagcgcatcttcgaggcctgcttcccatctatccttgtcccagacgcagaggaggaggtgaccagtctcaagcacttgcttgagactagtaccctgccgatcaaaacgagggaggcgcttcccgagagcggggagctgctggacgtctggaccgagctgcaggatattcacgatgctcacggcctcagatatcaatggggcggaagtcactctaataagaagctgctgtctagtttaggaattgacacccggaatatcctgtttacaggcaataagaaacagcctgtgatcgtgccaatgtatgcagccggtctggggatgctggaacccacaaaggaaccacttaaaccattgtcagctgccgagaagatcgcaagcattggacagactgccactatgagcccggacatgaacacctgtacgagtgaccaatttcaggagtctttgcctcccgtccagtttgattggtctagctctggactcactaatcccctcgacgcgtctggagggagtactctgctgaacctcgatttcttcggtccagtcgacgactccagttccagctcaagcacaacaatccccggtgtggatccagaactgtacgagctaactacatccaaattggaaatcagcacaagcagcctcaaggtgaccgacgccttcgctcgattgatgtcgacagtggaaaagacctccacgtcgacgagccgtaagcctaagagggaggaacacctcagtgaggaagccattaaagtgattgcaggtcttccggatctgacctttatgcatgctaaggtgttgatgttccctgctacgctgaccccatcaacttccagccaagagaaggctgatggctag

SEQ ID NO: 30037 - DNA, 114 bp, Artificial Sequence
  Description of Artificial Sequence: Synthetic coding sequence
atggctagtgaggacattgccaaactggccgagacgttggccaaaacccaggtcgccggaggacaactctcctttaagggaaaaagcctgaaactcaatactgcagaggactag

SEQ ID NO: 30038 - DNA, 309 bp, Artificial Sequence
  Description of Artificial Sequence: Synthetic coding sequence
atgcaaacttccagttcgcgttcagtgcacctcagcgagtggcaaaagaattactttgcaataaccagtgggatatgcacaggcccaaaagccgacgcctatcgagctcaaattctgaggatccagtatgcatgggctaactccgaaatcagccaggtctgcgcgacaaaactgttcaaaaagtatgcagaaaaatactccgcaatcattgactctgataatgttgaaagcggcctcaacaactatgctgagaacatcctgactctggccggttcacagcagaccgacagcgataagtggcaatcctag

SEQ ID NO: 30039 - DNA, 474 bp, Artificial Sequence
  Description of Artificial Sequence: Synthetic coding sequence
atggcaacaagtgctccccttcgttctcttgaggaggaggttacctgcagcatctgcctggactacttaagggaccctgtgaccatagattgtggacatgtcttctgccgatcgtgtacaacagacgtgcggccaatctctggaagccgcccagtatgtcctctgtgtaagaaaccgtttaagaaggagaacatcagacctgtgtggcagcttgcttcactcgttgaaaacatcgagcggctaaaagtggacaagggaaggcagccaggggaggtaactcgtgaacagcaagacgccaaactgtgcgagcggcatcgtgaaaagctgcattactattgcgaagatgatggaaagctgctgtgcgtgatgtgcagggagagccgtgaacacaggccccataccgccgtgctgatggagaaggccgctcagcctcatcgagagaagattctgaaccatctgtctactctgcgatag

SEQ ID NO: 30040 - DNA, 348 bp, Artificial Sequence
  Description of Artificial Sequence: Synthetic coding sequence
atggccggtgcccctaccgtcagtctgcccgaacttaggtccctgctggctagcggcagggctcgcctttttgacgtccggagcagagaggaggctgccgcaggcacaattcctggtgctcttaacattccggtgtctgaactcgagtctgcgctccagatggagcccgcagcgttccaggctctgtatagtgccgaaaagcccaagctcgaggacgaacacctcgtcttcttctgccagatgggaaagcgcggacttcaggcaactcagctggcaaggtccctgggctacacaggagctcgtaattatgcaggggcatatcgggagtggcttgagaaggagtcctag

SEQ ID NO: 30041 - DNA, 4766 bp, Artificial Sequence
  Description of Artificial Sequence: Synthetic coding sequence
atgttaccccctaagcatctaagcgccaccaaaccaaagaagtcctgggctccaaacctctacgagttagattccgatctgactaaagagccagacgtgattattggggagggccctaccgatagcgagttttttcaccaacgattcaggaacttgatctacgttgaattcgttgggccaagaaagaccctgattaaactgagaaatctgtgcctcgattggcttcagccggagacccgtacaaaggaggagataattgagttgctggtgctggagcaatatctaaccattatcccagagaaactaaaaccctgggtgagggccaagaagcccgaaaactgcgaaaagctggtcactctgcttgagaattacaaagaaatgtaccagcctgaagatgataacaattcagacgtaacttccgatgacgatatgacaaggaaccggagagagagctctccaccacactctgtccacagcttcagtgatcgagactgggataggagggggaggagccgggacatggaacctcgtgacaggtggagccacaccaggaacccccgttcaagaatgcctcccagagacctgtcccttccagttgtcgccaaaacatcctttgaaatggatcgcgaagacgaccgggactctagagcatacgaatccaggagccaggacgctgagagctaccagaacgtggtggacctcgccgaggatcgcaaaccacataatacaattcaagataacatggaaaattataggaaactcttgtcactcgtccaactagccgaggatgatggccactcacacatgacacagggccatagtagcagatccaagcgatccgcgtacccctccacctccagaggtcttaaaacgatgcctgaggcaaaaaagtctacacaccgccgtggcatctgtgaggatgaatcttcccacggcgtgatcatggaaaagttcattaaggacgtctctaggagcagcaagtcaggcagagcaagagaaagcagcgatagatcccagcggttcccccgaatgagcgacgataactggaaagatatttcacttaacaagagggagtctgtgatacaacagagggtctacgaaggcaatgcatttcggggaggttttcgcttcaacagtaccctcgtgtctcggaaacgcgtcctggagagaaaaagaagatatcattttgacacggacggaaaaggcagcattcacgatcagaagggctgtccacgaaaaaagcctttcgaatgcggatcagaaatgcgtaaagctatgtccgtgtcaagtctcagcagcctgtcctctcccagttttacagagtcccagcctatcgatttcggtgctatgccatatgtgtgtgacgaatgtggtcggtccttctctgttatatccgagtttgtagagcatcagattatgcatacccgggagaatctctacgagtacggcgaatcgtttattcactcagtggctgtgagtgaagttcagaaatctcaggtgggaggtaaaagatttgaatgcaaggactgtggagaaaccttcaacaagagcgcagccctggctgagcacaggaaaatacatgcacggggatatctcgtcgagtgtaagaatcaggagtgtgaagaagcctttatgccttcacccacgttttccgaactgcagaaaatttatggcaaagataaattttacgaatgtagagtgtgtaaggagacgtttctgcactcgtccgcccttattgagcatcagaagattcacttcggggatgacaaagacaacgagcgtgagcatgagagggaaagggaacgggaacgcggagaaacatttcggcctagtcccgctctcaatgaattccagaaaatgtacggcaaggagaagatgtatgagtgtaaagtttgcggggaaacatttctgcacagctcttcactcaaggaacaccaaaaaattcatacccgcggaaatcctttcgagaataagggaaaggtctgtgaggagaccttcattccgggtcaaagcctcaagcgcaggcaaaaaacttataacaaggagaagctctgcgactttactgatggcagagatgcattcatgcagtcctcagagttgtccgagcatcaaaagattcacagtaggaagaatctattcgagggtaggggctatgaaaagtcagtgatacacagtggtccatttaccgaatctcagaaatcgcacacgatcacacggcctcttgaaagcgacgaagacgaaaaggccttcactatcagttcaaacccttacgagaaccagaagattcctacaaaagaaaatgtctacgaggccaagagctatgaaaggagtgtgattcattcactcgcctccgtggaagcacagaagtctcactctgtcgcagggccatctaagcctaaggtgatggccgagtccaccattcagtcattcgacgccataaatcatcagagagtaagagcgggtggtaacacctctgaagggagagaatattcccgaagtgttatccactccttagtggcgtcgaaaccacctcgatcacataacggtaacgagctcgttgagtcgaatgagaagggggagtccagcatatacatctctgaccttaatgacaagaggcagaaaatccctgcaagggaaaacccatgcgaggggggatccaaaaaccgcaattacgaggattcagtgattcagtccgtcttccgggcaaagccacagaagagcgtgccgggagagggcagtggggagttcaagaaggacggtgagttttctgtgccatcctctaatgtccgtgaatatcagaaagcaagggcaaagaaaaagtatatcgagcataggagcaacgagacgagtgttatccactccctccctttcggcgagcagacatttaggcctaggggcatgctctacgaatgtcaggaatgtggtgagtgtttcgctcactcatcagatctaacagagcaccagaaaatacatgatcgggaaaagccttcaggtagccgcaactatgagtggtctgtaatccggagcttagcgccaaccgacccacagacctcctatgctcaggaacagtatgccaaggaacaagccaggaacaaatgcaaggattttcgacagttctttgcgacatctgaagaccttaataccaatcagaagatttacgaccaggagaaatcccatggtgaagagtcccagggcgaaaataccgatggcgaggaaacccatagtgaagagacccacggacaggaaacaattgaagatcctgtgatccagggatctgatatggaagaccctcaaaaagatgaccctgacgataagatctatgagtgcgaggactgtgggctcggattcgtggacctcaccgacctgactgatcatcagaaggtccatagcagaaagtgtctagtggatagcagagagtatacacattccgtgatccatactcactccatatctgaatatcagcgagactatactggggaacagctatacgagtgtcctaaatgcggagaatccttcatacactcctctttcctcttcgagcatcagcgaattcacgaacaagaccagctctattctatgaaagggtgcgatgatgggttcattgccctgttgcccatgaaacccaggcgaaatagagcagccgagcggaatccggctctggcgggatcggctatccgttgtctgctgtgcggccagggatttatccactcatctgcattgaatgagcatatgcgtctgcacagagaagacgatctgctggaacagtcccagatggctgaggaagcaataatccccggactggccctaactgaatttcagaggagccaaacggaggaaaggctgttcgaatgtgctgtgtgtggcgaatcatttgtgaatccagccgaactggctgatcacgtcacagtgcataagaacgagccttatgaatatggaagctcctatactcatacatcttttctgactgaaccgctgaaaggcgctatccctttttacgaatgcaaggactgtggcaaaagttttatccattcaacagtacttaccaagcacaaggagttgcatctagaggaggaggaggaagacgaggcggcagcggctgccgctgctgctgcacaagaggtagaagcaaacgtgcacgtgccccaggtcgtgcttaggatccaagggctgaacgtcgaagccgcagaacctgaggtcgaggccgcagaaccagaagtagaggccgctgagccggaggtcgaggcagcagagcccaatggagaggctgaggggcctgacggtgaagccgcagaacctatcggagaagctggacagcccaatggcgaagcagaacaacccaatggggacgcagatgaacccgacggggctggcatagaggatcctgaagaaagggccgaggaacctgagggtaaggccgaagagccagaaggcgatgcagatgagccagatggggtcggaatcgaggatcccgaggaaggggaggatcaagaaatccaggtagaggagccttattacgactgtcatgagtgcaccgaaacatttacttctagcactgcctttagcgagcacctaaaaacccacgcttctatgataattttcgagccagcgaacgcctttggcgagtgtagcggatacatcgaaagagcctcaacttccactgggggtgcaaatcaggcggatgagaaatacttcaagtgcgatgtgtgcgggcagcttttcaacgacagattaagccttgccaggcaccaaaacacccatacaggtta

SEQ ID NO: 30042 - DNA, 381 bp, Artificial Sequence
  Description of Artificial Sequence: Synthetic coding sequence
atggccgctgccacaggcgaccctggattgtccaaattacagttcgccccattcagctccgcccttgacgttggcttttggcacgagctcacccaaaaaaagctgaatgaatatagattagatgaggctcccaaggacatcaaaggctactattataacggggattctgccggactgccagctagactcaccctcgagttctccgccttcgacatgagcgcacccacaccagcgagatgttgtcccgcaataggaaccctgtataacaccaacaccctggagtcattcaaaacagccgacaagaagctgttgctggagcaagctgcaaatgagatctgggagagcataaaaagcggtaccgccctggagaatcccgtctag

SEQ ID NO: 30043 - DNA, 1434 bp, Artificial Sequence
  Description of Artificial Sequence: Synthetic coding sequence
atggctgatgggcaggttgctgaactgttgttacgcagactggaggcgtccgacggagggctggacagcgcagagttagcagctgagttaggtatggagcaccaggccgtcgtgggagccgtcaaatccctccaggccctgggtgaggtgatcgaagcagaactcagatccactaaacactgggaactgacagcagagggcgaagagatagcaagagaaggttcacacgaagcacgcgtgtttagaagtatcccccctgaaggtcttgcccagtctgagctgatgcgattgccgagcggaaaagttggcttttcaaaggccatgagcaataagtggatcagagttgataagtctgctgctgacggacctcgcgtttttagagtggtcgattccatggaggatgaagtgcagcgacgcctgcaattggtgcgcggaggtcaggctgagaaactgggagaaaaggaacgcagcgagcttcggaaaaggaagttactggcagaggtcggatcttggcgtgatcggccattcaagccctataactttttggctcacggcgtacttcccgatagtggacatctgcatcccctcctcaaagtgagatctcagtttcggcagatcttcctagaaatggggtttactgagatgccaacagataattttatcgagtcctccttttggaatttcgacgctttatttcagcctcagcagcacccagcccgagatcagcacgatacattttttctgagagatcccgctgaggccctccagctgccaatggactacgtccaacgcgtgaagagaacccactcccaaggaggctatgggtcccaggggtataagtataattggaagctggatgaggcaagaaagaatcttctcagaacgcacactacatccgcctcagcgagagctttataccgactcgctcagaaaaaacccttcacacctgtgaaatatttttcgattgatcgggtcttcaggaacgaaaccctggacgcgacccacctcgctgaattccatcagatcgaaggggtggtggccgaccacggcctaacgctcggccatctgatgggtgttctgcgagagtttttcactaagctgggcatcacccaactccggttcaaacccgcttacaatccatacactgagccaagtatggaggtgttctcatatcatcagggtttaaagaagtgggtggaggtcggcaacagcggcgttttccgaccggaaatgctcctgcctatgggcttgccagaaaacgtgtctgtgatcgcatggggcctgtctctggagaggcctacgatgattaagtacggcattaacaatattagggagcttgtcgggcataaggtgaacttgcaaatggtttacgactcaccactgtgtaggctggacgcagagcctcggccaccccctacgcaagaggcggcatag

SEQ ID NO: 30044 - DNA, 3195 bp, Artificial Sequence
  Description of Artificial Sequence: Synthetic coding sequence
atgcccgtccaagcagcacagtggacagagttcttatcctgcccaatctgttataacgagttcgacgaaaacgtgcataaaccaatcagcttgggctgctctcacaccgtgtgtaagacatgcttgaataagctgcaccggaaagcatgtcccttcgaccagactgcaataaacaccgatatcgatgtcctgcccgtgaactttgctttactgcagttggtgggagctcaggtcccagatcatcaaagtataaaactgagtaatctgggtgaaaacaaacattacgaggttgcgaaaaaatgcgtagaagaccttgcattgtacctcaaaccgttatccggcggaaagggcgtggccagcctgaatcaaagtgctttgagccggcctatgcaaaggaaactggtgacgctggtgaattgccagctcgtggaggaggagggcagagtacgcgctatgcgggcagccagatccctgggcgagaggaccgtgaccgaactaattcttcagcatcaaaatcctcagcagttatccgccaatctgtgggcagccgttagagccagagggtgtcagttcctaggccctgcaatgcaggaagaggctctgaaattagtattgcttgcactggaggacggaagcgcgttatctaggaaggtactcgtgctattcgtcgtgcaacggttggaaccacgattcccacaggcctctaagactagtattggccacgtagtccagcttctgtatcgggcttcttgctttaaggtgacaaagcgggatgaggacagttcccttatgcagctcaaggaagaattccggagttacgaagctctccggagggagcacgatgcccagattgttcacatcgctatggaagctggattgcgcattagcccggaacagtggtcaagcctgctatacggcgatctggctcacaagtcccacatgcaatctattatcgataaactccaaagccccgagtcttttgctaagagtgtacaggaattaactatcgtgctgcaaaggaccggcgatcccgctaacttaaaccgactgaggcctcacctggagttactcgccaatatcgatccaaatccagacgccgtgtcccctacttgggaacaattggagaacgcaatggtcgctgtgaaaacagtggtgcacggacttgttgattttatccaaaactacagcagaaagggccacgaaaccccacagcctcagcctaattctaagtataagacatccatgtgccgcgatttaagacagcaggggggatgtccaagaggcactaactgcaccttcgcccactcccaggaagaactcgaaaagtacaggctgaggaataagaagataaacgccacagtgaggacattccctctcctgaataaagttggagtgaataacactgtgacaaccacggccggtaacgtgatttctgtgattgggagtaccgagacgactgggaagatcgtcccatctactaacggcatctccaatgctgagaactccgtgtcacagctaattagtcgatcaaccgattcaactctgcgtgcccttgagaccgttaagaaagtcgggaaggtgggggctaatggccagaacgctgcaggaccatcagctgacagcgtgaccgagaacaagattggttcaccaccgaagacacctgtatccaatgtcgccgcaacttcagcaggacctagcaatgtaggaactgagctcaattctgtgccgcagaagtcctccccttttctgacccgagtgcccgtctatcctccccactccgaaaatattcagtactttcaggacccaaggacccagattccctttgaggtgccacaatatccccaaaccggttattaccccccacccccaactgtcccggctggcgtcgctccgtgcgttcctcggtttgtaaggtctaataacgttcccgagagttccttaccccctgcaagcatgccgtacgccgatcactactcaacgtttagcccaagggaccggatgaattcctccccctaccagccgcctccccctcagccttacggtcccgtgccacctgttcccagcggtatgtacgccccagtctatgattctagaagaatctggcgccctcccatgtatcagcgtgatgacatcatccgctccaacagcctgccgcctatggacgtcatgcacagttcagtctaccagacgtctctccgcgagcggtataactcccttgatgggtattacagtgtggcctgtcaaccaccttcggagccacgcaccaccgtgcccctgccccgtgagccttgcggtcacttaaaaacgagttgcgaggaacaaatccgacgaaagcccgaccagtgggcccaatatcatacccagaaggctccacttgtctcctccacactgcctgtggcaacgcagtcaccaacccctccctcacccctctttagcgtggatttcagagcagacttctccgagagcgtctctggtactaagttcgaggaggaccatctaagccactactcaccatggtcgtgcggcacaattggtagctgtatcaatgcaattgactctgaacctaaagacgtgattgccaattctaatgctgttcttatggatttggacagcggggacgttaagcgcagagttcacctgtttgaaacccaacgcaggactaaggaagaggatcctattatcccattctctgacggacccatcatttctaagtggggagctatatcacgctcatctcgtaccgggtatcatacaacagacccggtgcaggccactgcttctcagggatccgcaacaaagcctatcagcgtatctgactacgtgccctacgttaacgccgtggatagtcgctggtcttcctatggcaacgaggcaactagctccgctcattatgtggagagggataggtttatcgtgaccgacctgagcgggcaccgcaaacattcgtctacaggcgatctcctctccctcgaactgcagcaggccaagagcaacagcctgctgctgcagcgtgaggctaatgctcttgctatgcaacagaaatggaattccctggatgagggcagacatctgacgctcaaccttctgtccaaggagatagaactccggaacggagaggtaaaaaagctcaatctgagtgcctcctgtttgatgtacttgttctctgccgctgcctcgtggctgtaccactactag

SEQ ID NO: 30045 - DNA, 1548 bp, Artificial Sequence
  Description of Artificial Sequence: Synthetic coding sequence
tgagccggagggtctccttccgtcgtagactatttcccttctgaggatttctatagatgtgggtattgtaaaaatgagagcggcagtcgttctaatggaatgtgggcccacagcatgactgtgcaggattaccaggatctgattgatcggggatggcgtcgctctgggaagtatgtctataagcctgtgatgaatcaaacttgttgcccacagtacaccatccggtgtcgaccactgcaattccagccaagcaaatctcacaaaaaggtcctgaagaagatgctgaagttcttggcaaagggtgaagtgcccaagggcagctgcgaggatgaacctatggattctaccatggacgacgccgtggctggggattttgcgctcatcaacaagctagacattcaatgtgatctgaaaactctgtcggacgacatcaaggagagcctcgaaagtgagggtaaaaactccaagaaagaagaaccccaggaactcctacagtcacaagactttgtcggggagaaacttggctctggcgagccgtcccactcagtcaaggtccatacagtgcccaagcccggaaagggtgcagacctcagcaaaccaccatgcaggaaggctaaagaaatcagaaaggagagaaagagactcaaactgatgcagcaaaatcccgcaggggaactcgaagggttccaggcgcagggtcacccaccctctttgtttcctcccaaggctaagtctaaccagcccaagagcctggaggacctcatcttcgaaagtcttccagagaacgcaagtcacaagttagaggtgcgcgtcgtccgatcatccccaccatcatcccagttcaaggccacactcctggagtcttaccaggtctacaaaaggtatcagatggtgattcacaagaacccacctgatacccccactgaatcccaattcactagatttctttgtagcagccctcttgaggcggaaacccctccgaacggtcccgattgtggttacggatccttccaccagcagtactggttagatggtaagatcattgctgtgggagtgatagatattctacccaattgcgttagctcagtttacttatattatgatcccgactactccttcctcagcctcggtgtgtactccgccctgcgcgagatcgcctttactcgtcagttacacgaaaaaaccagccagctgtcatattactacatggggttctatatccattcatgtcccaaaatgaagtacaaaggccagtatagaccatcagacctgctgtgccccgagacgtacgtctgggtgccaatcgagcagtgcctacctagtctcgagaactccaagtactgcaggttcaatcaagatccggaggcggttgatgaggacaggtccactgagccggatcgtttgcaggtgttccacaaaagagccataatgccctatggtgtctacaaaaagcagcaaaaggacccaagtgaggaagcagccgtgctgcagtatgcctccctggtgggacagaagtgctcagaacggatgctgttattcaggaactag

SEQ ID NO: 30046 - DNA, 225 bp, Artificial Sequence
  Description of Artificial Sequence: Synthetic coding sequence
atggccatggcaccctcccccagcctcgttcaggtgtacacaagtcctgcggcagtcgcagtatgggagtggcaggacggactcggtacgtggcatccttacagtgctactgtgtgcagcttcattgagcagcagttcgtgcagcagaagggtcagcggtttggcttgggatcactagcacacagcattcccctcggtcaggccgacccatccctggcaccatag

SEQ ID NO: 30047 - DNA, 594 bp, Artificial Sequence
  Description of Artificial Sequence: Synthetic coding sequence
atggccgcattccgggatatagaagaagtgtcgcaaggtttgctcagcttactcggcgcaaatcgcgctgaggcccagcagaggagactgctgggccgtcatgagcaggtggtggaaagactcctggaaacccaggatggggcagaaaagcagctcagggagattctgacaatggaaaaagaggttgcccagtctctgctgaacgccaaagaacaggtgcaccagggcggagttgagttacagcagcttgaggccggactacaagaagcgggagaagaggatacacgtctcaaggcatctctgctccagttaacccgggaactcgaagaactcaaggaaatcgaagcagaccttgagcgccaagagaaggaggtggatgaagacacaacagtcacaattccctccgccgtatatgtggcgcagttgtaccatcaggtgtcaaaaatcgaatgggactacgaatgtgaacccggaatggtgaaaggaatacatcatggaccatctgtcgctcagcctatccacctggatagtacacagctgagcaggaaattcatctcagactatctctggagcctggtagacacagagtggtag

SEQ ID NO: 30048 - DNA, 2271 bp, Artificial Sequence
  Description of Artificial Sequence: Synthetic coding sequence
atgagtccccagaaacgcgtgaaaaacgtccaagcccagaatcggacttcccaagggtctagctcctttcagactactctatccgcatggaaagtgaagcaggatccgtccaactcaaaaaatatatcaaagcacgggcagaacaaccccgtgggggactacgagcacgcggatgatcaagcggaagaggacgctctgcaaatggctgttgggtattttgagaaaggaccaatcaaggctagtcagaataaggacaaaactttggagaagcacctgaagaccgtcgaaaatgtggcctggaagaatgggttggcttcagaggagattgatatactcttgaatatcgcgctgagcggtaaattcggaaatgccgtgaatacaagaatcctgaagtgcatgattccagcaacagtgataagtgaagatagcgtggtgaaggcggttagctggctgtgcgttggaaagtgcagcgggtccaccaaggttctgttttatcggtggctcgttgccatgtttgattttatcgataggaaggaacagatcaatctcttgtacggattcttcttcgccagcttgcaggatgacgccctgtgcccctatgtgtgtcatcttctttaccttctgaccaagaaagagaacgtgaagcctttccgagtcagaaaactgctggacctgcaggccaaaatgggaatgcagccgcatctgcaggcacttctgtctctgtataaatttttcgccccagcccttattagcgttagtctacctgtgcgtaagaagatatacttcaagaactcagagaacctgtggaagaccgccttgctggctgtgaaacagaggaatcggggaccctcccctgagcccctcaaattgatgctcggcccagctaacgttcggccactaaagagaaaatggaactctctgtcagtgatccccgtcctcaattcctcaagctacacgaaagaatgcggcaaaaaggaaatgtcactctccgactgccttaacaggtcaggaagttttcccctcgagcagctccagtcctttccccagcttttgcaaaatatccattgcctggaattgccttcgcaaatggggtcagtcctaaataactcactgctcctgcactatataaactgtgtaagagacgagccagtgctgctaagattctactattggttgtcacagactttgcaggaagagtgtatttggtataaagtcaataactacgagcacggtaaagagttcaccaactttctggataccatcatcagagcggaatgcttcctgcaggaagggttctacagctgtgaagcctttttgtataagtctttgccactgtgggacgggctatgttgtagatcccaatttctccagctggtgtcgtggatacctttttcgagtttctcagaagtgaagcctcttctctttgaccaccttgcccagctgttcttcactagtactatctattttaagtgcagtgtgttacagagcctgaaggagctgcttcagaactggcttctttggctgagtatggacattcatatgaagccagtgactaattctccattagagactacccttgggggttccatgaattctgtgtccaagctgatccactatgtgggatggctctctacgaccgctatgcgtctggaatctaataacacattcctcctacatttcatcctcgatttttacgagaaggtttgtgatatctacatcaactataacctccctttggttgttctattccctcctggcatcttttactccgctctcctgtcacttgatactagcatcttgaatcagctctgctttatcatgcatcgatatagaaaaaatctgactgcagcaaagaagaatgaactggtgcagaaaactaaatctgagtttaatttcagctccaaaacgtaccaggaatttaaccattatctgacctcaatggtgggctgtttatggacaagcaagccgtttggcaaggggatctatattgaccccgaaatcctggaaaagacgggcgtggctgaatacaagaactctttgaacgtcgtccatcacccctcctttctaagctatgctgtctccttcctgttgcaggaaagtcccgaggaaaggacagtgaatgtgagttctattcgcggaaagaagtggtcctggtatctcgactatctttttagtcagggcctgcaaggtctcaaactgttcataaggagcagcgtgcatcactcatctattccgagggctgaagggatcaactgcaacaatcagtactag

SEQ ID NO: 30049 - DNA, 1941 bp, Artificial Sequence
  Description of Artificial Sequence: Synthetic coding sequence
gcacagggctccgtcagctttaacgatgtcaccgtcgactttacccaggaggagtggcagcacctagatcacgcacagaaaacactgtacatggacgtgatgttagaaaactattgccacctgatctccgtggggtgtcatatgaccaaacctgatgttattctgaagctggagcggggagaagagccctggacctcctttgcaggccatacctgtcttgaggagaactggaaggcggaggacttccttgtcaagtttaaggaacatcaggagaaatactctcgaagcgtcgtgagcattaatcataaaaagctcgtcaaggagaaatccaaaatttacgagaagacttttaccttaggtaagaatcccgtgaattcgaagaaccttccacctgagtatgatacgcacgggcgaattctcaaaaatgtgtcagaacttatcatctctaacctcaaccccgcacgcaaaaggttatcagagtataatggatacggtaaatctctcttgagcactaaacaggagaccacccacccggaagttaaatcccacaaccaatccgcaagggctttctctcacaacgaggtgttaatgcaataccaaaaaactgagaccccggcacaatctttcggctacaacgattgcgagaagtcttttctgcaacgcggaggcctgatcacacattcccgtccctacaaaggggaaaacccatccgtctacaacaagaaacgcagggccacaaacatcgagaaaaaacacacttgcaatgagtgtgggaagtcattctgtcggaaatctgtgctcattttgcaccagggcatacacagcgaggagaaaccctaccagtgtcaccagtgtggaaatgctttccggaggaagagctatttaatagaccatcagcgcacccatacaggagagaagccattcgtctgtaatgaatgcgggaaaagcttccgtttgaagactgcgttaacggatcaccagcggacccataccggagagaaatcttatgagtgcctccagtgcaggaacgcattccgcctgaaaagccacctgattcgacaccagcgtactcacaccggcgagaaaccctacgaatgcaacgactgcggtaaatcattccggcagaaaacaactctgagcttacaccagaggatccacaccggcgaaaaaccttatatttgtaaggagtgcgggaagagctttcaccaaaaagccaacctgacagtccatcagagaacacacactggcgagaaaccttatatttgtaacgagtgcgggaaaagctttagccagaagactacactggcgttacatgaaaaaacccataacgaggaaaagccttatatctgctcagaatgcgggaagagcttcagacagaaaacaactttagtggcccaccagaggacacacacaggcgaaaagtcatatgagtgcccgcattgcggaaaggcgttcaggatgaaatcctatctgatcgatcaccaccgaacgcacactggcgaaaagccctacgagtgtaacgaatgcggtaagagtttttcacagaagaccaacctgaacctgcaccagaggattcatactggcgagaagccatacgtgtgcaacgagtgtggaaaatcatttagacagaaagctacccttaccgtgcatcagaaaattcataccggtcagaaatcctacgagtgtccacagtgtggaaaagcattcagtcggaaaagctatttgattcatcaccaaagaacccatactggagaaaagccatacaagtgttccgagtgcgggaaatgcttcagacagaaaaccaacctcatagtgcatcagcgaacacacacaggcgaaaagccctacgtgtgtaacgagtgcggaaagtccttctcctacaagcgcaacctgatcgtgcaccaacgaacccataagggggaaaatattgagatgcaatag

SEQ ID NO: 30050 - DNA, 594 bp, Artificial Sequence
  Description of Artificial Sequence: Synthetic coding sequence
atgggagggagaaagcgtgagagaaaggcggctgtggaagaagacacctccctatccgagtccgaaggccctagacaaccagacggcgatgaagaggaatccaccgctctgagtattaacgaagaaatgcaaagaatgcttaatcagctgcgtgagtatgattttgaggatgattgcgattcccttacctgggaagaaaccgaggaaacactgcttttgtgggaggacttctctgggtacgccatggcagcagcggaggcacagggcgagcaagaggatagtctggaaaaagtgatcaaggacacagaatccctcttcaaaacccgcgagaaggaatatcaagagactattgaccagattgaactcgagttggccactgcgaaaaacgacatgaatagacacctacatgagtacatggaaatgtgtagcatgaagagaggactggacgtgcaaatggagacatgccggcgtctaatcacacagagtggagaccgcaaaagccccgcattcaccgccgtgcccctgtcagaccctccaccaagacaagcacggctgaggactcccattgcaatgtctcatttgaccgctccatag

SEQ ID NO: 30051 - DNA, 423 bp, Artificial Sequence
  Description of Artificial Sequence: Synthetic coding sequence
atggccatggctccatccccttctttggtacaggtgtacactagtcccgctgctgtggcggtgtgggagtggcaagacggtctcggtacctggcatccctacagcgccaccgtatgctcctttatagagcagcagttcgttcagcagaaaggccaaaggtttggcctgggtagcttagcacattctatccccttgggtcaggcggatccaagtcttgcaccttacattattgaccttccatcatggacccaattccgacaggacacggggacgatgcgggcagtgaggagacacttgtttcctcagcattccgcgcctggacgcggagttgtttgggagtggttgagtgacgacggatcctggactgcttatgaggcttccgtgtgcgactacctcgagcagcaggtcgctcggggaaattag

SEQ ID NO: 30052 - DNA, 3237 bp, Artificial Sequence
  Description of Artificial Sequence: Synthetic coding sequence
gtctgcatgcacccgcacaatgtgttatcagatgtggtgaattacaccctgtggttgatggaatgttctcacgcgtctggatgttgtcacgcaacaatgttcttctctatctgttttagttttagggcagtgcttgagctcttcgatcgctatgatggactgcggaggctggtgaacctaatcagcactttggaaattttaaacttggaggaccagggggctctcctgtcagatgatgagattttcgcatctagacagactgggaagcatacttgcatggctctgcggaagtactttgaggcacatctggcaataaaactggagcaggtcaaacagtcactgcagaggactgaggggggaattcttgtgcacccccaacccccatataaggcttgttcctatacgcacgaacagattgtggagatgatggaattcttgatcgaatacggacccgctcagctctactgggaaccagctgaggttttcttgaaacttagctgtgtgcagctgctcctgcagctgatctctatcgcctgcaactggaaaacgtattacgcccgtaatgataccgtgaggttcgccttagacgtattggcaattctgacagtagtgcctaaaatccagctccagctggcagagagcgtagatgttctggatgaagcagggtccaccgtgagcaccgtgggcatcagtataatcttaggggtggctgagggagagttcttcatccatgacgctgagatccagaaaagtgccctgcagatcattatcaactgcgtgtgcggccctgataacaggatctcttccattggaaagtttattagtggcaccccgcgacggaaattaccgcagaatcccaaatcgagcgagcatacccttgctaagatgtggaatgtggttcagtccaataatgggataaaagtcctcctgtcactcctatccataaagatgccaattactgatgctgaccagatacgagcactggcctgcaaagcactcgtaggcctgagccgttcgtctactgtgcgccagatcatatctaaattaccgctctttagtagctgtcagatccagcagttgatgaaggagcccgtgctgcaggacaaaaggtcagatcacgtgaagttctgtaaatacgctgctgagcttattgagcgggtcagcgggaaaccactgcttataggtacagatgtttctctagcccgactccagaaggcggatgtggtggcccaatcccgcatcagctttccagaaaaggagcttctcttgctgatccggaatcacttgatcagtaagggcctgggagagactgccacggtgctcactaaagaggccgatctgccaatgaccgccgctagccattctagcgcctttaccccggtgactgccgcagcctcgccagtgtctctgcctcgaaccccaagaattgccaacggaattgctaccagactgggctctcatgcagccgttggagcttcagccccttcagcacctaccgcccacccccagcccagaccaccacagggccctttggcccttccgggtccttcctatgcaggcaacagtcctctgatcgggcgtatctcattcatcagggaacggccatccccgtgcaacggtcggaagattagagtactgcgccaaaagagtgaccacggtgcatattcgcagtctcccgctattaagaagcagctggaccggcatttgcccagtcctcctactttggattccattatcacggaatacctgcgagagcagcatgccagatgcaagaaccccgtcgccacctgccctccgttctcactgttcaccccccatcagtgccccgaacctaagcagcgacggcaagcccctattaatttcacctccaggctcaataggcgcgcttcttttcccaaatacgggggagttgatggtggctgtttcgataggcatcttatctttagtagattccgcccaatctccgtgtttagggaggcaaacgaagacgagtctgggtttacgtgctgcgctttctctgcgcgagaacgattcctcatgctgggcacctgcaccggccagttaaagctgtataatgtcttttctgggcaggaggaggctagctataactgtcacaactcagcaatcacccatctcgaaccctctagagacgggagtctcctgttgacttctgcaacgtggtcccaaccgttatctgcactctgggggatgaagtccgtgttcgatatgaaacatagctttactgaggaccattatgtcgagttctccaaacatagccaggacagggtaatcggcaccaaaggggatatcgcccatatttacgacattcagacaggcaataagctgcttaccttatttaaccctgatctggccaataattataaacgaaactgcgctactttcaatcctacagacgatcttgtcctcaatgatggggtcttgtgggacgtgcggagcgcccaggcaattcacaaattcgacaagttcaacatgaacattagcggcgttttccatcctaatggcttagaagtgattatcaacactgagatctgggacttgcgtacattccacttgctgcacaccgtgccagctctcgaccaatgtcgggtggtctttaatcacactgggacagtaatgtatggggctatgctgcaggcagatgacgaagacgatttgatggaagaacgcatgaagagtcctttcggatccagctttcggactttcaatgccacagattataagcctattgctacaatagacgtgaaacgtaatatcttcgatttgtgtaccgatacaaaggactgctatctcgccgtcattgagaatcaggggagtatggacgcgctgaacatggacactgtgtgtcgattgtatgaggtcggccgacagcggctggcagaagacgaggatgaggaagaggaccaagaggaagaggagcaagaagaagaagacgatgacgaggacgacgatgacacagacgacttggacgagctcgacactgatcaattacttgaagccgaactcgaagaagacgataacaacgaaaacgccggagaagacggcgacaacgacttttcccccagcgacgaagagctcgcgaatttgctcgaggaaggagaagacggagaggacgaggactccgatgccgatgaggaagtcgagctgatactcggggacacagactcttccgacaacagtgatctggaagacgacattatcctgtctttgaatgaatag

SEQ ID NO: 30053 - DNA, 447 bp, Artificial Sequence
  Description of Artificial Sequence: Synthetic coding sequence
atgctgtctgacggttgcggttcagaggaaaagataagtgtccctagctgttacggcggtattggcgctccagtatcaagacaggtccccgcttctcatgattcagagcttatggccttcatgaccaggaagttatgggacttagagcaacaagttaaggcacagaccgacgagatccttagcaaagaccagaagattgctgccttggaggacctggtgcaaacactcagaccacaccctgccgaggcgacacttcagcgacaggaggagctggaaaccatgtgcgtgcagctccagcgccaagtgcgcgagatggagcgctttctgagcgactatgggctgcaatgggtgggcgagccaatggaccaggaggactcggagtctaaaacagtgtccgagcacggtgagcgggattggatgaccgcaaagaagttctggaaaccatag

SEQ ID NO: 30054 - DNA, 1755 bp, Artificial Sequence
  Description of Artificial Sequence: Synthetic coding sequence
atgagcctgccccctgaaaaggcctccgagctgaaacagttgatccaccagcaactgagtaaaatggacgttcatggtagaatccgcgagatcttggccgagaccattagagaggaactcgcgccagatcagcagcacctcagcaccgaggatttaatcaaagcactccgaagaaggggaatcattgacgacgtgatgaaggagttgaacttcgtgaccgactctgtggagcaggagttaccttcctctcctaagcagcctatctgcttcgaccgacagtccacattgaagaagtcagatgggacccgaatggcggatagcaccaccatgcttagcatatccgatcccatccatatggtgcttatcaagacagacatcttcggtgagaccacgctcgttgcatcttatttcctggagtggcgctcagtcttgggatcagaaaatggggtcaccagtttaaccgtggagctgatgggggtaggcacagaatccaaagtgagcgttggaatcctaaacattaaactcgaaatgtatccccctctgaaccagaccctctcgcaggaggtggttaatacccagctcgctctggagaggcagaagacagccgagaaagaaaggctatttttggtgtatgcaaagcaatggtggcgcgagtatctccagatccggccaagccacaattccagacttgtgaagatttttgcccaggatgagaatgggatcaaccggccagtatgcagctacgtgaagcccctgcgggcaggtcgcctgctggacacgccgcgacaggccgctaggttcgtgaacgttctgggatatgagcgcgctcccgtcatcgggggagggggtaagcaggaacaatggtgcacactgctcgcctttctttgtcgaaataagggcgactgcgaggaccatgccaacctgctgtgtagtctgctgctggggtacggcctggaggcattcgtttgcgtcggaacaaaggctaaaggtgtgccacatgcgtgggtgatgacatgcgggacagatggagcgattactttttgggagtctttaactggccataggtacatccacaagcccaccaaccctgatgaacctcctgttgctgagcagcctaagcccttatacccctacaggacaatcggctgtgtcttcaaccaccagatgtttctgggcaattgtcaaccaagtgacgccgtggagacttgcgtgttcgacctgaacgatgagagtaaatggaagcctatgtcagaagaggcaataaagtcggtgtgcgcacctggggctacaaccagcctgccccctttccccccactatgcgcctcaacaattgacgcttctgtaaccagcaacgaaattgagatgcaactccggctgctcgtgtctgaacacaggaaagatctggggttgaccacagtctgggaggatcagctcagctatctgctttcaccagcgctggcatcttatgagttcgaaaggactacaagcatctctgccggtaatgaagagttccaggacgcaattaggagggccgtccccgacggtcacacctttaaaggattcccaatccatttcgtatatagaaacgcaagacgggcattcgccacttgtctcagaagcccattttgtgaggaaattatctgctgtcggggagatcaggtacgcctcgcggtgcgagtcagagtcttcacttatccagaaagtgcctgtgccgtttggattatgttcgcttgcaagtacagaagcgtgctctag

SEQ ID NO: 30055 - DNA, 4515 bp, Artificial Sequence
  Description of Artificial Sequence: Synthetic coding sequence
atggtgagcgagagcgatttctctaaggacgtggctgtccaggtactccctctggacaagatcgaggagaataataagcagaaagctaatgacatcttcatctcccagtacaccatgggtcaaaaggacgccttgcgaaccgttctcaaacagaacgtgtccctctgcttaaccggctggtccgatcactcaggcgttatcaccacgcactgcagtctttatttgctgcggcttatgcgttcatcccacttgagtctgcccagttcttgggattatcgcgcacagtctatgcctgtgtttaaggaagtaaaagtgcatctgttagaagatgcagggatcgagaaagacgcagtgactcaggagacaagaatctctcccagcggcatcgatagtgcaaccacggtggcggcagcaacagcggctgctatagcaacagcagcaccgctgatcaaggttcaatccgacctcgaagcaaaggtgaatagcgtgacggaattgcttagtaagctccaggaaacagataagcacctgcagagggtgaccgagcaacagacatctattcaacgcaagcaggagaagcttcattgccacgaccacgaaaaacagatgaatgttttcatggaacagcatatccggcacttagaaaagctgcagcaacagcagattgatatccagactcattttatctctgctgctttaaagacaagttcatttcaacctgtatcaatgccttctagcagggccgtagaaaagtactcggtgaagccagaacatcccaacctgggttcttgcaatcccagcctgtacaacacctttgccagcaaacaggctcctctgaaggaagtggaagatactagcttcgataagcaaaaaagccctcttgagacaccagccccaagaagatttgctcctgtccctgtgtcacgcgacgatgagctcagtaagcgggagaatctgcttgaagagaaagagaacatggaggttagctgtcacagaggcaacgtgaggcttctcgagcagatcctcaataataatgattccttgacccggaagtctgagtctagcaacacaactagcttgactagatcgaaaatcggctggacccctgaaaagactaatcgattcccttcctgcgaggagctggaaactactaaggtcactatgcagaaatcagatgacgtactccatgatctcgggcaaaaagagaaggaaactaacagcatggtgcagcccaaggaaagcttaagcatgttaaagctgcctgacctcccccagaatagcgtgaagctgcagaccactaatactacacgttccgtcttgaaggatgccgagaaaatcttgagaggcgtgcagaataacaaaaaggtgttagaggagaacctggaagccattattcgggcaaaagacggcgctgccatgtactcactcatcaatgcgctctcaaccaatagggagatgtcagagaagatcagaattagaaaaaccgtggacgaatggattaaaacaatatctgcggagatacaagacgaattgagccgcactgactacgagcagaagaggttcgatcaaaagaaccagaggactaaaaaaggacagaacatgaccaaagacatccggaccaacacacaggacaagaccgtcaataaatccgtgatccctcggaagcactctcagaaacagatcgaagaacacttccggaatctgcctatgcggggaatgcctgcctcgtccctacaaaaggagaggaaggagggtcttctgaaggcaaccaccgtcatacaggatgaggactatatgctgcaggtctacggaaaaccagtgtatcaaggtcaccgtagcacactgaaaaaaggtccttatcttaggttcaattccccttctccaaagagcaggccacaaaggccgaaagttatcgagcgggttaagggcacaaaagtgaaatccatcagaactcagactgacttctacgcaaccaagccaaagaagatggattctaaaatgaagcatagtgtgcccgttctgcctcatggggaccagcagtacctcttctcccccagcagggaaatgccaaccttttccggtacactggagggacacctgatacccatggccatcctgcttgggcagacccagtctaactcagacacaatgccccctgcgggtgtcattgttagcaagcctcaccctgttacagtcaccacttccatacctccctccagtcgaaaagtcgaaaccggggttaaaaaacctaatatcgcaatcgtggaaatgaaatctgaaaaaaaagatccacctcaactgactgttcaagttctgcctagtgtagacattgactccatatctaactcctcggcggacgtgctgtcacctctgagctcgcctaaggaggctagcttgccaccagtacagacctggatcaagacaccagagattatgaaagtagacgaggaggaggtgaagtttcccggtactaatttcgacgaaataatagacgtaatacaggaggaggagaaatgcgacgagatacccgactcggagccgattctggagttcaacagatctgtgaaagcagatagcactaagtacaacgggccacccttcccaccggtggcctcaacatttcagccgactgctgatattctggataaggtaatcgaacgcaaagaaaccctagagaatagtttaatccagtgggtcgagcaggagatcatgagccggattatctcaggtttgttccctgtccagcagcagatcgccccttccatctcggtgtcagtgtcagagacaagtgagcctctcacctctgatatcgtggaggggacttcatctggagcattgcagctgtttgtggacgcaggcgtaccagtcaatagcaatgttatcaagcactttgtgaatgaagccctggcagagacaattgctgtgatgctcggagacagggaagcaaaaaaacaaggcccagttgcgacaggggtatccggcgatgcttcaaccaatgaaacatatctgcctgcgagagtctgtactccactgcccaccccccagccaacccccccttgcagccccagtagcccggcaaaagaatgcgttttggtaaagacccctgacagttcaccctgtgattccgaccatgacatggctttccccgttaaggaaatatgcgctgagaaaggcgatgacatgcccgctatcatgctggtaaacacaccaaccgtgaccccaactaccacgccgcctcccgcagcagcagtatttacacctaccctatctgacatcagtatagacaaactgaaagtcagctcccctgaactgccaaaaccttggggtgatggagatctacccttggaggaggaaaaccccaactctccacaagaggaactgcaccccagggcaatcgtcatgagtgttgccaaagatgaagagccagaatccatggattttcctgcacagcctcccccacccgaacctgttccgttcatgccattccctgccggaacgaaagccccatcaccttcccagatgcccggatccgattctagcaccctagagtcaacgctttctgtaacagtgactgagactgaaaccttagataagccaatttcagagggagagattctcttctcctgcggccagaaactggcccctaaaatacttgaagacatcggcctgtacctcacaaacttgaacgatagtctgagctcaaccttgcatgacgctgtagagatggaggacgacccaccatccgaaggccaagtcattagaatgtcacataagaagttccacgccgacgccatccttagcttcgccaaacaaaaccaggaaagcgccgtctcacaacaagccgtgtaccactccgaggatctggaaaattcagtgggcgagctttcagagggccaaagaccacagctgactgccgcagccgaaaacatcttgatggggcacagcctgtatatgcaaccacctgtgaccaacacccaatctctcgatcagcagtgtgacccaaagcctctgtcccgccagttcgatacggtatccggcagtatatatgaagactcctgcgcttcacatggcccaatgagcctcggcgaactggaactggaaccgaactccaaattggtactgccaacaaccctccttaccgcacaggagaacgacgtcaatcttcccgtggccgctgaggatttttctcagtaccagctgaaacagaatcaggatgtgaagcaagtcgaacacaagcccagtcagtcgtacctgcgggtcaggaacaagtccgacatcgctccaagccagcaacaggtaagccctggcgatatggaccgcacccagatagagctgaatccatatttgacttgcgtgttttcaggaggtaaggccgtgcccctgtccgcctcacagatgcctcctgctaaaatgtcagtgatgctgccttcggttaatctggaggactgtagccagtccttaagtctcagtacgatgcaggaagatatggagagttctggcgctgacacgttctag

SEQ ID NO: 30056 - DNA, 2271 bp, Artificial Sequence
  Description of Artificial Sequence: Synthetic coding sequence
atggtggcccctgtgctcgagacaagtcacgtcttctgctgtcctaatcgtgtccgcggagtgttaaattggagctctgggccacggggactgctcgctttcggtacgagttgctccgtcgtcctatacgatcccctcaaaagggtagtggtgacgaatctcaacgggcacaccgccagggtgaattgtattcaatggatctgcaagcaggacggaagcccaagcacggagctggtgtcaggaggctccgataaccaggtgatccactgggagatagaagacaatcaactactcaaggcagtacacctacagggccacgagggccctgtgtatgccgtccacgcagtgtatcagcgccgaacatcggacccagccctgtgtaccttgattgtgagtgcagcagcagattccgctgtaagactttggagtaaaaagggccctgaaggcagggacttattcctagcttcctgctcccaggactgtctgattcgtatttggaaactgtacataaaatctacatctctggagacacaggatgatgataacattcgcctgaaagagaacacttttaccatcgaaaacgaaagcgtcaaaatagccttcgccgtgacactggaaacagttctcgccggacacgagaattgggtgaacgccgtgcactggcagcctgtgttctataaagatggggtgctgcagcaaccggtgcggttactctcagcatccatggacaaaaccatgatcctctgggctcctgacgaagagagcggcgtttggttggagcaggttagggtgggggaggtgggcggtaacaccctcggattttacgactgccagttcaatgaggatggctccatgattatagcgcatgcctttcacggcgcactgcacctgtggaagcagaatacagtcaatcccagagagtggactcctgagattgttataagcgggcatttcgatggcgtgcaggatctggtatgggaccctgaaggagagttcattattactgtgggtaccgatcagaccacacgactgtttgctccctggaaaaggaaagaccaatctcaggtgacttggcacgagattgcacggcctcagatccatggttacgatcttaaatgtctcgcaatgatcaaccgtttccaattcgtctcgggagccgacgagaaagttttgcgggtgttctcagcccctaggaactttgtagagaacttctgcgccataactggccagagcttgaaccacgttctttgtaatcaagattccgatctacccgaaggtgcaactgtcccagcgctcgggctttccaataaggctgtgtttcagggcgacatcgcctcacagccctctgacgaagaagaattgctaacatcgacaggatttgagtatcagcaagtggcgtttcagccttccattctaaccgagcctcccacagaggatcatctgctccagaataccctttggccggaggtccaaaaactgtacggccatggctacgagattttttgtgtgacctgcaattcttccaaaacccttttggcctctgcctgtaaggctgcaaaaaaggagcatgcagccatcatcctgtggaacaccacctcctggaaacaggtgcagaatttggtattccacagcctgacagttactcagatggcgttttcccctaacgaaaaattcctgctggctgtctcaagagaccgaacctggagtttatggaaaaaacaggacacaatctctcctgaattcgagccagttttttccttgttcgcatttacaaacaagattacatcggtccactcacgtattatctggtcatgcgactggagtccggattctaagtattttttcacaggcagcagggacaagaaggtagtggtgtggggagaatgcgacagtacagacgattgtattgaacacaatatcgggccatgttcttcagtactggacgtcgggggtgctgtgacagcagtctctgtgtgtccagtactgcacccaagccagcgctacgtagtggcagtgggacttgaatgcggtaagatctgcctctacacctggaagaagactgatcaggtccctgagattaacgactggacgcattgtgttgagactagccagagtcagagccacactctggctatacgtaagctgtgttggaagaactgttctggcaagactgagcagaaagaggccgagggcgcagaatggctacacttcgcatcctgtggcgaggaccacaccgtgaaaattcacagagtcaataagtgtgctctgtag

SEQ ID NO: 30057 - DNA, 345 bp, Artificial Sequence
  Description of Artificial Sequence: Synthetic coding sequence
atgcaggagatcaatcagaacttggccgaggaggctggcctgaatatcacacacatttgccttccaccagactcgtccgaggcagaaattattgacgagatattaaagatcaatgaggacactagggtgcatggcctcgctctgcagatatccgaaaatctctttagcaacaaagtgctaaacgcactcaagcctgaaaaagacgttgacggtgtgacagacatcaatctggggaaattagtcaggggagacgcgcatgagtgtttcgtcagccccgtagccaaagccgtgatcgagttgcttgaaaagagtggcgtcaacctcgatggcaagaaaatcttgtag

SEQ ID NO: 30058 - DNA, 747 bp, Artificial Sequence
  Description of Artificial Sequence: Synthetic coding sequence
atggcaactagcgctccattgcgatcactcgaggaagaagtcacctgcagcatctgtctggattacctcagagatccggtgaccatcgactgcggtcatgttttctgccggtcttgcaccactgacgtgcgcccaataagtgggagtagaccagtttgtccactctgcaaaaagccctttaagaaagaaaacatcaggccagtttggcagctggcctccctggtggagaatatcgagagattgaaggtcgataaaggccgtcagcctggcgaggtaacgcgcgagcagcaggacgctaaactctgcgagcgccatagagagaagttgcactactattgcgaggatgacggcaagttactgtgtgtgatgtgccgggaatcaagagagcaccgacctcacaccgccgtgctaatggagaaagccgctcagcctcatagggaaaaaattctgaaccatctctctacattgcgaagagaccgagataagattcagggtttccaggccaagggcgaggcggatatattagcagctctcaagaaactccaagaccagcgccaatatattgtggcagaattcgaacaaggccatcagtttctacgggagagagaggaacacctgcttgagcagctggccaaattagagcaagagctgactgaaggcagagagaagttcaagtcacggggagtgggggagctggccagactcgctctcgtcatttctgaactcgagggtaaggctcaacagtag

SEQ ID NO: 30059 - DNA, 1461 bp, Artificial Sequence
  Description of Artificial Sequence: Synthetic coding sequence
atgacctgtgggagctattgcggaggcagagcgttcagctgtatctccgcctgtggacccagaccgggacggtgttgcatcacagccgcaccctatcggggtatttcctgctacaggggcctcacagggggtttcggatcacatagcgtgtgcggcggatttcgggctgggagctgtggacggagcttcggctaccgctcaggcggagtctgtggccctagccccccatgcatcacgacagtgtccgtaaatgagagcctcttgacacctctgaaccttgagatcgaccctaacgcccagtgcgtcaaacaggaagagaaagaacaaatcaaatctttgaactcacgattcgcggctttcatcgacaaggtacgttttctggagcaacagaataaattgttagagaccaagctccagttctatcagaacagggagtgttgtcaaagcaatctggagcctctgttcgaaggctacattgagacactaagacgcgaggctgagtgtgtcgaagcagatagcgggaggctcgccagcgagctcaaccacgtccaggaggttcttgagggatacaaaaagaaatatgaggaggaagtctcgttgagggccacagcggaaaacgaattcgtcgcccttaagaaagacgtcgattgcgcttacctgaggaaaagcgacctggaggccaatgttgaagcattgattcaagaaattgactttctgcgccgattgtacgaggaggagattcgcgtcctacagtcacatatcagcgacacgtcagtggtagtaaaactggacaactcccgtgacctgaacatggactgtatcatcgcggagattaaagcgcagtatgatgatatcgtgactcggagtcgggctgaagccgaatcctggtatcgaagcaagtgcgaggaaatgaaggctaccgtaatcagacacggagaaaccctgaggcggactaaagaggagattaacgagcttaaccgtatgattcaaagattaactgcagaggttgaaaatgcgaaatgtcagaacagtaaactcgaagcagccgtggctcagtcagagcagcagggtgaagctgccttatctgacgcccgatgtaagctggcggagctggaaggggctctgcagaaagccaaacaggacatggcctgcctcatacgtgagtaccaggaggtgatgaacagtaagcttgggctggacatcgaaatcgccacttatcggagattgttagagggagaggaacagaggttatgtgagggggtcggatccgtgaacgtctgcgtgagtagcagtcggggtggagttgtctgcggagacctgtgcgccagcacaaccgctccggtcgtctccacccgagtgagctccgtccctagtaattccaacgtggtggtggggactacaaacgcatgcgccccatccgccagggttggtgtctgtggtggctcctgtaagcggtgttag

SEQ ID NO: 30060 - DNA, 1710 bp, Artificial Sequence
  Description of Artificial Sequence: Synthetic coding sequence
atggcactactctcagagggacttgatgaggtgccggcagcctgtctgagcccctgtggccctcccaatcctaccgagctcttttcagaaagccgaagactcgcactggaggagctcgtggcagggggtcccgaagcgtttgccgctttccttagaagggaacggctggccagatttctcaaccccgatgaggttcacgccatcctgagggctgccgagcgacccggtgaggaaggcgcagctgctgccgcagctgccgaggattcctttgggagttcccatgattgctctagcggtacctactttccagaacaatccgacctggagcctccactcctagagctgggatggccggcattctaccagggtgccggagaggggggaccctacggatgtaaagatgctctgcgccaacagctgcgcagcgccagagaggtgatcgccgtggtcatggacgtgttcacggacatcgatattttcagagacttgcaggagatctgccggaagcagggtgtcgccgtttacatcctacttgaccaggccctcctatcgcaatttctggacatgtgtatggacctcaaagtgcatcccgaacaggagaagctaatgacggtccgtacgattaccggcaacatttattatgcccgaagcggaacaaagatcattggcaaagtgcatgagaagtttactctcattgacggcatccgagtcgctactggatcctactcctttacatggactgacggcaaattaaacagtagcaatctggtaattttgtcagggcaagttgttgagcacttcgatctggagttccgtatcctgtatgctcagtccaaacccattagccctaaactgcttagccattttcagagttcgaataagtttgaccatttgacgaaccgcaaaccacaaagcaaggagcttactctgggcaatttactgcgcatgcgcctggccagactttctagcacgccaagaaaggccgatcttgatcctgagatgccagcagaaggaaaagctgaacggaagccacacgactgtgagtccagtactgtgtcggaggaagactacttctcgagtcaccgtgatgagctgcaatctcgaaaggcaatcgacgccgctacacagacagaacccggagaggaaatgccgggattgagtgtgagtgaagtcggtacccagacgtctattactacagcatgtgccggaacgcagacagctgtgataacccgaattgcctcgtctcaaacaaccatatggagtcggtctaccacgacacagaccgatatggacgagaatattttgttcccaaggggtacccagtcgacagaaggatctcctgtatccaagatgtccgtgagtagaagcagcagcctaaagagctcctccagcgtttcaagccaaggcagcgtcgcatcatccacaggctctccagcctccattcgtacaactgatttccacaacccgggatacccgaaataccttggaacaccacacctcgagctgtatctgagcgattcgctgagaaacctgaataaagagcgtcagtttcactttgctggaatacgatcgcgcctgaaccacatgctcgctatgttgagcaggagaactctgtttacagaaaaccaccttgggctgcattctggcaatttcagccgagttaatctcctcgctgtaagagacgtggccttatatcctagctatcagtag

SEQ ID NO: 30061 - DNA, 1224 bp, Artificial Sequence
  Description of Artificial Sequence: Synthetic coding sequence
atggtactgttttcggactccagtctgccacattggcagcagcagccccctcagccagcgcctcccccaccgctgtttcctaggcaacaacaggtgcaagtcaataagggtcgagtaaactgtcaccccagatgtcgctacataaagacaaaaccttgccaccagttgagccaccaggtgtgggttcagcagaagccctcacacagactgctcagcctgcaactgagcccttccccaaagcctagcccaagcccacagctttctctgaaattccgtctctcactgaagtttagacccaagcagttgttccatcccatgtcattgctgaaacacaatccgccaactcacagtcacccttccccaaaactgcagcaatctcagccacagagcaacgtgcaggggcagtcgcctgtccgggttcagagcccgtcacaaacaaggattcggccatcaacgccctcgcagttgagcccagggcagcaatcccaggtgcagactacaacaagccagcccatccccattcaacctcataccagcctgcagatccctagccagggccaaccccaatcacagcctcaggtcgttatgaagcacaacgcggtcattgagcacctgaagcagaagaaatccatgaccccagctgagagagaggagaaccagaggatgattgtgtgtaaccaggttatgaaatacatcttggataaaatcgacaaggaggagaagcaggctgccaaaaaaaggaagagagaagagtccgtggagcagaagagaagcaagcagaacgctacaaagttgtcggctcttctcttcaaacataaagagcagcttagggccgagatactcaagaaacgggcactcctggataaagatctgcaaatagaggtccaagaagagctgaaaagggacctgaagattaagaaggagaaggacctgatgcagctggctcaggcaacagctgtggccgcaccctgccctcctgttacgcctgctccccctgctccccctgcaccgcctccatccccccctccgcctcccgctgttcagcacaccggacttctgagtaccccaaccctgcccgctgcctcacaaaaaaggaagcgggaggaggagaaggacagcagttcaaagtcgaaaaaaaaaaagatgatcagcaccacctcgaaagaaactaaaaaggacactaagctgtactgcatctgtaagaccccttacgatgagtcctag

SEQ ID NO: 30062 - DNA, 480 bp, Artificial Sequence
  Description of Artificial Sequence: Synthetic coding sequence
atggccacttcagcgccactgcgttccttggaagaggaggtgacatgttctatttgtcttgactacctcagggacccggttaccatcgactgtggtcacgtgttctgtcgctcctgcaccactgacgtgcggcctatcagcgggagccgccctgtttgcccactgtgtaagaaaccgtttaagaaggaaaatatcagaccagtgtggcagctcgagaaaatcctgaatcatctcagcactctcaggcgcgatagggataaaatccaagggttccaggcgaagggcgaagcagatatccttgccgctttgaaaaagctccaggaccaaaggcaatacattgttgccgagttcgaacagggacatcagttccttcgtgagagggaagagcacttgctagaacaactcgcaaagctggagcaggaactaacggagggcagagaaaagtttaaatcaagaggcgtgggcgagctggcgagatag

SEQ ID NO: 30063 - DNA, 309 bp, Artificial Sequence
  Description of Artificial Sequence: Synthetic coding sequence
atgaatgaggctgagatcgttgacgttgcccttgggattctgattgagtcaagaaaacaggagaaggcatgcgagcagcctgcattggctggggcagataatccagaacacagccctccctgtagtgtgtcaccacatacctcatcaggcagctctagtgaggaggaggattcaggcaaacaggccctggctcctggcctatccccttcccagaggcccggtggttcctcttccgcatgttccaggtctccggaagaggaagaggaagaggatgtgctgaaatacgttagggaaatcttttttagttag

SEQ ID NO: 30064 - DNA, 345 bp, Artificial Sequence
  Description of Artificial Sequence: Synthetic coding sequence
atgcagttcggtgagctactggctgctgtcagaaaagcacaagctaacgttatgctgttcctggaagaaaaggagcaggctgccctgtcacaggctaatggcatcaaagctcatcttgaatataggagcgcagaaatggagaagtcaaagcaggagcttgaaacgatggctgccattagtaatactgtccaattcttggaacgctctatgacatcagaacttaagtgcttgccattgttttcggctaacatcggactccctaacttgagtccggctcccggaaactcttcctccaacatgtgcatgacttcccgcagcacccgaacccaacacaccagcatctag

SEQ ID NO: 30065 - DNA, 579 bp, Artificial Sequence
  Description of Artificial Sequence: Synthetic coding sequence
atggcacctaaaccaggggcagaatggagcacagctctgtcccacttggtactcggggtagtgagcttgcacgctgcggtgtcaacagccgaggcatcccgcggtgcggctgcgggattcctgcttcaggtgctggctgccacgaccacattggcgcctggattatccacacatgaggactgcctcgccggtgcatgggtggctacggtcattggtctgcccttactagcatttgattttcactgggtcaacggcgatagaagcagcgcaaatcttttacttgggggaggcatggtgctggcagtagccggagggcacctgggcccagaggggagaagtgttgccggtcaagcaatgctgttagttgtcgctgtgacgattctgatcgtcgccgtgttcaccgccaacacgtatgggatgtggggaggggctatgcttggagtagctggcttgctcagcaggctcgaggaagatcggttgttgctcctgccaaaagaagatgtctgccgatgggcacttgcagtcgggtcttgggcctattgtagagcattacatacgcaaaggctgcaatgggaatag

SEQ ID NO: 30066 - DNA, 888 bp, Artificial Sequence
  Description of Artificial Sequence: Synthetic coding sequence
atgaaacagtacggtttaggccctaatggtggcatcgtgacaagtttgaacctattcgctactcgtttcgatcaggttatgaagttcatcgaaaaggcacagaatatgtcaaagtatgtgctgatcgacactcccggtcagatcgaagtcttcacctggtcggcttccggtaccatcattactgaggcactggcctcatccttccctacggtggtcatctatgttatggatacctcaaggtccaccaatcccgtcaccttcatgtctaacatgttatatgcatgcagcatactttataagaccaagctaccgtttatcgtggttatgaataaaactgacatcatcgatcacagttttgcagtcgaatggatgcaagatttcgaggccttccaggatgcactcaatcaggaaaccacatacgtgtcaaacctgacccgttctatgtctctggtcctggacgaattctactcatctttaagagttgtgggtgttagtgctgttctgggaacaggtcttgacgaactttttgtgcaggtcacatccgccgcagaggagtatgagagggagtaccggcctgaatacgagcggttgaagaagtctctggccaacgccgagtcacagcagcagcgcgaacagctggagcgcttgcggaaagacatgggcagtgttgctctggatgctggcaccgctaaagacagcctgtcccccgtcctccaccccagcgacttgattctcacccgcggaaccttagatgaggaagacgaggaagctgactccgacactgatgatatcgatcatcgcgtaactgaagaatcccacgaagagccagctttccagaacttcatgcaggaaagcatggcccagtactggaagagaaataacaaatag

SEQ ID NO: 30067 - DNA, 1212 bp, Artificial Sequence
  Description of Artificial Sequence: Synthetic coding sequence
atgcccagcgccgaggctaagctcaaaaagaataggtgcgccaattgttttgattgtccaggttgcatgcataccttatcgacacgggctacaagtatttccacacaactaccagatgatcccgctaaaaccaccatgaagaaagcatattatctggcctgcggcttttgcagatggacgagtcgcgacgttggcatggcagacaagtcagttgcatcaggcggatggcaagagcccgagaacccccacactcagcggatgaataagttgatcgagtactaccagcagctggctcagaaggagaaggtggaaagagaccgaaaaaagcttgccagaaggcggaactatatgccccttgcattctcagataaatacggactgggcacaaggctgcagagacctcgcgctggcgcatccatctcaacccttgcgggtctttccctaaaggagggtgaggatcagaaagagataaaaatagagcctgcacaagccgtggacgaagtggagcctctgcccgaggattattatacaaggcctgtgaacctcactgaggtaactacacttcaacagaggctgctacagccagacttccagccagtttgcgcttctcagctctacccacggcacaagcatctgctgattaaacggtccctacgatgcagaaagtgtgagcacaatctgtccaagcctgaatttaaccctaccagcattaaattcaagatccagctcgttgccgtgaattatatcccagaagtgagaattatgtcaattcctaatctgagatacatgaaagaatcacaagtgctgctaacactaaccaaccctgttgaaaatctcactcacgttaccctgttcgagtgcgaggagggcgaccctgacgacattaattcaactgctaaagtcgtggtgcccccaaaagagcttgtgctcgcgggtaaagacgctgccgcagagtatgacgagcttgccgagccacaggatttccaggacgacccagatataatcgcttttcgcaaggccaacaaggtgggaatcttcatcaaagtgacacctcagcgggaagaaggcgaggtgacagtctgctttaagatgaagcatgacttcaagaacctcgccgcaccaatccgtccaatcgaggaatcagaccagggtacagaggtcatatggctgacgcagcacgtcgaactgtctctaggccctttactgccttag

SEQ ID NO: 30068 - DNA, 1674 bp, Artificial Sequence
  Description of Artificial Sequence: Synthetic coding sequence
atggaccaaagtcgggtgctcctatgggttaaggctgaacccttcatagtgggcgcactccaggtaccaccaccctcaaagttttctttgcactatctccgtaagattagcacttatgtgcagatccgggctaccgagggagcctaccctagactctactggagcacctggcgacatattgcttgcggaaagttgcagctggccaaagacctggcctggctgtactttgagattttcgattccctgagcatgaaaacgcccgaggaacgccttgaatggagtgaggtgttgtcaaattgtatgtctgaagaagaggtggaaaaacagcgcaatcaactgtccgtggacacgttgcaattccttctctttctgtatatccagcaattgaacaaagtcagtttaaggacgagtctcatcggagaggagtggcctagcccgcgtaataaaagccagtcccccgacctaaccgagaagagcaattgccataacaagaattggaacgattatagccaccaggccttcgtttacgaccacttgagcgatcttttggaattactgttggatccaaagcagcttaccgccagtttccattccactcatagctccctggtcagccgagaagccgtggtggctctgtcttttctcattgagggaaccatctcgagagccaggaagatctaccctcttcatgagcttgccctgtggcaacctctgcacgccgattctggcttttctaaaatcagtaagacattcagcttttacaaactcgaaacatggctgagatcatgccttacaggcaatcccttcgggacatccgcgtgcctgaagtcaggtaagaaactggcttgggcacatcaggtggaagggactaccaagcgggctaaaatcgcttgtaacactcatgtggcaccgagaatgcaccgcctggttgtcatgtcccaggtctataagcagacgctagccaagagctccgacaccctggccggagcccacgtgaagatacaccggtgcaatgagtcattcatatatcttctcagcccacttcggtctgttactatcgagaagtgccggaattctatttttgtgctcggtcccgtgggcacaactcttcacttgcacagctgcgataatgttaaagtgattgcagtctgccaccggctttccatctcctccacaactggttgtatttttcatgtcctgacacccactaggccacttatactctcgggcaaccagactgttacctttgctcctttccacacgcactacccaatgcttgaagaccacatggccaggacaggactggccacggtccccaactactgggataaccccatggtagtatgtagggagaattctgatacccgggtatttcagctgctaccaccatgcgagttctatgtcttcattattccatttgaaatggagggcgacacaaccgaaatccctggcggacttccttccgtgtatcagaaggccctgggccagcgcgaacaaaaaatccagatatggcagaaaactgtgaaggaggctcacctgaccaaggaccagcgtaaacagttccaggttctagtggagaataaattctatgagtggctcattaatactggacatcgccagcagttagactccctagtgcctcctgcagcgggttcaaagcaggcggcagggtag

SEQ ID NO: 30069 - DNA, 462 bp, Artificial Sequence
  Description of Artificial Sequence: Synthetic coding sequence
atggccgagcaggaacagcgcaaaatccccttagtgcctgaaaacctgctgaagaaacggaaagcctaccaggccttaaaggccacccaagccaaacaggctttgctggctaagaaagaacaaaagaagggcaagggcctgcgttttaaaaggttggaaagctttctacatgactcatggcgacaaaaacgggataaagtccgcctgcgacggcttgaggttaagccccacgctctggagctcccagacaaacattcactggcctttgtagtgcgaattgagagaatcgatggcgtgtccctgctggtgcagaggaccattgccagactccgtttaaagaagatcttttcaggcgtgtttgtaaaagtgactccccagaatcttaaaatgcttagaattgtggagccgtatgtcacatggggcgaggtgtggaggcatctgttgggcaggccacatagttag

SEQ ID NO: 30070 - DNA, 2070 bp, Artificial Sequence
  Description of Artificial Sequence: Synthetic coding sequence
atgatcgactccgttaaactgaggcgcgattcggcggctgatttcttcagccactacgaatacctgtgcgcgctgcagaatagcgtacctctgcctgctgtgcgggcatgtctgagggaaggcgtgctggactttaatgccgatagactcaggggcgtcgactgggccccactgttgagcaccctcaaaattaataaggaccttcccctggtgtccatcaaatccttctttcagccctggctgggcgacaccggatcggacatgaacaaattctgcaggagtcgcgttcccgctatccgttacaaagacgtaacttttcagctgtgcaaggcgcttaaagggtgtcttagcattagcagtgtccttaagaacttggaattaaatggactgatattgcgtgagcgcgacctcacaattttggccaaaggattaaataagtctgcatccctcgtgcatctttctctcgcaaactgccccataggtgacggcggactagaaataatatgtcagggtatcaaatcttctattaccttgaagacagtgaatttcaccgggtgcaaccttacctggcagggcgcagatcacatggcgaaaattttgaaatatcagaccatgcgaaggcacgaggaaacgtgggcagagagtctgcgatataggcgccctgacctggactgtatggctggtctgcgacgaattacacttaattgcaatacgctcatcggagatctgggggcatgtgcattcgccgatagcctcagcgaagatttgtggctccgagctttggacctgcaacaatgcggcctcacgaatgagggcgctaaagcgctgctggaggcattagagactaacaccacgttggtggtcctggacatccggaagaatcccctgatcgatcacagcatgatgaaagcggtgataaaaaaggtgctgcagaatggcagaagcgccaagtcagaataccaatggatcactagccctagcgtgaaggaacccagcaaaaccgccaagcagaaaagaaggaccatcattctcggatccggccataagggaaaggctaccatacggatcggcttggccaccaaaaagcctgtctcctcggggcgaaagcactctttgggcaaagaatattacgctcctgctccgctgcctcccggagtatcaggattccttccttggcgtactgccgaaagagcgaagcggcatcgcggtttcccactgatcaagaccagagacatttgcaaccagctgcagcagccaggcttccctgttactgtgaccgtggagagtccgtcttcttccgaggttgaggaggtggacgattcctctgagtcggtgcatgaagtaccagagaagacatccattgagcaagaggctttacaggaaaaattggaagagtgcctaaagcagttgaaagaggagagagtgattagactcaaagtggataagagagtcagtgagctcgagcatgaaaacgcccaattgaggaacattaactttagcctatccgaagccctgcacgcgcagtctctcacaaacatgatcctcgatgatgaaggcgttcttggctccatcgaaaacagtttccaaaaattccatgctttcctggatttgctaaaggatgccggtctggggcagcttgcaaccatggccggaattgaccagtcagattttcagctccttggccaccctcaaatgacatcaactgtgagcaaccctccaaaagaggagaagaaggcactagaggatgagaagccagagccgaagcagaatgcattgggacagatgcagaacattcaattccaaaagattactggcgatgctcgtatacccttgcctctggacagtttcccggtgcccgtgtctactccagaaggtctgggcactagcagtaacaacctaggtgtgcccgctactgagcagaggcaagaatccttcgagggcttcatagcccgtatgtgttctccatctccagacgccacaagtggaacggggtctcagagaaaagaggaagaactgagccgcaattcccggtcgagttcagagaagaagacaaagactgagtcacactag

SEQ ID NO: 30071 - DNA, 915 bp, Artificial Sequence
  Description of Artificial Sequence: Synthetic coding sequence
atgaacttctctgaggtcttcaagctgagcagtctgctgtgcaaattttctcccgacgggaagtacctagcatcctgcgtgcagtatcggctggtggtgcgcgatgtgaatacccttcaaattctgcagctctacacctgcctggatcagatccagcatatcgagtggtcagcggatagcctgtttatcttgtgtgccatgtacaagcgaggtctggtgcaagtctggagcctagagcaacctgaatggcattgcaaaatcgatgaaggtagcgccggtcttgtcgccagttgttggtcacctgacggacgccatatcctgaatacaacggagtttcacctgcgaatcacagtctggtcgctgtgtaccaagagcgtatcctatatcaaatatccgaaagcatgcttgcaagggattacctttacccgggacggacgctatatggccctcgccgagcggagggactgcaaagattacgtgagcatctttgtctgcagcgactggcagctcctgaggcactttgacacagacacgcaggatcttacagggatagaatgggcaccaaacggttgtgtattggctgtgtgggacacctgcctggaagtgaggattctaaatcatgtgacctggaaaatgattacagaatttggccacccagccgcaatcaacgatccaaaaattgtggtttataaagaggctgagaagtcccctcagctggggctcggctgcctgtcttttccacctccaagagcgggagctggcccattacctagttctgagtctaagtacgaaatagcttctgtgccagtgagccttcagaccctaaagccggttaccgacagagcaaatccaaaaattgggattggcatgcttgcattttctccagacagttactttcttgctacccgaaattag

SEQ ID NO: 30072 - DNA, 483 bp, Artificial Sequence
  Description of Artificial Sequence: Synthetic coding sequence
atgaaagaagtgggacgtccacgcgaggttaggggccgacctggtaagagccgcattcagaaggagttagcagatatcacgctagatcctcctcctaactgctcagctggccctaagggcgataacatctacgagtggcggagcaccatcctcggacctcccggatcagtgtacgagggaggcgtgttctttctagacattacctttactcccgaatacccttttaaaccaccaaaagtgaccttccgcacccgaatctaccattgcaatattaattctcagggggtgatttgcctcgatatcctcaaagataattggtctccagcccttacaatcagcaaagtcctgctctctatttgttcacttttaacagactgtaatcctgcagatccattagttgggagcattgctacacagtatatgacgaaccgcgcagaacacgatagaatggcaaggcaatggacaaagcggtacgctacttag

SEQ ID NO: 30073 - DNA, 516 bp, Artificial Sequence
  Description of Artificial Sequence: Synthetic coding sequence
atgtcttcaggtaacgcgaaaattggccatccagctcccaattttaaagctaccgccgttatgcctgatggccagtttaaggacatttccttatccgattataaaggaaagtatgtggttttctttttctacccactcgattttacctttgtgtgccccactgaaatcatcgccttcagcgaccgagcagaggagttcaagaaactgaactgtcaggttataggggcaagcgttgatagccacttttgccatcttgcgtgggttaatacccctaaaaagcagggcggacttggaccaatgaacatccctttagtatccgatcccaaacgcacaatcgcccaggactacggcgtcttgaaggccgatgaaggaattagtttccgcggactttttattattgacgacaaaggcattctacggcagattacagtgaatgatcttccagtgggcaggagcgtagacgagactcttcggcttgtgcaggcctttcaatttaccgataaacacggggagtag

SEQ ID NO: 30074 - DNA, 603 bp, Artificial Sequence
  Description of Artificial Sequence: Synthetic coding sequence
gtcctgattttcgcgtgcttggtccctgggttccctgctgtaatgtcttcccggggaccctgtaccttggaaaccctcattaacccatcacccagcgttgcagacgtgaaaatctatcccgaagaaatcactccgctgttgcccgcaatttcaggtgagaagatcgccgaggatcagacatgtttcttcttgcagattctcctgaaatatatggtgattcaggcagcttctttggaatggaaaaacaaggagaatcaagacacgggctttaaatttttattcactctcttccgcaagtattacctgccgcacctgttcccatcttttactaagcttacaaacatttacaagcccgttctggatatcccacatctaagaccgaaacccgtctacatcacgacaacaagggataatgagaacatctacagtaccaaaattccttacatggccgctcgggtcgtgttcataaagtggattgtcacctttttccttgaaaaaaaatatctgacagctacacagaatactaagaacggggtggatgtcttacccaaaatcatccaggtgtgtcacccatccagtttctacctgctcatgcttgtgtag

SEQ ID NO: 30075 - DNA, 576 bp, Artificial Sequence
  Description of Artificial Sequence: Synthetic coding sequence
atgagtagcacattgggaaagctaagcaaccaggtggaagagaccctccccctgctgaaaaagccattaaaaagagccatcaccaccctcatggcaggcatcttaagactcgtggtgcagtggcctcctggtaggctacagacagtcaccaaaggggtcgaaagtttgatctgcacagactggatacggcacaaatttactagaagcaggatcccggaaaaggtgttccaggcaagcccagaagatcacgagaagtatggaggagacccacagaatcctcacaagctccacattgtaacacgtattaaatctacccggcgaagaccatattgggagaaggacatcatcaagatgctgggattagagaaggcccatacacctcaggtgcacaaaaatatacctagcgtgaacgcgaagttgaaggtcgtcaaacacctgatccgcatcaaacctctgaagcttcctcaaggcttaccagccgaggagaacatgagtaacacttgccttaagtctacgggcgaactggtcgtgcagtggcatctgaagcctgtcgaacaaaaagctcatgagtcatag

SEQ ID NO: 30076 - DNA, 483 bp, Artificial Sequence
  Description of Artificial Sequence: Synthetic coding sequence
atggaggcggagcgccctcaagaagaagaagatggggaacaggggcctccacaggacgaggaggggtggcctccgcctaactctacaacaagaccttggagatctgctcctcctagtccacctcccccagggacaaggcatactgctcttggcccaagatccgcctctctgctcagtctgcagaccgaactattacttgacttggtcgccgaagcccagagtcggaggctagaagagcagcgcgctactttctatacccctcagaaccctagctcactggccccagcacctttgagaccgctggaggatagagagcagctgtattctaccattttaagtcaccagtgccaacgcatggaggcccaaaggagcgagccgccactgcctccgggtggtcaagagttgttggaactattactgagagtgcagggaggaggtcggatggaggaacaacgcagccgcccaccgacacacacgtgttag

SEQ ID NO: 30077 - DNA, 321 bp, Artificial Sequence
  Description of Artificial Sequence: Synthetic coding sequence
acgtttttggaacaatctaagacccgctttaataagaactataaggggatgagtttaagtaagataaccactactgtggggcttaatatcggaactgtcgacgtaggtaaggcaaggttgatgttctgggacctcggtggtcaggaagagctccaatcactgtgggataaggacaaaaccaagtgcggggacctgggaacccttcactccagcaaggtgagtgcaagctttcggctgagggatctggccgctgaccaccacagaacccagaagtggcagcgcccagatgtaggaacagccggttggcttccactgccttag

SEQ ID NO: 30078 - DNA, 1524 bp, Artificial Sequence
  Description of Artificial Sequence: Synthetic coding sequence
atggccgaactgcagatgctcttggaggaggagattcctggagggagacgcgcactgtttgactcatacaccaatctcgagcgggttgccgattattgcgaaaataattatatccagagcgcagataagcagagggccttggaggagactaaggcctatactacccagagcctagcttctgtggcctacctgatcaatacactcgcaaataatgtcttgcaaatgctggacatccaggcctcccagctgagaagaatggaatcaagcatcaatcatatctctcagactgtggatatacacaaggaaaaagttgcccgtagagaaatcggcatcctgaccacaaacaaaaacacatctagaacccacaaaattatcgcgcctgcaaatctggagcgcccagtgagatatattcgaaagcctattgactacactatcttggatgacattggtcatggagtaaaagtctcaacccagaacatgaaaatggggggacttccccgaacgacacctcctacacagaaacctccctcccccccaatgagtggcaaaggcacgctgggcaggcactctccatatagaaccctcgagccagtcagacctcctgtggttccaaacgattatgtgccctcaccaacaaggaacatggccccttctcaacagtcgcccgtgaggaccgccagcgtcaatcaacgcaataggacatactcctcctcgggatccagcgggggatctcatcctagctcccgaagtagctccagggaaaattctggttctgggagcgtaggggtgcccatcgcagtgccaactccaagccctccatcggtgtttcccgcacctgccggatctgccggaacacccccactgcctgctactagtgcctctgcaccagcacctcttgtccctgccaccgtgccctcatctaccgccccagatgcggctgcaggcggagcgcagaccctcgcagatggattcacttccccaaccccacccgtagtgagcagcaccccaccgaccggtcacccagtgcagttctactccatgaatcggcctgcttctcgccacacccctccaaccataggaggctccctgccgtatcgcaggccaccttccataacctctcaaacgagcctccagaatcagatgaatggcggacccttttacagccagaaccccgtgtcagatacacccccaccccctcctcccgtggaggaaccggtgtttgacgagagcccccctccccctcccccacccgaggactatgaagaagaagaggccgctgtggtagagtactctgacccctacgccgaagaggaccccccatgggctccgcgatcctaccttgagaaagtggttgcaatatacgattacactaaagacaaggaggacgagctctcctttcaagaaggcgcaatcatctacgtgatcaagaagaatgatgacggttggtacgaaggcgtaatgaacggggtaacggggctcttcccagggaattatgtggagtccataatgcactactctgaatag

SEQ ID NO: 30079 - DNA, 303 bp, Artificial Sequence
  Description of Artificial Sequence: Synthetic coding sequence
atggcttccgcgggaacccagcattactccatcggtctgagacagaagaatagcttcaaacagagcggtccctcgggtaccgttcccgcaaccccacctgagaaacccagcgaaggtcgtgtgtggccccaggctcatcagcaggttaaacctatatggaagctagagaagaagcaggtggagaccttatctgctgggctgggccctgggttactcggagttcctcctcagcccgcttattttttttgcccctcaaccctctgtagctccgggactaccgcagtaatcgcagggcacagctag

SEQ ID NO: 30080 - DNA, 1212 bp, Artificial Sequence
  Description of Artificial Sequence: Synthetic coding sequence
atggcgtcagcactgagaccacccagggtgcccaaaccgaaaggggttctgccttctcattactacgagagcttccttgagaagaaaggcccttgtgatcgcgactacaagaaattctgggctgggctgcaagggctcaccatctatttctacaattctaacagggacttccagcatgttgagaagctaaacctgggggcatttgagaaattgactgatgagatcccctggggctcatcccgagaccctggcactcacttttccctaattttgcgggaccaggagatcaaatttaaagttgagacattagagtgtagggaaatgtggaaggggttcatcctgaccgtagtggagctgcgcgttcccacagacctgaccctcctgcccggtcacctgtatatgatgtcagaggtgttggccaaggaagaagcgcgtcgggctctggagactccctcctgctttctcaaagtgtctcgacttgaggctcagctactcttagaaagataccctgaatgtgggaacctgcttctccgaccctctggagacggagccgatggtgtctctgttactaccagacagatgcataatggaacgcacgtagtaaggcattataaggtcaagcgcgaaggcccaaagtatgttattgacgtcgagcaaccattttcgtgtaccagtctggacgccgttgtgaactatttcgtttcacataccaagaaagcgctggtccctttcctgttagacgaagactatgaaaaggtgctggggtatgtcgaagctgacaaggagaacggtgaaaatgtgtgggtcgccccatctgccccaggcccaggacctgctccttgcactgggggacccaagcccctgagtcccgctagctctcaggataagttgccccctttaccccctttgcccaaccaggaagaaaattatgtgaccccaatcggagacggcccagccgtggactacgagaatcaagacgttgccagctcttcgtggccagttatactaaaacctaaaaaactgcccaaaccacccgctaagttaccaaaacctcccgtggggccaaaacctgaaccaaaggtgttcaatggaggcctcgggcgaaaactccccgtttcctcagcacagcccttgttcccaacagctgggctggccgatatgacagctgaattacagaaaaagctcgaaaaacgtcgcgcactggagcactag

SEQ ID NO: 30081 - DNA, 1551 bp, Artificial Sequence
  Description of Artificial Sequence: Synthetic coding sequence
atgctaaggcgtggcagccaggcattacgacgcttttctacaggaagagtctattttaagaacaagctgaagctggctctcatcggtcagagcctctttggccaggaagtgtactcccacctgcgtaaggaaggccatcgcgtggtgggcgtgtttaccgtcccagacaaagatggtaaagccgatcccctggccttggctgccgaaaaggacggcacacctgttttcaaattgccaaaatggcgagttaaggggaaaaccataaaagaagtcgccgaggcttatcgatccgttggagccgagttaaacgtgctccctttctgcactcagtttatacccatggatatcatcgatagtcccaaacatgggtctatcatttaccaccccagcattctgcccagacataggggcgcttctgccatcaattggacgcttatcatgggggataaaaaggccggattttcggtcttctgggccgatgatggcctcgacacaggacctatactgctgcaacggagctgtgatgtggagccaaacgacactgtggatgccctctataaccgattcctcttccccgagggtatcaaggcgatggttgaggcggtgcagctgatagctgacggaaaggctccccgaatccctcagcccgaggagggagcaacatacgaaggcattcagaagaaggaaaatgccgagatatcttgggatcagtcagctgaggtgttacacaattggatccgcggacacgataaagtacccggagcgtggacggagattaacggacagatggtgactttctacggatccaccctgttaaatagtagtgtcccaccaggggagcccttagagataaagggtgcgaaaaagccaggtttggtgacgaaaaacggattggttctcttcggcaatgacggcaaagctctcacagtgcgcaacttgcaatttgaggacggcaagatgattcccgcttcacagtacttctctaccggcgaaacctccgtggtggagctgacagcagaggaggtcaaagtggctgagacgattaaggtgatctgggctgggattctgtccaatgttcctattatcgaagactcaaccgatttttttaagtcaggggcttccagcatggatgtggcgagactggtggaagaaatacgccagaagtgtgggggactgcagctgcagaatgaggatgtttacatggctacaaaatttgagggattcatacagaaggttgtaaggaagttgcgcggtgaagatcaggaggtagagttggtcgtcgactacattagcaaagaggtcaatgagatcatggttaagatgccttatcagtgcttcatcaacggacagttcaccgacgccgatgatggcaaaacctacgacacgatcaacccaactgacggatctaccatatgcaaagtgtcttacgccagtctagctgacgtcgacaaggcagtcgcagcagccaaagatgcctttgaaaacggagagtggggaaggatgaacgcccgtgagcgcggaaggctgatgtatagcatgcggatgaattag

SEQ ID NO: 30082 - DNA, 1581 bp, Artificial Sequence
  Description of Artificial Sequence: Synthetic coding sequence
atggaggaaatccctgcccaagaagccgctggcagccctcgggtgcaatttcagtctctggagactcaatccgaatgcctgtctccagagccccaattcgtacaggacaccgacatggagcaggggctgacaggagggtttccaatctcaaagccggatggaatcagtcagctcgaacaagaccttcaggtgtttgatctagagacaaagacacgcgaggtactgcgcgacgattgctctgacggggaaactagggaggagaacaagctcttgatccctaagcagaagatttccgaggaagtacacagttataaggtgcgcgtcggaaggttgaagcacgacattacacaagtgcccgagactagggaggtgtataaatcagaagaccgtctagagagacttcaggagatcctgcgcaaattcttatacctggagagggagttccgccagattactatctccaaagagactttcacctctgagaagaataatgagtgtcacgaacctgagaaatcattctctctcgatagtactatcgacgcagatcagcgcgtcttgagaattcaaaataccgacgataacgacaagtacgatatgagcttcaatcagaactctgcctctggcaagcatgaacacctcaacctcaccgaagatttccaaagttctgaatgcaaagagagtttgatggacctcagccatcttaacaaatgggaatcaataccgaacaccgagaaatcctataaatgtgacgtgtgcggaaagatcttccatcaatcttctgccctgactaggcaccagcgtatccatacaagagagaaaccttataagtgcaaagaatgcgaaaagagcttcagtcagtcatcctccctgtccagacataagagaatccacaccagggagaagccctataagtgcgaggcaagcgacaaaagctgcgaggcaagcgacaagtcatgttcaccctcatcaggaatcatccaacacaagaaaatacatacacgggcaaagagctacaagtgttccagctgcgaaagagtgttttccagatccgtgcacttgacacaacatcagaagatccataaggaaatgccctgtaaatgtacggtgtgcggcagcgacttttgtcataccagctatttgctggaacaccagagagtacaccatgaagagaaggcctacgaatatgacgagtatgggctggcgtatataaagcagcaggggatccatttcagggagaaaccatacacatgttctgagtgtgggaaagattttagactgaatagccatttaatacaacatcagagaatccataccggggaaaaagcccacgaatgcaacgagtgtggcaaagcgtttagccagacatcctgcctgatccaacatcacaaaatgcaccgaaaagaaaaatcttatgagtgtaacgagtatgagggcagcttctcccatagctccgaccttatcttacaacaagaggtattaactcgacagaaggcattcgattgcgacgtgtgggaaaagaacagttctcagagagcccacttagtccagcaccagtctatccataccaaagagaattcatag

SEQ ID NO: 30083 - DNA, 603 bp, Artificial Sequence
  Description of Artificial Sequence: Synthetic coding sequence
gtactcatcttcgcatgcctcgtgcccggtttccctgccgtcatgtcatcccggggtccttgcactctggagaccctcatcaacccctccccttcagtggccgatgtgaagatataccccgaggaaataacgccattactccctgctatctcaggcgagaaaatcgcagaagaccagacctgtttctttcttcagatcttgcttaaatacatggttatccaggcagcctctctggagtggaaaaataaggagaatcaagatactggcttcaagtttctctttacactgttcaggaagtattacctgcctcacctgttcccttcattcaccaagctgacgaacatctataaaccagttctagatatcccccatctgaggcccaaacccgtgtacataacgaccaccagagacaacgagaacatctactccaccaagattccctacatggctgccagggtggtgttcattaagtggattgttaccttctttctggagaagaaatacctgaccgcgacacagaatacaaagaacggtgtcgatgtgctcccgaagatcattcaggtgtgtcacccttcttccttctatcttttgatgctggtgtag

SEQ ID NO: 30084 - DNA, 540 bp, Artificial Sequence
  Description of Artificial Sequence: Synthetic coding sequence
aatatcaagcccggtgagggcctgggcatgtacatcaagagtacctacgacggcctgcatgtcataacaggaacgacagagaacgtggggtggcagttgaagaatttggtgaagaagctaagggagaaccctactggtgtggtgctcctactcaaaaaaagaccaaccgggtcctttaattttacccctgcgcctctcaagaatctgagatggaagccaccactggtgcagactagcccccctccagccacgacccagtccccagagagcacaatggatacctctcttaagaaagaaaagtctgccatcctggacttgtacatccctccccctccggcagtgccttacagccccagagacgaaaacggcagtttcgtatatggcggatcctctaagtgcaaacaaccactgcccggtccaaagggcagtgaatctcccaactctttcctggatcaggagtctcgtaggaggaggtttacaatagcggattcagaccagctgccaggctactcggtcgaaaccaatattctaccaacttag

SEQ ID NO: 30085 - DNA, 1368 bp, Artificial Sequence
  Description of Artificial Sequence: Synthetic coding sequence
atgatgggcgctcctaacctgattgcagacagcatggagtacggactgagttacagcgtgatatcttacctgaagaagctctcccagcaggcgaagattgagtctgatcgagtaatcggatctgtgggtaaaaaggttgtccaagagacgggtatcaaggtccggtctaggagtcacggcttatccatggcataccgaaaagacttccaacaactgctccagggaatttctgaggacgtaccacaccgactgctggatctgaacatgaaggaatacacaggtttccaggtcgccctcctgaataaggacctgaagccccagacattcagaaacgcctacgatattcccaggagaaatttgctcgaccatcttacaaggatgcgttcaaacttgctgaagtccacaaggcgatttttgaaagggcaggacgaagatcaggttcacagcgtgccgatagcacaaatggggaactaccaagagtatctgaagcaggttccgagcccgctccgagaactggatccggaccagcctcgtcggctccacacatttggcaacccatttaaactagacaagaagggcatgatgattgacgaagcggacgagttcgtggccggacctcagaataagcacaaacgccctggagaaccaaacatgcaggggattcccaagcgtcgtaggtgcatgtcaccgcttttgcgtggccgtcagcagaaccccgttgtgaataaccacatcggtggcaagggaccacctgccccaacaacacaggcacagcctgatctgatcaaacccctccccttgcacaagatctcagagactacgaacgatagtattatccacgatgtagtcgagaaccacgtggcagatcagctgtcaagtgatatcacccccaatgctatggatacagagttctctgcttctagccccgctagcctgctggagcggcctacgaatcacatggaagctcttggccatgaccacctgggcacaaacgatctgacggtcgggggattcctcgagaatcacgaagaacctcgggataaagagcaatgtgcagaagagaatatcccggcatcctctctgaacaaaggaaaaaaacttatgcattgtagatctcacgaagaggtcaatactgaactgaaggcacaaatcatgaaagaaattaggaaacccggtaggaaatacgaaagaattttcacactactgaagcacgtccaaggatcgttgcaaacccgcctcattttcctgcagaatgtcattaaagaggcatctcgttttaagaagcgcatgctgatcgagcagctggagaactttctcgacgaaatacacagaagagcgaatcagatcaatcacataaactctaactag

SEQ ID NO: 30086 - DNA, 1467 bp, Artificial Sequence
  Description of Artificial Sequence: Synthetic coding sequence
cttgactgtggccctagactgcctgtggaggtgggaccaagccttagttccccatcgtctggctgcggcgaaggctcaatatctgtcggcgagaacgtgagcgacgtggctcccacacagccctggtggcccaatactcccggagacagcgtaagcgaggaactgggacccggacgtagtggagatacagaggatcttagcccgaattggcccttgaatagccaagaagacaccgctgcacagtcttccccaggtcgcggagaggaggctgaagcatctgcagctgaggcccaggggggagagcaagcatatctggcgggactcgccggacagtatcacctggaacgttatcctgatagctacgaatcaatgtcggagccaccgatagcccatttgttaagacccgtgctgccacgcgcttttgcattccccgttgacccccaagtgcaaagtgcggctgatgagactgctgtgcagctgtccgagttgctcacgctcccagtgctcatgaagcgctcaatcactgctcctctggctgcgcatataagccttgtaaataaggccgctgtggattacttcttcgtggagctgcatcttgaggctcattacgaagctttgcgtcactttctgcttatggaggacggagaatttgcccagtctctgtccgacctgctttttgagaagctcggcgctggacagactccaggcgagcttctaaacccgctggtgctgaatagcgtcctttccaaggcactgcaatgcagcctccatggagacactcctcacgcctcaaatctgtctttagcgctaaagtacctgccggaggtgttcgccccaaatgccccagatgtgctgtcttgcctcgagttgcggtataaggtagactggccacttaatatcgtcattaccgagggttgcgtgtctaagtactctggcgtcttcagttttttgctgcagctcaagctgatgatgtgggctctcaaagacgtttgtttccacctaaagcggaccgtcccttctgctgcagctgtgcaggctagggatgcagcctttagggagggtcaccctggcctccaccggcagcctgatcccgcaaggcatctggtgcgtgtgcagggacaggttggacataggggccgacccggtggggatcctgcatgcgctcgcagggtccctgctcagggacgactccaagcagctccagtgatgaacgtcattcactcaatcttttccctggttcttaagttcaggtcccaactgatttcgcaagcctgggggcctccagggggacccagaggtgctgaacacccaaacttcgccctgatgcagcagagctacaacaccttcaagtattacagccacttcctctttaaggtggtgacaaagctcgtcaatcggggttaccagcctcatctggaggactttctgctaagaattaacttcaacaattactatcaggatgcatag

SEQ ID NO: 30087 - DNA, 3819 bp, Artificial Sequence
  Description of Artificial Sequence: Synthetic coding sequence
atggccaacgacagtcctgcaaagagtctcgtggacattgatttgtccagtcttcgcgatcccgctgggatctttgaattggtcgaggtcgttggtaacggcacatatggtcaggtgtataagggccgacatgtgaaaacaggacagttggctgcaattaaggttatggatgttactgaggatgaggaggaggagataaaactagaaataaacatgctgaagaagtattcccaccatcgcaacattgccacttactacggggcatttatcaagaaatctcctcccggacacgacgaccagttgtggctagtgatggagttttgcggggctggctcaattaccgaccttgttaagaacacgaagggtaataccctaaaggaggattggatcgcctacatctccagggaaattctgagaggtctggctcacttgcatatccaccacgtgatccaccgtgatattaaggggcagaacgtcctgctgacagaaaacgccgaagtgaagctagtagacttcggagtttcagctcagctcgatagaacagttggtaggcgtaacacatttatcgggacaccctactggatggccccagaggtaatagcctgcgacgagaatcctgacgccacttacgactatagaagcgacttgtggtcatgcggtattaccgctatagaaatggccgaaggagcaccccctctctgtgacatgcaccctatgcgggcacttttcctgattccgagaaacccccctcccagactcaagagcaagaaatggagtaagaaatttttcagctttatagaagggtgtctggtcaagaattacatgcaaagaccttcaaccgaacagctgcttaagcatccatttattagggatcagccgaacgagcgtcaggttcgtatccagctgaaggaccacattgacagaacccggaagaagcggggagagaaagacgagacggagtatgaatacagcggctcagaggaggaggaagaggaagttcctgagcaggaaggggagcctagcagcatcgtgaacgtgcccggtgagtcaaccctgaggcgggacttcctccgtctgcagcaggagaacaaagaacgaagtgaggccttgagacggcaacagctgcttcaggaacaacaactacgggaacaagaggaatataagagacagctccttgcggagcggcagaaacgcatcgaacagcagaaggagcagagacgcaggttggaagagcagcagaggagagaaagagaggctagaaggcaacaggaaagagagcagagaagacgtgaacaggaggaaaaacgcagactcgaagaattggagaggaggaggaaggaggaagaagagaggcgcagagccgaggaagaaaagagacgggtcgagcgcgaacaggaatacatccggaggcagcttgaggaggaacagcggcacctggaggtgctacagcagcagttactgcaggaacaagccatgctgctgcacgaccatcggcgacctcaccctcagcatagtcaacagccccctccaccacagcaggagaggtcaaagccctcatttcacgcacccgaacccaaggcacactatgagccggctgatcgcgcaagggaggtggaggatcggttcagaaaaacaaaccacagcagccccgaggcccagtcaaagcagacagggagagtactggaacctccggtccccagtaggtcagagagcttctctaatggcaattccgagtctgtgcatccagcactgcagaggccggctgagccgcaggttcctgtgcggaccacatctcgttcgccagtcttgtccagacgcgactcccccttgcagggatcgggacagcaaaactcacaggcgggacagcggaattccacctctatagaaccaagactcctgtgggagagagtcgaaaagctcgttccacgcccagggagtggttccagctctggctcttcgaactccgggtctcagcctgggtctcaccccggaagtcagtcaggaagcggggaacggttcagggttcgctcctccagcaagtccgagggctcgccctcccagcggctcgagaatgcggtcaaaaaaccagaagacaagaaggaggtttttagacctctaaaacctgcggatctgacggctctggccaaggaacttcgagccgtggaagatgtgaggcctcctcataaagtcacagactactcaagcagcagtgaagagtccggcaccactgacgaagaggatgatgacgttgagcaagagggagcagatgaatccacctcagggcctgaggatacccgggcagccagttcactcaacctgtccaatggagaaacagagtccgtgaaaacaatgattgtgcacgacgacgtagaatctgagcctgccatgaccccttcaaaagaggggacccttattgtccggcaatctacggtggaccagaagagagccagtcatcacgaaagcaacggcttcgcgggacgcatacacctcctccccgacttgttgcagcagtctcattctagttccacgtcaagtacctcgagtagcccatcctcatcccagcccacccccaccatgagcccacagaccccccaggataagctgaccgctaacgaaacccagtccgccagtagcacactgcagaaacacaagagcagctcctcattcaccccattcattgaccccaggctgttgcagatctcccctagcagtggcaccaccgtgacaagcgtggtggggtttagctgcgatggcatgaggcccgaggccatccggcaggaccccacccggaagggctccgtggtcaacgtcaatccgaccaatacaaggccgcagagtgacactccggaaatcagaaagtacaaaaagcgctttaacagtgaaattctgtgtgcggctctgtggggcgtgaacctccttgtgggaacggagagtgggctgatgttgctcgacaggagtggacaaggcaaggtataccccctcattaaccgcagaagatttcagcaaatggacgtgctcgaggggttgaacgtgctagtgacaatcagcggaaaaaaggacaagctaagagtttactatctgtcatggctgcgaaataagatactgcacaatgatccagaggttgaaaagaagcaggggtggaccactgtgggcgatctcgaggggtgcgtgcactataaggttgttaaatacgagagaatcaagttcctcgtgatcgcattgaagtctagcgtggaagtgtatgcttgggccccaaagccctaccataaattcatggccttcaagtctttcggcgagctggtgcacaaacctctactcgttgacttgactgtggaagaaggtcaaagactcaaagtcatttacgggagttgcgccggatttcacgcagtggacgtggatagcggttcggtgtacgatatttatctgcccacacacatccagtgttcaatcaagccccacgccattattatcctgccaaacaccgacggcatggagctgcttgtgtgttatgaagatgagggtgtatacgtgaatacctacggcagaatcaccaaagacgtagtgttacaatggggcgagatgcctacctccgttgcatatatccgctctaaccaaaccatgggatggggcgaaaaagccatcgagatcaggtccgtggaaaccgggcatctggatggggtctttatgcataagcgggcacagaggcttaaattcctgtgtgaacggaatgataaggtctttttcgccagtgtgcggtcaggcggtagcagtcaggtctactttatgacattaggaaggacttctttactgagttggtag

SEQ ID NO: 30088 - DNA, 363 bp, Artificial Sequence
  Description of Artificial Sequence: Synthetic coding sequence
gcactgcagatctccgagaacctgttctctaataaggttttgaatgcactcaagccggagaaagacgttgatggcgtaactgacataaacttgggcaaactggtgcggggagacgcccatgagtgctttgtgtctccagtggctaaagccgtgatagagctattagagaaatccgtgggggttaatcttgatggaaaaaagatcctggtagtgggcgctcacggcagcctggaggccgctctccaatgtctgttccagagaaagggctccatgacaatgtccattcaatggaaaactcgacagttacaaagcaagactgagagccgatcagtgacaagattggagtgtcgccgagtaatctag

SEQ ID NO: 30089 - DNA, 1866 bp, Artificial Sequence
  Description of Artificial Sequence: Synthetic coding sequence
atggtgtccattctgtcaagtttcgaatctagactaatgaagcttgagaattcaataatcccagttcacaagcagactgagaacctacagcggctgcaggaaaatgtggagaaaaccctgtcttgtttggatcacgtcattagctactatcacgtcgcctcagacacagaaaagataattagagagggccctacgggaaggctggaagagtatttggggagcatggccaaaattcagaaagccgtggaatacttccaggataattcgcccgattcccccgaattgaacaaggttaagctcctcttcgagcggggtaaggaggcgctggaaagcgagttccgatctctgatgactagacatagcaaagtggttagcccagttctgatacttgacctgatatccggcgacgacgacctcgaggcccaggaagatgttaccctggaacacctccccgagtcagtactccaggatgtgataaggatcagccgttggctggttgagtatggcaggaaccaggattttatgaatgtgtattaccagatccggtctagccagctggaccggagcattaaaggactcaaggagcattttcataagtcatcctccagctctggagtgccatactccccagcaatccccaataagcggaaagacacaccaactaagaaacccgttaagaggcctggtacaatacgtaaagctcagaatctgctgaagcagtacagccagcatgggttggacggcaagaagggaggatccaatctgatcccccttgaaggacgggacgatatgcttgatgtggagacagacgcttacattcattgtgttagcgcgttcgttaagcttgcccagagtgagtatcagctgctagcggatatcattccagagcatcatcaaaaaaaaacattcgacagcttgatccaggacgccttagatggcctcatgctggagggagaaaacatcgtcagcgccgctcgaaaggcgatcgtgcgacatgatttctctactgtcctgactgtgtttcccatcctccgtcacctcaaacagaccaaaccagagtttgatcaagtgcttcagggaaccgccgcaagcacaaagaacaaactcccaggactgataacatcaatggagaccatcggcgctaaggccctagaggatttcgctgacaacattaagaatgacccagacaaagagtataacatgcccaaagacggcaccgttcacgagcttacctccaacgccatcctgttcctccagcaattgcttgattttcaggaaactgctggggctatgctggcatcacaagggaaggtcctgggaaacctgcaactgaatctgttgtctaagtcaaaagtctatgaagaccctgcactgagcgctatcttccttcacaacaattataactatatcctgaaatctctggaaaaatccgagctcatccagttagtagccgtgacacagaagacagctgagcgttcttaccgagagcatatcgagcagcagatacagacctatcaacgcagctggctcaaggtgactgactatattgctgaaaaaaatctccctgtattccaacccggagtgaaacttcgcgacaaggagcgccagattatcaaggaacgctttaaaggatttaatgacggcctggaagagctgtgcaaaattcaaaaggcctgggccattccagatacagagcagagagatcgcatccgacaagcccagaaaacgatcgtaaaagagacttacggggcttttctacaaaagttcgggtccgtgccctttacgaagaaccccgagaaatatatcaaatatggcgtggaacaggttggagacatgattgacagactattcgacacttctgcctag

SEQ ID NO: 30090 - DNA, 1344 bp, Artificial Sequence
  Description of Artificial Sequence: Synthetic coding sequence
atggacttcctgctgggcaatccattttccagccctgtagggcagcgcattgagaaagccacagacggcagcctccaaagcgaagattgggcactcaacatggaaatctgcgacattatcaatgaaactgaggagggacccaaggatgccctccgcgctgttaaaaagcggatcgtaggtaacaaaaacttccacgaggtgatgctggccctcactgtgcttgagacatgcgtgaaaaattgcggccaccggttccatgtcctggtggcctcgcaggatttcgtcgaaagcgtactagtgaggacgatattgcccaagaataacccacctactattgtgcatgataaggtcttaaacttgatccagacagtgtttaacagcgaaacacaatctggacaggactccgtcgggactgactcaagccagcaggaagacagtggacagcatgcagcacctttgccggctccaccaatcctgtccggcgacacacctatcgctcccacaccagaacagatcgggaaactcagatcagaattagaaatggtctcgggcaacgtgagagtcatgtccgaaatgctgacagagctcgttcccactcaagctgagccagccgatctggaactgctccaggaactcaatagaacctgccgggcaatgcaacaaagagtcctcgagctgataccccaaattgccaatgaacaattaactgaagaactgctcattgtaaacgacaacttgaacaatgtcttcctccgccacgagaggtttgaaagatttaggaccgggcaaaccaccaaggctcctagcgaggccgagccagcagccgacctgatcgatatgggccctgacccggcagccaccggcaacctgagtagccagctggcaggcatgaatctcggctcttcgagtgtgcgggcagggctgcaatccctagaggcctctggtcggctggaggacgagtttgacatgtttgctctcacaaggggttcctcattggcagaccagagaaaagaggtcaagtatgaagctccacaggccactgacgggctcgctggagctttagatgcacggcagcagagcacaggtgccattcccgtcacacaggcttgcttgatggaggatattgaacagtggttatctacggatgtcggtaatgacgctgaggagccgaaaggcgtgaccagcgaggagttcgacaagttcctcgaggagagagccaaggctgccgatcgtctgccaaatctctcttctcccagcgctgaaggaccacccggaccaccctcaggtcctgccccacgcaagaagacgcaggagaaagacgacgacatgctgttcgcactgtag

SEQ ID NO: 30091 - DNA, 2103 bp, Artificial Sequence
  Description of Artificial Sequence: Synthetic coding sequence
atggcaaccatgatacccccagtcaagctcaaatggctggagcatctcaactccagctggattaccgaggattccgagtctattgcaaccagggagggcgttgccgtcctgtactctaaactggtttctaacaaggaggtggtgccccttcctcaacaggtgctgtgcttgaaggggcctcagttgcccgattttgagagggagagcctgtcctcggatgaacaggatcactacttggatgcactcttaagcagccagctggcactggcaaaaatggtgtgcagtgactctccgtttgcaggagctttaagaaaacggctgcttgtcctgcagcgggtcttttacgccttgagcaataaatatcacgacaagggtaaggttaagcagcagcaacacagccccgaaagctcctccgggagtgctgacgtgcacagcgtctccgagcgtcctcggtcatctacagatgctctgatagaaatgggagtgcgaacaggactttctctgctttttgccttactcagacagagttggatgatgccagtgagcgggcctggcctttctttgtgcaatgacgtcattcacacggctattgaagttgtgagcagcctgccgcctctcagcctcgccaacgaaagtaaaattccgcctatggggctcgactgcctgagccaggttacaaccttcctgaaaggggtgaccatacccaatagcggcgctgatacgctggggaggaggctagcttctgaactcttgctcggcctggcagcccagagagggtcgctgcgatatctattggaatggatcgagatggccctaggggctagcgccgtagtgcacactatggagaaggggaaattactgtcctctcaggagggaatgatcagctttgactgtttcatgactattctaatgcagatgcggaggtctctcatctccgagaaccaggactccgcagacgtcgaccctcaggagcatagctttaccagaactatcgatgaggaggctgagatggaagagcaggctgagcgcgatagggaagagggccaccccgaaccggaagacgaggaggaagaaagggaacatgaggttatgacagctggcaagatcttccagtgtttcctgtccgctcgcgaagtcgccaggagccgcgatagagacaggatgaactccggcgctgggtcaggcgctcgggctgacgaccccccaccacagtcacaacaggaaaggcgcgtttctaccgatttgcccgagggccaggatgtgtacactgctgcatgcaactctgtcattcaccggtgtgcactgctgatcttgggcgtctctccggtgatcgatgaactccagaagagacgggaagaggggcagctgcagcagccttcgacctccgcctcagagggcggtggcctgatgactaggagtgaatcattaactgccgagtcccgactcgtccataccagccctaattatcggctgatcaagagtaggagtgaatccgacctctcccagccggagtccgacgaggagggatatgctttgagcgggcgaaggaacgtcgatttagacctggcagcaagccatagaaaaagaggaccaatgcatagccagcttgagtcactttctgattcgtgggcaagactcaaacacagccgtgactggctgtgcaacagttcgtatagttttgaatcagactttgatttaacaaagagcctgggagtccacaccctcatcgaaaatgtagtgtcctttgtttccggcgatgtcggaaacgccccaggcttcaaagagcctgaagaaagcatgagcactagcccgcaggctagtataatcgctatggaacagcagcagctccgagctgagctccgccttgaagccttacatcagatcctcgttttgttgagcggtatggaagagaagggtagtattagcctggccggttcgaggctttccagtggtttccagtctagtacattactgacctccgtgaggcttcaattcttggccggttgtttcggattgggaacagtcggccacacaggtggtaaaggagaatccggcagactccatcactatcaggacggaatcagagctgccagggggtactag

SEQ ID NO: 30092 - DNA, 537 bp, Artificial Sequence
  Description of Artificial Sequence: Synthetic coding sequence
atggccgacagggcggctgcagagcgagcatgcaaagacccaaacccaattattgacggtcgcaaagccaacgtgaacctggcctacctgggagctaagcctcgtatcatgcagccaggttttgcattcggagtccagcagcttcacccagccctgatccagcggccttttgggatacctgcccactacgtgtacccccaagcctttgtccaacccggagtagtgattcctcatgtgcagcccactgctgcagcagctagcaccactccttacattgattacaccggcgcagcctacgctcaatatagcgcggctgccgcagctgccgctgcggctgcagcctacgatcagtatccttatgccgcatcccctgccgcagctggctacgttaccgcgggagggtacggctatgcagttcagcagcccatcaccgcagccgctccagggaccgccgcagccgctgctgctgctgcggcagccgcagccgcttttgggcaataccagccacagcagcttcaaactgatcggatgcagtag

SEQ ID NO: 30093 - DNA, 579 bp, Artificial Sequence
  Description of Artificial Sequence: Synthetic coding sequence
atgggaaagggatgtaaggttgtagtgtgcgggctgctgagcgttggaaaaactgccatcctagaacagctcttatatggaaaccacacaatcggaatggaggattgcgagactatggaggacgtttacatggcctccgttgagaccgatagaggtgttaaggagcagttgcatctttatgacacgcggggattgcaggagggagtggaactgcccaaacactacttctcattcgccgatggatttgtgctcgtgtattccgttaataatctggagagtttccaacgcgtggaactgttaaagaaggagattgataaatttaaagacaaaaaggaagtcgccatcgtcgtgctggggaataagatagacttgagcgaacaaaggcaggtagatgccgaggtagcacagcagtgggctaaatctgaaaaagtccgtttatgggaggtgaccgtcacagatcgtaagaccctgattgaaccattcaccctcctcgcctccaaactgtctcagccccagtcaaaatctagttttcccctccccggacgcaagaacaagggaaacagtaactctgaaaattag

SEQ ID NO: 30094 - DNA, 555 bp, Artificial Sequence
  Description of Artificial Sequence: Synthetic coding sequence
atgaatagaagccagcctggcctgctcagaaccgatcccgtaccagaggaaggtgaggatgtagccgctactatctccgcgacggaaactcttagcgaggaagaacaggaggagctacgacgcgagctggctaaggtcgaggaggagatccagaccttaagtcaagtactcgccgcaaaagaaaaacatctcgctgaaattaagcgaaagctcggcatcaatagcttacaggagctgaaacagaatatcgcaaaaggctggcaggacgtgacggcaacaagcgcctacaaaaagacatccgagacgttgtcccaggctggccaaaaggcctctgctgcttttagttccgtcggtagcgttattaccaagaaactggaagatgtgaaaaactccccaactttcaagtctttcgaggaaaaggtggagaatcttaagtcaaaagtggggggtacgaagcctgccggaggagattttggcgaagtattgaactcagccgcaaacgcctccgcaacaacaactgagccactacctgaaaagacacaagagtctctgtag

SEQ ID NO: 30095 - DNA, 1620 bp, Artificial Sequence
  Description of Artificial Sequence: Synthetic coding sequence
atggccaccagtgcacctctgcggtccctggaagaggaagtaacctgtagcatttgtctcgattatctcagagacccagtgaccatcgattgtggacacgtattttgcaggtcatgcaccacggacgtgagacctatctccggcagccgtcctgtgtgccctctctgcaagaaaccttttaaaaaggaaaacattagacccgtttggcagctggccagtctagtggaaaatattgagaggctgaaggtagacaaaggaagacagcctggtgaggtgacccgcgagcagcaggacgccaagctttgtgagagacatagggagaagctgcactattactgcgaggacgatggaaagctactatgcgttatgtgcagagaaagtcgagaacaccggcctcacacagctgtccttatggagaaagcggctcagccccaccgtgaaaagattctgaatcaccttagcaccctccggcgagaccgtgacaagatccaagggttccaggccaaaggcgaagctgatatcctcgccgctctcaaaaaactgcaggaccaacgccagtatattgtcgcagagtttgagcaaggccaccagtttctgagagagcgagaagaacatcttcttgaacagctcgctaaactggagcaagagctgacagaagggcgtgagaagtttaaaagccgcggagtgggagaattagccagactggcgctggtgatttccgagctggagggaaaggcccagcaaccagctgcggaactcatgcaggatacacgagactttctcaacagatatcctaggaaaaagttctgggtaggcaaacctattgccagagtggttaagaaaaagactggcgagttttcagacaagttactgagcctccagaggggattaagagaatttcagggaaagctgctgagagatctggaatataagaccgtctcagtgaccctggatcctcagagcgcatccggatatttacagctgtctgaggactggaagtgtgtcacctatacctctctctataaatcggcatatttacatccacagcaatttgactgtgaacccggtgtccttggttctaaggggtttacctggggtaaggtgtattgggaggtagaggttgagagagagggatggagcgaagatgaggaagagggagatgaggaagaggaaggggaagaggaggaggaggaagaggaagccggatatggggacggctatgatgactgggagaccgacgaagacgaggaatccctgggcgacgaagaagaagaggaagaagaagaggaagaggaggttctggagagctgcatggtgggagtggcgcgtgacagcgtaaagaggaagggagatctgagtctgagacccgaggacggagtgtgggccctccgtctgtcaagctccggcatctgggctaacacctcgcccgaagcagagctctttccagcgttgcgccctcgtcgagtcggtatagcgctcgactatgaaggcggaacagtaaccttcaccaatgctgaatcacaggagctgatctacacattcactgccactttcacaagaaggttggtaccgtttctgtggctcaagtggcccggaacaaggctcctcctccggccttag

SEQ ID NO: 30096 - DNA, 612 bp, Artificial Sequence
  Description of Artificial Sequence: Synthetic coding sequence
atggagccacctatggagccgtccggaggcgaacaggagccgggtgccgtcaggttcctcgacctaccttgggaagacgtgctgctgccacacgtgctgaatcgggtgcctctcagacagctgctgagactgcagagagtgtctagagccttccggtcactcgtgcagctgcacttagccggactgcgcaggttcgacgccgcacaagttggaccacagatccccagagccgctttggctaggttgctccgcgacgccgaggggcttcaggagttggctctcgccccttgtcatgaatggttgtcagacgaggacctcgtaccagttctcgcccgaaatccacaattgagaagcgtcgcccttggtggctgtggccagctcagccgtagggcacttggtgctctggccgaggggtgccctcgcctccagcggcttagcctggcacactgcgattgggtcgacgggctggcactgcgtggtctggcagacaggtgccctgcactagaagaactcgacctcacagcctgccgccagctcaaagacgaggcgatagtgtatctcgcccaacgtaggggagccggacttcgaagcctctccctagccgtgaactag

SEQ ID NO: 30097 - DNA, 1824 bp, Artificial Sequence
  Description of Artificial Sequence: Synthetic coding sequence
atggcccgaggattgggcaaggcctccgggtttccagcaggaccgagtggcgcagagctaccagcatcagggagacggaggggaccattgattagcctgtttcccgcagtcctggccagcgaggccgcaatgtcctatcccgctgatgattatgagagcgaagccgcttatgacccctatgcgtaccccagtgactacgatatgcacactggcgatcccaagcaggatctcgcttatgagcgccagtatgagcagcaaacttaccaggtcattcctgaggtgattaaaaattttattcagtatttccacaagaccgtttctgatctgatcgatcagaaggtctacgagctgcaagccagccgagttagttcagacgtgattgaccagaaagtctacgaaatacaggacatttatgagaactcatggacgaagctgaccgagaggttttttaagaacaccccttggcctgaagcagaggctattgcgccacaggtggggaacgacgccgtttttctgatcctgtacaaagagttgtattaccgccacatctatgcgaaggtctcaggtggaccatccctggaacagaggtttgaatcctattacaattactgcaatctgtttaattacatcctgaacgccgacggaccagctcctttggagctacccaaccagtggctgtgggatatcatcgatgaattcatttaccagtttcagtcgttcagccagtaccggtgcaaaactgctaaaaaaagcgaagaggagatcgattttctgcgctccaatccgaaaatttggaacgttcactccgtcctcaacgttctgcactcgctggttgataagtctaatatcaacaggcagctggaagtctatacttccggcggagaccctgaatctgtggccggagagtacggcagacactccctctataagatgctggggtatttctccttagtaggacttctgcgtctccactccctgctgggcgactattaccaggccattaaggtccttgaaaacatcgagttgaacaagaagtcaatgtatagcagagtgcctgaatgccaggtcacaacttattactacgtcgggtttgcctacctcatgatgagaaggtatcaggacgcaattcgcgtgtttgccaacattctgctctatatccagagaacaaagagcatgttccagagaacaacgtacaagtacgaaatgatcaataagcaaaacgagcaaatgcatgccctactagcgatagcactgacaatgtatcctatgagaatcgacgaatcaatacacctgcagttgagagagaagtacggcgataagatgctgcgcatgcagaaaggggacccacaggtctacgaggagctgttctcttatagttgccctaaattcttaagccctgtggtccccaattacgataacgtgcaccccaattatcacaaggaaccattcctacagcagttgaaggtgtttagcgacgaagtacagcagcaggctcagttgagcacaattcgctcatttctgaaactctacaccacgatgccagtcgcaaagttagctggcttcctcgacctcaccgaacaggaatttaggattcagctgctagtgttcaaacacaaaatgaagaacctggtctggacctctggcatctcagctctggatggtgaattccaatcagcatcagaagtggatttttatatcgataaggacatgatccatattgccgataccaaggtggcccgaagatatggagacttttttattagacagattcataagtttgaggagctgaaccgcacactcaaaaagatgggacagagaccgtag

SEQ ID NO: 30098 - DNA, 1308 bp, Artificial Sequence
  Description of Artificial Sequence: Synthetic coding sequence
atggccgcttccagcttggaacagaagttatcacggctcgaagctaaattgaagcaggagaaccgagaagccaggcgcagaatcgacctcaaccttgatatcagtccacagagaccccgaccaataattgtcatcacactgagccccgcaccagccccttctcagagggccgctctccagctcccccttgccaacgacgggggttcacggagtccaagctctgagtcgtcaccgcagcacccaacccccccagctaggccccgtcatatgcttggattacctagtacactgttcacaccgcgatccatggagtcaattgaaatcgaccagaagctgcaggagatcatgaagcaaaccggctatctcactattgggggacagaggtatcaagcggagatcaacgacctggagaacctgggggagatgggttctgggacatgcgggcaggtctggaaaatgcgtttccgcaaaacaggacatgtgatcgccgtgaaacagatgaggcggagcggcaacaaagaggagaacaagagaattctaatggacttggatgttgtgctgaagtcacacgactgcccttatattgtccagtgcttcggaacatttattactaatacagacgtgtttattgccatggaattgatgggaacctgcgctgagaagttgaaaaaaagaatgcagggccctatccccgaacggattttgggaaagatgacagttgctattgtgaaggctctgtattatctcaaggaaaagcacggagtcattcatcgcgatgttaaaccaagcaacatactgctcgacgaaagaggccagattaaactttgcgacttcggcatctctggcaggcttgtcgactcaaaggccaagactcggtctgcaggatgtgcggcatacatggcccctgagagaattgatcccccagacccgacgaaacccgattacgacatcagagcggacgtttggtctctgggcatttcacttgttgagctagcaaccggccagttcccctacaagaactgtaaaacggacttcgaagttctcacaaaggtgcttcaggaagagcctcctctgctgcctggccatatggggttcagtggagatttccagtcttttgtcaaagactgtctcacaaaagatcaccgcaagaggcccaaatacaataaactcctcgaacacagttttattaaaagatatgaaaccctcgaggtggacgtcgctagctggttcaaggacgtgatggcgaaaacagaatcacctcgtacaagcggagtactgagccagccacacttgccctttttcaggtag

SEQ ID NO: 30099 - DNA, 3006 bp, Artificial Sequence
  Description of Artificial Sequence: Synthetic coding sequence
atggcctcaagccctctgcccggtccaaacgatattcttcttgcctctccctctagcgcgtttcagcctgacacactcagccagcctagaccaggccacgctaacctcaaacctaaccaggttgggcaagtaattttgtatgggatacctatcgtatccctcgtaatcgatggtcaggagagactgtgcttggcgcagatttccaatactctgttgaagaacttttcatataacgaaatccacaaccggagagtcgccctagggatcacttgtgtgcagtgcactcccgtccagttagagattctccgcagagccggtgccatgcctatatcctctcgcaggtgtgggatgatcaccaaacgagaggctgagcgcctttgcaaatccttcctgggcgaaaatagacctcccaaactaccggataattttgcctttgacgtatcacatgaatgcgcctggggatgcagaggaagcttcatcccagcaaggtacaattccagtcgcgctaaatgcatcaaatgcagctattgcaatatgtatttctcgccaaacaagttcatctttcattcccaccgcacaccagacgctaagtatacccagcccgatgctgcaaattttaatagttggcgcagacatctcaagctgacagacaaaagtccccaggacgaacttgtgttcgcatgggaggatgtcaaggcaatgtttaatgggggtagcaggaagcgggcacttccccagcctggagcccaccctgcttgtcacccattgtcctcagtgaaggccgcagccgttgccgcagcagcagcggttgcaggaggaggcggtctactgggaccccacctgctcggcgcaccaccacctccccctcccccaccaccaccccttgcagagctcgccggagccccacacgcccaccacaaacgacctcgctttgacgatgatgacgatagcctgcaagaggctgcggttgtcgccgctgcttccttatccgcagctgctgccagtttgtccgtggctgcagcgtcggggggagccggaaccggcggaggaggcgctggcggtggttgcgtggccggtgtcggtgtgggagctggagctggtgctggtgctggcgcaggcgctaagggacccaggtcatacccagttatccctgttccctctaaaggtagctttgggggagttctacagaagttccctggatgcggcggactcttcccccatccatatacctttcccgctgctgccgctgcattttccttatgccataagaaagaggatgccggagcagctgctgaggcattgggaggagccggagctgggggagccggtgccgcaccaaaagctggtctcagtggcctcttctggccagctggacgaaaggacgccttctatcctcctttctgcatgttttggccacctcgcacccccggaggtttacctgtccctacttacctgcagccacccccacagcctccctcagccctggggtgtgctctgggcgagagtccagccctattgcgccaggctttcctggatttggctgaacccggaggcgctgccggtagcgcggaggcggcaccaccccctggccagccccctcaggtggtcgccaacggccctgggagcggccctccgccaccagctggcggagctggttctcgcgatgctctctttgagtcacccccagggggttccggcggtgactgttccgcaggctccacacctccagccgactctgtggcagcagccggtgctggagccgctgctgcaggctctggaccagcgggttcccgggtcccggctccgcatcacccccatctcctggaagggcgaaaggctggtggcggaagctaccaccatagtagcgcatttcggccagtaggcggtaaagacgacgccgagtcactggcaaagctccacggagcttctgcgggtgcacctcatagcgcacagacccacccccaccatcaccaccatccgcatcaccatcaccatcaccatcatccaccccagccgccttcccctcttctactccttccccctcagcccgatgagcccggaagcgaacggcatcatcctgccccacctcccccaccccctccccctccccctccgccattggcccagcatcctcatcatcggggtctgctgtctccagggggaacatcctgctgctatcctagcgaagacagcagcgaggatgaggacgacgaggaggaggagcaagaggtggacgtggaagggcataagcccccagagggcgaagaggaagaagagggacgcgaccctgacgatgacgaggaggaagacgaggagaccgaagtactcctaggcgatcccctggtcggcggaggaaggttcctgcaggggagaggtccctcggagaagggaagttcccgggatcgggctccagcagtagctggggcattccccctgggtttgaactcctcccggcttctgcaggaggacgggaaactcggagatcctgggagtgatcttcccccacccccacctccccctctcgcccctcagaaagcatctgggggaggatcttctagtccagggtctccagttcaccatcccagtttagaagaacaaccttcttataaggattcgcaaaagacaaaagagaataaccaggttatagtcagtactaaggacgataattccttctcagacaagaacaaggaacattcgttcttcatcactgattcagacgcttcaggaggagacttttggagggaacggagtggcgaacacacacaagaaacgaactccccccactctctcaaaaaggatgttgagaatatgggtaaggaggagctgcaaaaggtcctttttgaacagatcgatcttcggcgtagactggagcaggaattccaggtgttaaagggaaatacaagcttccctgtatttaataactttcaggatcagatgaagagggagctcgcctatcgggaggaaatggtccagcagttgcaaattgtttcctgcattagcacctag

SEQ ID NO: 30100 - DNA, 198 bp, Artificial Sequence
  Description of Artificial Sequence: Synthetic coding sequence
atggctatggccccaagccctagcctagtgcaggtgtatacttctccggcagccgtcgcggtttgggaatggcaggatgggttggggacgtggcacccatatagtgcgacagtatgtagtttcattgaacagcagttcgtgcagcagaagggtcagaggtttgggctagggagccttgcccacagcattccactgtag

SEQ ID NO: 30101 - DNA, 1041 bp, Artificial Sequence
  Description of Artificial Sequence: Synthetic coding sequence
atgatctctcgaccggcatggctgtggggggctgagatgggggcaaacgagcacggagtgtgcattgcaaatgaggccatcaacacaagggaaccagcagcagaaattgaggccctcctggggatggaccttgtgaggctgggattagaacgtggtgagacagctaaagaggccttggacgtgatcgtctccctcctagaggaacatggccagggagggaattacttcgaggatgcgaatagctgtcattcgttccaatctgcgtacctgattgtggacagggacgaggcctgggtactggaaaccatcggtaagtactgggccgctgaaaaggtgacggaaggtgtcagatgcatctgcagccaactgtctctgacgaccaaaatggacgccgaacacccagagctccggtcctacgctcagagccagggctggtggaccggagagggcgagtttaactttagcgaggtgttttccccagtcgaagaccacttagattgcggagccggaaaggactctcttgagaagcaggaagagtcgatcactgtgcagactatgatgaatactttgcgggacaaggcatcgggggtgtgtattgatagtgagttttttctaacgactgccagtggtgtgagtgtgctgccccagaacagaagttccccgtgcattcactatttcactggaacccctgatccctcgcgcagcatctttaagccatttattttcgtggacgatgtcaagctcgtgcccaaaacgcagagtccatgtttcggcgatgatgatcccgcaaaaaaggagcctcgctttcaggagaaaccagacagacggcatgagctgtataaggctcacgagtgggctcgcgctatcatcgaatctgatcaagaacagggcaggaaactgcgctccactatgttggagctggaaaaacagggcctcgaggctatggaggaaattttgacgtccagtgaaccactcgaccctgcggaagttggcgatctcttttatgattgcgtagacacggagattaaattttttaaatag

SEQ ID NO: 30102 - DNA, 1620 bp, Artificial Sequence
  Description of Artificial Sequence: Synthetic coding sequence
atggcaacttctgctcccctgcggtccttagaggaagaagttacctgttcgatctgcctggattaccttcgtgatcctgtcactatagactgtggacacgtcttctgtcggtcttgcaccacagacgtgaggccaatcagcggcagcagacccgtgtgccccctttgcaaaaaacccttcaagaaggaaaacattcgccctgtctggcaactggctagtctggtggagaacatcgaaagactcaaggtagataaaggaaggcaacccggagaggtcactagagaacagcaggatgctaagctctgcgaaagacaccgagagaagctccattactattgtgaggacgatggcaaactgctatgcgtaatgtgccgtgagtctagagaacaccggccacatactgctgtgctcatggagaaggcggcacaaccccacagggagaaaattctgaaccatttgtcaacattacgcagagatagggataaaatccagggctttcaggccaaaggagaggccgacatactggctgccctcaaaaagctgcaggatcagagacagtatatcgttgctgagttcgagcaaggacatcagtttcttcgggagcgcgaagagcacctccttgagcagctcgccaagctcgagcaagaacttactgaaggcagagaaaagtttaagtcacgaggagttggggagttagccaggcttgctctcgtgatttcagaactggaaggcaaagcccagcaaccagccgcagaattaatgcaggatactcgggattttctaaaccgctacccaaggaaaaaattttgggtcgggaagccaatcgcgagagtcgtgaagaaaaagacaggagaattctccgacaagttgctgtccttgcagaggggcctccgcgaatttcaaggtaagctgctccgagacttggaatacaaaacggtcagcgtaacgttggatccccaatccgcgtccggctacctgcagctgagcgaagactggaaatgtgtcacctatacttcattgtacaagtccgcttacctgcacccacaacagttcgactgcgaacccggagtcttaggtagcaaaggttttacctggggcaaagtatactgggaagtcgaggtggagcgcgaggggtggtccgaggacgaagaagaaggtgatgaagaagaggagggtgaggaggaagaagaggaggaagaagccggatacggcgatggatacgacgactgggaaacagatgaagacgaggaaagccttggggacgaagaggaggaggaggaagaggaagaggaggaagttctcgaatcttgcatggttggtgtggcacgagactcagttaagcgtaaaggggatttaagcctaagacctgaagacggagtctgggccttacggctctcctctagtggcatttgggctaacaccagcccagaagccgaactatttcctgcgctgcggcctaggagggtgggtatcgcgctagattacgagggaggcactgtcaccttcacaaatgctgagtcccaggagctgatctatacattcactgcaacgtttaccagacggctcgtgcctttcctgtggctgaaatggcctggtacacggttgttgctccgcccatag

SEQ ID NO: 30103 - DNA, 390 bp, Artificial Sequence
  Description of Artificial Sequence: Synthetic coding sequence
atggccgagctgatacaaaagaaactccagggtgaagtcgaaaaatatcagcagctgcagaaggacctatccaagagcatgtccggcaggcagaaattggaggcgcagctgaccgaaaacaatattgttaaggaggaattggcactgctggatggatcaaatgtcgtgtttaagctcttgggaccagtgttggtgaagcaggagctgggcgaagctcgcgctaccgtcggaaagaggctcgactatatcaccgccgagatcaagcggtacgaatctcagctccgtgacctcgagcgtcaatctgagcagcagcgcgaaacacttgcacagcttcagcaagagtttcagcgtgcccaggcagccaaagcaggtgcgccaggaaaggcttag

SEQ ID NO: 30104 - DNA, 1740 bp, Artificial Sequence
  Description of Artificial Sequence: Synthetic coding sequence
atgagcgcggcaaatcccgagacacctaacagcaccatttcacgcgaagctagtacccagagttcgtctgccgcagcctcacaggggtgggtcttgccggagggaaagatcgtcccgaacacagtcttcgtcggaggcatcgacgccagaatggacgaaaccgagatcggttcttgctttggaagatatggcagtgtcaaggaggtgaaaataatcactaacaggaccggtgtatcaaaaggctatggctttgtgagctttgtgaacgatgtggatgttcagaagatcgtcggttctcagattcacttccacggcaaaaagctgaagctcggcccagcaatccggaagcagaagctgtgcgcacgccacgtacaaccacgacccttggtagttaacccaccaccacctccccagtttcagaatgtttggagaaaccccaacaccgaaacatacttacagccacagataacaccaaatcctgtgactcagcatgtgcagtccgccgctaaccctgaaactcccaatagcaccatctcccgagaagcatctacgcagtccagcagcgcggcagcaagccagggctgggttcttcccgaagggaagattgtgccaaacactgtgttcgtgggagggattgacgccagaatggacgaaactgaaatcggatcctgcttcggtcggtatgggagcgtgaaggaagtgaaaataattaccaaccggactggagtcagtaagggatatggcttcgtgagttttgtgaacgatgtggacgtgcagaaaatagtggggtcccagatacacttccacggcaagaaacttaagctcggacccgctatcaggaaacaaaagctttgcgcccgtcacgtgcagcctcggcctcttgtggtcaacccaccccctcccccacaattccaaaacgtgtggcgcaaccccaacactgagacatatttgcagcctcagattacacctaacccagttacccaacacgtgcaggcatattccgcttatccgcatagccccggacaagtaatcaccggttgtcagctactggtctacaactatcaggagtatcctacctatcccgacagcgccttccaggtgaccactggttaccaactgcctgtgtataattatcagccatttccggcatatccccgatccccctttcaggtgacggcaggttaccaactgcctgtatacaactatcaggcattccctgcttatcccaattctccatttcaggtagccacgggataccaatttcccgtgtataactatcagcccttcccagcctaccctagctcaccgttccaggtaaccgcaggttaccagctgccagtgtataactaccaggcattccccgcatatccgaattcaccatttcaggtagctaccggctaccagtttcctgtgtacaattaccaggcctttcctgcttatccgaatagcccagttcaggttacaacgggttaccagcttcccgtctacaactaccaagccttcccagcttacccaagctcgcccttccaggtaacaacaggttatcagctccccgtgtacaactaccaggcatttcctgcatatcctaactcggcggtccaggttacgaccggttatcagtttcatgtttacaattaccagatgccgcctcagtgtcccgtgggcgagcagagacggaacttgtggaccgaagcgtacaaatggtggtacctggtgtgcctgatccaacggagggactag

SEQ ID NO: 30105 - DNA, 831 bp, Artificial Sequence
  Description of Artificial Sequence: Synthetic coding sequence
atgtacgcaagctggacgaaggcgtgccgaggtctggaggaactgattaacctaacacgcctgaatgtaagctacaaccatatcgacgatctcagtggacttatccctctgcacgggataaaacacaagttacgctatattgatttgcattcaaatcggattgactccatccaccatttgcttcagtgcatggtggggctgcactttctgaccaatctgattcttgaaaaagatggcgatgataatcccgtgtgtcgcttacccggatatagggccgtgattctgcaaacactgccgcagcttaggatcctggactgcaagaacatattcggcgagccagttaacctaactgagataaactcttctcagctccagtgtctggaaggattattggacaacctcgtctcttctgatagcccattgaacatctctgaggacgagatcattgatcggatgccggtgataaccgcacccatagacgaattggtcccattggagcagtttgcaagcaccccttcagatgcagtcttaacgtcttttatgtcggtgtgtcagtccagcgagcccgaaaagaataaccacgagaatgacctgcagaacgagatcaagctgcaaaagctggatgaccaaattttgcagctcctgaacgaaacatctaattccatcgataatgtgctcgaaaaggacccccgaccaaagcgagataccgatatcacatcggagtctgactatgggaactcacgtaagaacggggagactaaaaaagccgctgccggttctacagataagaccgatcccagaggaggcacacagtccttttcttgtcgttag

SEQ ID NO: 30106 - DNA, 1995 bp, Artificial Sequence
  Description of Artificial Sequence: Synthetic coding sequence
atgggtgatgatggctctcctccagccaagaagatgatcaccgacatacatgctaacggcaagaccattaacaaagtgcccaccgtgaaaaaagagcatttggatgactatggcgaggctcccgtggagacggacggggagcatgtaaagagaacctgcacttctgttccagaaacacttcacttgaatcccagcctgaaacatacgctagcacagtttcacttgtcatcccagtcgtctctaggaggaccagccgctttctcagcgaggcactcccaagaaagcatgtccccaacagtcttcttgcccctcccgtcaccacaggtactgccgggacctctcctgatccctagcgactcctccacagagctcacacagaccgtgctggagggcgagtccattagctgctttcaagtgggcggtgaaaagcgcctatgtcttcctcaggtactcaatagcgtcctgcgagaatttacactccagcaaattaacaccgtctgcgatgagctgtacatttattgcagcaggtgtaccagcgatcaacttcacatccttaaggtgctgggcatcctgcctttcaacgccccttcatgtggcctaattacccttactgacgcccagagactttgtaacgccctcctgcgacctcggacctttccacagaacggctcagttctgcccgcaaagtccagccttgctcagttgaaagagactggatctgcctttgaagtggaacacgagtgcctgggaaaatgtcaggggctttttgcaccccaattttacgtgcagcccgatgccccttgcatccagtgtctggaatgctgcggcatgttcgccccacagacctttgtgatgcatagccatcgctccccagacaagcgtacctgtcactggggttttgaatccgcgaaatggcactgttaccttcatgtgaatcagaagtacctgggcacgccagaggaaaagaagctaaagatcattctagaagaaatgaaagagaagtttagcatgcgtagtgggaagagaaaccagagcaagactgacgcgccaagcggcatggaactgcagtcctggtacccggttatcaaacaagagggggaccatgtttcccagactcacagttttttgcacccctcttactatctgtatatgtgcgataaagtggtggctcccaatgtgagtttaacatcagccgtctctcagtccaaggagctgacaaaaacagaagccagcaagtctataagccgccagtctgagaaagcacactccagcgggaaactgcagaaaacggtctcataccccgacgtgagtctggaggagcaagaaaagatggatctaaaaacctcacgcgagctgtgctccagactggacgcatcaattagcaataactctacctccaaacgtaaatccgagtcagccacctgcaacctcgtgagggacatcaataaagtgggaatcggactggttgccgcagcttcctcccctctgctcgtgaaggacgtgatttgcgaggacgacaagggaaagattatggaagaagtcatgaggacttatctcaaacagcaagagaagctgaacctcatattacagaaaaagcagcaactccagatggaggttaagatgctgagctcgagtaaaagcatgaaggaactgacggaagagcagcagaatctccagaaagagctagaatcacttcagaatgaacacgcccagagaatggaagagttttacgtagagcagaaagatctcgaaaaaaagctcgaacaaattatgaagcagaagtgcacatgcgactcaaacctcgagaaagacaaggaggcagagtacgcaggccaattggccgagctcaggcaacgtctggaccacgcagaggctgatagacaggagctccaggatgaactacgccaggaacgagaagctagacagaaactggaaatgatgattaaagagctcaagctgcagatacttaaaagttccaagaccgctaaagagtag

SEQ ID NO: 30107 - DNA, 1068 bp, Artificial Sequence
  Description of Artificial Sequence: Synthetic coding sequence
atgggacgtagagaccttgtgtctggaggcagtaacgaaggaaacggcaaggaagactgggctatgaaaacagtgagcctaaggtggaccaagctgccacctgtaaagtctgccataagagggcaggctccagttgtcccatacatgcggtacggacactcaaccgtgttgatcgatgatacagttttgctctggggtggcagaaatgacactgaaggggcttgtaacgttctttacgcattcgacgtgaacacacacaaatggttcactccaagggtgtcaggcactgtgcccggagccagagatggccatagcgcctgcgtgcttggcaaaatcatgtatatcttcggcggttatgagcagcaggccgactgtttctctaacgacatacataaactcgacacgagtactatgacgtggacccttatttgcaccaaaggctcacctgccaggtggcgcgattttcattccgcaacaatgctaggctctcatatgtatgtgttcggcggaagggccgaccgattcggaccctttcattctaacaacgagatctattgtaatcggatcagggtctttgacactcgaactgaagcatggctggattgcccccctactccggttctccctgagggccgacgatcacactcagccttcgggtacaatggggagctgtatatcttcggtgggtacaacgccaggctcaataggcattttcatgatctgtggaagttcaatcccgtctctttcacatggaagaaaatcgagcctaaaggcaagggaccgtgccccaggagaaggcagtgctgttgtatagttggagacaagatcgtgttgttcggcggtacatcccccagccctgaagaaggacttggcgatgaatttgatcttattgaccacagcgacctacacatactggacttttctcctagcctgaagaccctgtgcaaactggcagtaatccagtataatctggaccagagttgcctaccacacgatatcagatgggaactcaacgctatgacaaccaatagtaatatcagtcggccaatagtttcaagccatgggtag

SEQ ID NO: 30108 - DNA, 1245 bp, Artificial Sequence
  Description of Artificial Sequence: Synthetic coding sequence
atggccgctgccccaccatcttattgctttgtagcatttcccccaagagccaaggacgggctggttgtattcgggaaaaacagtgcacggcctcgggatgaggtacaggaagttgtatacttttctgcggctgaccacgaacctgagagtaaagttgagtgtacttacattagcatagatcaggtgcctaggacttacgccatcatgatatccaggccagcgtggttatggggcgctgagatgggggctaacgaacatggggtttgtattgccaacgaggctattaatacacgggagcccgctgctgaaatcgaggcactacttgggatggaccttgtgcggctgggtctggaaaggggggagaccgctaaggaggctttagatgtcatcgtcagtctgctggaggagcacggtcagggtgggaattactttgaggatgccaatagctgtcactcatttcagtctgcttacctgatcgtcgaccgggatgaagcctgggtcctggagaccattggtaagtactgggctgctgagaaggtaaccgaaggagtccgttgtatctgttctcagctctccttgacaacaaagatggatgctgaacatccagaactcaggtcttatgcgcagtcccaggggtggtggacgggcgagggtgaatttaacttcagcgaagtcttttcccccgttgaggaccacctggattgcggtgcagggaaagacagcttagaaaagcaggaagaatccataactgtgcagacgatgatgaatacccttcgggacaaggccagtggcgtgtgcattgattcagagtttttcctgaccacagcctccggcgttagcgtgctgcctcagaaccgcagctccccatgtatacactacttcacaggcacacccgatccttcccggtcgatattcaaaccttttatattcgtggacgatgtgaaactggttccgaaaactcaatccccctgtttcggtgacgacgatcccgctaaaaaagagcctcgcttccaggagaagcctgatcgcagacatgaactatacaaagcacacgagtgggcaagagcgataatcgagtctgatcaagaacagggcagaaaactccgaagcaccatgctagagttggaaaaacaagggctggaggccatggaggaaattctgacctcctctgagcctttagatcctgccgaggttggggacctgttttacgactgcgtggatacagaaattaaattctttaaatag

SEQ ID NO: 30109 - DNA, 1200 bp, Artificial Sequence
  Description of Artificial Sequence: Synthetic coding sequence
atggcaaccggggatcttaagcgatcactcaggaatttagagcaagtgcttcgtcttctcaattaccctgaagaggtggactgtgtcggactaataaaaggagacccagccgcaagcttaccgatcatttcctactcattcactagttactccccatacgtgaccgagctgatcatggaatctaacgtcgaattaattgccaagaatgacctgcgttttattgacgctgtgtacaagttgctgagagatcagtttaattataaacctatcttgacgaagaaacagtttatccagtgcggttttgcggagtggaaaattcagatcgtgtgcgacattctaaactgtgtgatgaaaaaacacaaagagctgtcctctttgcaaaagattccttcgcaacagcgcaagaaaatatcaagtggtaagtccgaacccccactcggtaatgagaagatctccgctgaagcggtgggagtggacatatccggccgtttcatgacctctgggaaaaagaaggcagtggttatcagacacctgtacaacgaggacaatgtggacatctccgaggacactctgtcacccattactgatgtgaatgaggctgtggatgtgtccgacctgaacgcgactgaaatcaaaatgccagaagtaaaagtgccagaaatcaaggctgaacaacaggatgttaacgtcaaccctgaaataaccgctctgcaaacgatgctagcggagtgccaggaaaacctcaagaagctaactagcattgaaaaaaggctggactgcctggaacagaaaatgaagggcaaggttatggtggatgaaaacacatggaccaacttgctgtcaagggtgacgctgctcgaaacagagatgctgctctctaaaaagaatgatgaattcatagagttcaatgaggtgtctgaggactatgcaagctgtagcgacatggatctcctaaatccccacaggaagtctgaggtggagcgcccagccagcataccccttagctccgggtactccacagctagctccgacagtacgcctagagcttcaacagtgaactactgtggcctcaatgagatcagcgagaactttcctgcatggtccgccacatctagttgctctagtctgagctggctgctgcggggacacactagctacctaagctctcagtcatttgcctggcccctgtcctgcgtctag

SEQ ID NO: 30110 - DNA, 1317 bp, Artificial Sequence
  Description of Artificial Sequence: Synthetic coding sequence
tgatgtgccggtgcagagcgcccaaggaggagaggtaggctgtgggactcaagtggcgtaccacagagacagaaacggcctggaccttggcgcacccagacacaggagcagatgagccgcgatgtgtgtatacacacttggccttgtacatactacctcgagcccaaacggcgatgggtaaccggccagctgagcctgacttccttatctctgagattcatgacggatagtaccggcgagatccttgtgtcatttcccctttctagtattgtagaaatcaaaaaggaggcctcccacttcatcttttcctctatcactatactcgaaaagggccatgccaaacattggttttcctccttgagacctagcagaaatgtagtgttcagcattattgaacacttttggagggagctgctgctgtcccaacccggagccgtggccgacgccagcgtgcccaggacccggggagaggagttaaccggtcttatggccggtagtcagaagcggctggaggatacggcaagggttttacatcatcagggccagcaactggacagcgtcatgcgcggattggataaaatggagagcgatttagaggtggctgaccgattgctcaccgaactggagagtccggcatggtggcctttttcttctaaactgtggaagacaccgcctgagactaagcccagggaggacgtgagcatgacctcctgcgagccgttcgggaaagagggcattctcatcaaaatcccggcagttatctctcacaggactgagtcccatgtgaagcctggtagactgacagtgctcgtgtccggactagaaatacacgactctagttctctgttaatgcacaggtttgagcgtgaggacgtggacgacatcaaagtgcattccccttacgaaattagcatccgccagagattcatcggtaagcccgacatggcctatcggctgattagcgcaaaaatgccagaagtcattcctattcttgaggttcagttttccaagaaaatggaactacttgaggacgcactggttctcaggtcagccaggacatccagtcccgctgaaaagagttgtagcgtttggcacgccgcttcgggactaatgggcaggacattacatcgggaaccaccagccggagatcaagaaggtaccgcgttgcatttacagacttccctgcctgccctctccgaggcagatactcaggaactcacacaggggttcagacccatgtctcttagtacccaaacggtccttgtgatgttatgctctgagagcgcaggcgctctgtggcggcaacggttatcatag

SEQ ID NO: 30111 - DNA, 711 bp, Artificial Sequence
  Description of Artificial Sequence: Synthetic coding sequence
atgaccggatatgaggcgaggctgattacgtttgggacttggatgtacagtgttaataaagaacaactggcacgcgcaggtttttatgccatcggccaagaagacaaggtccagtgcttccattgcggaggcggactggcaaactggaagcccaaggaagacccttgggagcagcacgccaagtggtaccccggatgcaaatacctcctggaagaaaaaggccacgagtacatcaacaatattcacctaacgcggtcccttgaaggcgctcttgtccagaccacaaagaaaacaccatcactgaccaagcgcatttctgataccatctttcctaaccccatgttacaggaagcaatcagaatgggattcgatttcaaggacgtgaagaagattatggaggagcgcattcagacctctggctctaactacaaaacattggaagtcctggtcgcagacctggtttctgcccagaaggatacgacggaaaacgagctgaatcagacatcactgcagcgggagatcagtccagaagagcctctgaggcggctccaggaggaaaagttgtgcaagatctgtatggatcggcacattgccgtcgtcttcattccatgcggccatctggttacctgtaagcagtgcgccgaggccgtggatagatgtccaatgtgcagcgccgtaatcgactttaaacagagggtttttatgagttag

SEQ ID NO: 30112 - DNA, 285 bp, Artificial Sequence
  Description of Artificial Sequence: Synthetic coding sequence
atgaatccaacaaatcctttctcagggcagcagcctagcgcgttttcagccagtagctctaatgtgggcactctgccttctaagcctccttttagattcggtcagcctagcctatttggacagaacagcaccctgtcaggaaagtcatccggcttctctcaggtgagttcattccccgcatctagcggggtctcccattcctccagcgtccaaactctgggcttcacccagactagttccgttgggcctttctcgggtctcgagcacacctccacgttcgtgtag

SEQ ID NO: 30113 - DNA, 723 bp, Artificial Sequence
  Description of Artificial Sequence: Synthetic coding sequence
atggctatagtgcagaccctgcccgtgccattggaacccgctcccgaggcggcaactgcgccacaggcccctgtcatgggttcagtctccagcctgatctccgggagaccctgccccggtgggccagctcctccacgacaccatggcccaccaggccctacattttttagacagcaggacggactgcttagaggaggctatgaggctcaggagcctctctgtcccgcagtgcctccgagaaaggccgtgccggtgacgtcctttacctacatcaatgaggacttccgaaccgaaagcccacccagcccatctagcgacgtggaagacgccagggagcagagggcacacaatgcccatctgcgcggaccccctcctaagctgataccagtgagtggtaaactcgaaaagaatatggagaaaatcctgatccgtccaactgcttttaaacccgtactgccaaaaccacgtggagcaccttcgttgccaagtttcatgggtcctagagccaccgggctgagtggcagccagggcagtctcacacagctgttcggtggccctgcaagcagttcgagcagcagttcctcttcatccgctgctgacaaacctctggccttttcagggtgggccagcgggtgcccatccggcacgttgtccgatagcggtcgaaacagtctgtcaagtttgcccacctactctaccgggggtgctgagccaacgacgtag

SEQ ID NO: 30114 - DNA, 1317 bp, Artificial Sequence
  Description of Artificial Sequence: Synthetic coding sequence
atgtgtcccaaaaatgcctcttactacggaaaccgggctgctacactgatgatgctcggcagattccgtgaggccctcggcgatgcacaacagtctgtgcgtttggacgattccttcgtccgtggacacttacgcgagggaaaatgtcacctgagcctcgggaatgccatggcggcatgtcggtctttccagcgggctttggagctggatcacaaaaatgctcaggctcagcaagagttcaaaaatgccaatgccgttatggagtacgaaaaaattgctgagacagattttgaaaagcgcgatttcaggaaagttgtgttctgtatggacagggcactggagtttgctccagcctgtcatcgttttaaaatccttaaagcagagtgcttagctatgctggggaggtacccagaggcacagtccgtagcatccgatattttgagaatggactccacaaacgcagatgctctgtacgttcgagggctgtgtctgtattatgaggactgcatagaaaaggcagtgcaattttttgtccaggctctgagaatggcccctgatcacgagaaggcatgcatcgcatgtcgcaacgcgaaagcgctgaaagctaaaaaggaggatggtaacaaggccttcaaagaaggcaactataaattggcgtatgaactctatactgaggcgctgggcatcgatcctaacaatatcaaaactaacgcaaagctatattgcaataggggcaccgttaactctaagctgaggaagctcgacgatgctatagaggactgcaccaatgccgtgaaactcgatgatacttatatcaaggcgtatcttcggagagcgcagtgctacatggatacagagcaatatgaggaagccgtccgagactacgagaaggtgtaccaaacagaaaagaccaaagagcataagcagttgctgaaaaacgcccagttggagcttaaaaagtctaagcgaaaagattactacaaaattctgggagtcgacaaaaatgcctccgaggacgagattaagaaggcctaccgaaaacgcgcactgatgcatcatccggataggcacagcggcgctagcgcagaggtgcagaaagaagaggagaaaaagtttaaggaggtgggggaggcattcaccattctgtccgatcctaagaagaagaccaggtacgacagtggccaagacttggacgaggaggggatgaatatgggcgacttcgaccccaacaatattttcaaggccttctttggcggaccaggcggtttctccttcgaggcatccggcccaggaaactttttcttccagttcgggtag

SEQ ID NO: 30115 - DNA, 678 bp, Artificial Sequence
  Description of Artificial Sequence: Synthetic coding sequence
atggaggaagaagagatgaatgatggaagtcagatggttaggagccaagagagcttgacttttcaagatgtggctgttgattttacacgggaggagtgggaccaactgtaccctgcccagaaaaatttgtaccgggacgtgatgctcgaaaactatagaaacctggtggcccttgggtaccaactgtgcaaacctgaagttatcgcccagttagagctggaggaggagtgggtcattgaaagagacagtcttttagatacccatccaggggaccaatctcatgtgatgtccgtggtccgctccagcgtgcacgccagatggattgttggaaaagtgatcggcacgaagatgcaaaaaaccgccaaggtcagggtaacccgactggtactggatccctacctactgaaatattttaacaaaagaaaaacttacttcgcacatgacgccctacagcagtgcaccgtgggggacatagttctgctacgagctctgccagtgccgagagcaaaacatgtaaagcacgaacttgccgagattgtgtttaaagttggaaaggtcattgaccccgtcacgggaaagccttgtgccggtaccacttatctggaatcaccgctgagtagcgagacaacccagctctcaaagaacctggaagaattgaacatctcgtcagcccagtag

SEQ ID NO: 30116 - DNA, 753 bp, Artificial Sequence
  Description of Artificial Sequence: Synthetic coding sequence
atgactaccaagaatctggagaccaaggttacagtcacctcctcacccatccggggtgctggagacggtatggagacagaggaaccacccaagagtgtagaggtcacatcgggggtacagagcaggaagcaccattccctccagtccccgtggaagaaagccgttccttccgagtcaccaggcgtgttacagctgggaaagatgttgaccgagaaagctatggaggtgaaagccgtcagaatcttggtgcctaaggctgcaatcacccacgacatacctaacaaaaacacgaaagtgaaatccttaggtcaccataaaggcgagtttctgggtcagtccgaaggcgtgatcgagccaaataaggagctgagtgaggtcaagaacgtcctcgagaaactcaagaactcagagcggaggctgctccaggacaaagaaggtctttctaatcagctccgagtgcagacagaagtcaatcgagagctcaagaagcttctggttgcatccgtaggcgatgatttacagtaccattttgagaggctcgctcgggagaaaaatcagttgatcctcgagaatgaagccctgggaagaaataccgctcagctctccgaacagctagaacgcatgagtatccagtgtgacgtctggaggagcaagttcctcgcctctcgagtcatggcagacgaactgaccaacagtcgcgctgcactgcagagacagaaccgggatgcacatggagctatacaggatttgtag

SEQ ID NO: 30117 - DNA, 387 bp, Artificial Sequence
  Description of Artificial Sequence: Synthetic coding sequence
atgttatgttggggatattggagtctagggcagccaggcatctcgacaaacctgcaaggcattgtagccgagccccaggtgtgcggctttataagcgatcgcagtgtgaaggaagtggcctgcgggggaaatcacagcgtttttctcctggaagatggtgaggtgtacacatgcgggctcaacaccaagggccagctcggccatgagcgcgagggcaataaacctgagcaaatcggggcactggccgatcaacatatcatccatgtagcctgcggcgaatctcactcactggccctatccgatcgcggtcagttgttctcttggggggcaggatccgacgggcagttgggactcatgactaccgaggattcggtggctgtgccctag

SEQ ID NO: 30118 - DNA, 1617 bp, Artificial Sequence
  Description of Artificial Sequence: Synthetic coding sequence
atggacgtggataaggagctggggatggagagcgttaaggccggtgcatccgggaaaccggagatgcgcctgggaacccaggaggagaccagcgagggtgatgccaatgaatccagccttcttgtgctgtccagcaatgtgccactccttgctctggaattcctagagatcgcacaggccaaagagaaggccttcctccctatggtatcacacacattccacatgaggaccgaagagagtgacgcttctcaggaaggggacgacttacctaaatcctccgccaataccagccacccaaagcaggatgattcacccaagagttctgaggaaacaattcagccaaaggagggtgacattcctaaagcacccgaggaaacaatccagagcaagaaggaagacctgcccaagtctagtgaaaaggccattcaaccaaaggaaagtaacattcccaagagtagcgctaagcccatccaaccaaagctgggcaatatcccaaaggcctctgtaaagccgtcacagcctaaagaaggcgatattcctaaggcccctgaggagacgattcaatccaaaaaggaggacctgcccaagtcctcggaggaggccatccaacctaaagagggggacatccccaagtccagcgctaaacctatacaacccaagctaggaaacattgccaaaactagtgtgaaaccttctcagccaaaggagagtgacatacctaagagccctgaggagacgatacagcctaaagagggcgatattccaaaatcatcagctaaaccaatccaacccaaacttgggaatatacccaaagcatccgtgaaaccatcacagcccaaggaaggcgacatctccaagtcgccagaggaggccatacagcctaaggaaggcgacctgcccaaatccctcgaggaggccatccagcctaaagaaggcgacattcctaaatctcttgaggaggccattcagcctaaagagggagacatcccaaagtcgcccgaagagacaatccaacccaaaaagggggatataccaaagagcccagaggaggcgatccaaccgaaggagggcgatatacctaagtcaccaaaacaggccattcagcctaaagaaggcgatatcccaaagtcccttgaagaagctatcccaccaaaggaaatagacatccctaaaagccctgaggagaccattcagcccaaggaagacgattccccgaaatcattggaagaggccaccccgagtaaagagggtgacattctcaagccagaagaagagaccatggagttccccgaaggtgataaagtgaaggtgattttgagcaaggaagacttcgaggcctcgctgaaggaggcaggtgaaagactggtcgccgtggactttagcgctacctggtgtggcccatgtcggacaattagacccttttttcacgctctgtccgtgaaacacgaggacgttgtgtttctagaagttgacgctgacaattgtgaggaggtcgtcagggagtgcgcgatcatgtgtgtgcctacatttcagttttacaagaaagaggagaaagtggacgagctgtgcggggcactgaaggaaaagttagaggctgtcatcgcagaattgaaatag

SEQ ID NO: 30119 - DNA, 153 bp, Artificial Sequence
  Description of Artificial Sequence: Synthetic coding sequence
atggcgtccgaggaactccagaaggacttagaagaagtgaaagtacttctcgagaaggcaacacggaagagagtgagggatgcgctgacagccgaaaagtctaaaatcgagaccgagattaaaaataagatgcagcagaagagccagaaatag

SEQ ID NO: 30120 - DNA, 1527 bp, Artificial Sequence
  Description of Artificial Sequence: Synthetic coding sequence
atggccactgattggctggggtcgatcgtgagtatcaattgtggggacagccttggagtctatcagggacgcgtctccgctgtggaccaggtatcacaaactatcagcctgacaaggccattccataacggcgtcaaatgtcttgtccccgaagtgacctttcgggcaggtgatattaccgagcttaaaatcctggaaatccctggcccaggggacaatcagcacttcggcgatctccaccagactgagctgggaccatctggcgcaggttgtcaggtgggaataaaccagaatgggaccgggaaatttgtaaaaaaacctgcaagcagctcctctgcccctcagaatatacccaagcgtaccgacgtgaaatcccaggatgtggccgtgagcccgcagcaacaacagtgcagcaagtcatacgttgacaggcacatggagtcgctctcccagagcaagtcatttcgcaggagacacaactcctggagctcctcctcccgtcaccccaatcaggccactcctaagaaaagcggtcttaagaacgggcaaatgaaaaacaaagatgacgaatgctttggagacgacattgaggaaataccagacactgatttcgacttcgagggcaaccttgccctgttcgacaaggcagctgtcttcgaggagatcgatacttacgaacggcgatccggtactcgatctaggggaatccctaatgaaagaccgacccggtacagacacgatgagaacatccttgagagtgagccaattgtgtatcgccgaatcattgtacctcacaacgtgtctaaggagttttgcaccgactctgggctggtagtccccagcataagttacgagttacacaaaaaactcttaagtgttgctgagaaacatggtttgaccctggaacgccgtctagaaatgactggggtttgcgcctctcagatggcccttactttactaggcggaccaaaccgacttaaccctaaaaacgtgcaccagagaccgactgtggcgctgctctgtgggcctcacgttaagggtgctcagggaataagctgcggtagacatctggccaaccatgacgtacaggtgattctgttcctgcctaatttcgtcaagatgctggagtccattactaacgaactctctctgttctccaagacacagggacaacaagtgtcctctttgaaggaccttcctacatccccagtggatctggtgatcaattgtctggactgccccgaaaacgtgttcctccgcgaccagccttggtacaaggcggcagtggcttgggctaatcagaaccgcgcacccgtgctgtcaatcgacccaccggtccacgaggtggaacagggcattgacgccaagtggagcctcgcactgggactgcctctgccactgggggaacacgccggaagaatatacttatgcgatatcggcattccccagcaggtcttccaggaggtggggattaattatcactcaccattcggctgtaagtttgtcattcccttgcacagcgcctag

SEQ ID NO: 30121 - DNA, 3846 bp, Artificial Sequence
  Description of Artificial Sequence: Synthetic coding sequence
atgaccttttatagttggattccttaccataggcaagcaccactgaatcaccggcgagtgtgtagcgccgaaggtgccggatctcccggaccagcccttgatcctaggtggttgccaacagaagctcacctgctcgaagcgcatcgtcttctgctgcagtccgttctgtgtgacagacccagggagagcatccagttgcattttcggctctctatggcctctcagctccaggtgttttctccacccagtgtaagtagcagcgctttctgtagtgccaaaaagcttaagatagagccaagcgggtgggatgttagtgggcagtccagcaatgacaaatattatacccacagcaaaacgctgcccgcaactcaaggtcaggccaatagtagccatcaggtggccaattttaatatcccagcctacgatcagggtttgctcctgcctgcccctgccgttgagcacatcgtggtaacagccgcagatagttccggttcagctgccaccagcacctttcagtcttcccagacattaacccatcgtagtaatgtttccctgcttgaaccctaccagaaatgtgggttgaaaagaaagtctgaggaggtggattcgaatggcagcgtgcaaatcatcgaggagcacccacctctgatgctgcagaaccgcaccgtggtcggggctgccgctacgaccactactgtcaccactaaaagctcctcaagttctggcgagggggactatcaactggtacaacacgaaatattgtgttcaatgacgaactcttacgaggttctggagttcctgggtcggggtactttcgggcaggtggccaagtgttggaagcgctctacgaaggagattgtggcgattaagatcctgaaaaatcatccaagttacgctcggcagggacaaatagaggttagcatcctaagcaggttatcgagtgagaacgccgatgaatataattttgtgaggagctatgagtgcttccagcataagaatcacacctgtctagtcttcgaaatgctggaacagaacctgtacgacttcttgaagcaaaacaagtttagccccctgccacttaagtatatccggccaattctgcaacaggtcgccacagcactgatgaaattaaagtctctaggcctcattcatgccgacctcaaacctgaaaacatcatgctggtggacccagtaaggcagccttatcgagtaaaggtgatagacttcggtagcgctagccatgtgagtaaggccgtatgttccacttacctgcagagcagatattatagggcccctgagataattcttggactacctttttgtgaggccatcgatatgtggagtctcggatgcgtaatagccgaactgttcctggggtggccactctaccccggtgcctccgaatatgaccaaattcggtacatcagccagacgcaggggttgcctgctgagtacctgctctccgccggaactaagaccacgcgattctttaatagagacccaaacctaggctacccactctggaggttaaaaactcccgaggagcatgagctcgagaccggcatcaagagtaaagaggccagaaaatacatttttaattgcctcgatgatatggcgcaggtgaacatgtccaccgacttagagggaaccgacatgctggcagagaaggcggaccgtcgcgaatacatagacttgctgaaaaaaatgctcactatcgacgctgacaaacgcattacgcctttgaagaccttgaatcaccagttcgtaaccatgacccaccttctggactttccgcattccaatcacgtgaagagctgcttccagaacatggagatctgtaagagacgggtgcatatgtatgacaccgtgagccagattaaatcacctttcacaacacatgtggcacccaacacgtcgaccaacctgactatgtcatttagcaatcagcttaacacggtccacaaccaggcgtctgtcctggcctcttcctccaccgccgctgctgcaaccctgagcttggccaacagcgacgtgtccctgctgaattatcagtctgccctctacccctcctccgccgcacctgtgccaggggtggcccagcaaggcgtttctttgcaaccgggaacaacccagatctgtacacagacggatccttttcagcagactttcatagtgtgtccccctgcttttcaaaccggcctgcaagcaacaacaaagcatagcgggttccctgtgcggatggacaacgccgtccctatcgtcccccaggcacccgcagcacagccactgcagatccaatccggagtgctcactcagggctcttgtacccctctaatggttgccactctgcatcctcaggttgccacaataaccccccagtatgctgtgccttttacattgtcttgcgctgccggacggccagcccttgttgaacagactgctgcggtcctgcaggcctggcctggtgggacacagcagatcctcctcccatctacctggcagcaattacctggagtcgcactccacaactccgtccaacccacggccatgatacccgaggccatgggatctggtcagcagctcgcggattggcgcaacgctcattcacacgggaaccagtactcgacaattatgcagcagcccagtcttctcacaaatcacgtgaccctcgcgactgctcagccattgaacgtgggggtggctcacgtggtgagacaacagcagtcttccagtttaccgagcaagaagaacaagcagtctgcaccagtctcctcaaaaagttccctggacgtgctaccatcacaagtgtatagtctagtaggctcttctcccctgaggacaacctcatcctacaattcgctggtaccagttcaggatcagcaccagccgattatcattcctgacactcccagtccgccagttagcgtcattaccatccgctcggacaccgatgaggaagaagacaacaagtataagcctagcagcagcggactgaagcctaggtcgaacgttataagctacgtaacagtgaacgacagccccgattcagatagctcgctgagcagtccctacagtacagacactttgagcgctcttcgaggaaactccggtagcgtcctggaggggcctggccgtgtagttgctgacggaaccggaacgaggacaataattgtccccccacttaagacacagctgggggattgtacggtagctactcaggctagtgggcttctctctaataaaaccaagccagtggccagtgttagcggccagagctcaggctgctgcatcacaccaaccgggtatcgggctcaaagggggggtacttctgctgcccagccgttaaatctgtctcagaatcaacaatcctccgctgcccctacgtcccaggaacgaagctccaatcccgctcctcggaggcaacaggcattcgtcgctccgttaagtcaggccccatatacgtttcaacacgggtcacctctccactctactggtcacccccacttggccccagctcctgcccacctcccctcccaggcacacctgtatacctatgccgcacctacatccgccgctgcattgggctcgacttcaagtatcgcacatttgttctctccccagggttcatccagacacgcggctgcatacacgacgcatcctagcactctcgtccaccaggtacccgttagcgtgggcccatccctgttgacctccgcctcagttgcccctgcacaatatcaacatcaatttgcgactcagagctatattggctccagtcgcggttcaacaatttacactggctaccccctttcccccactaagatctcccagtatagctatctctag

SEQ ID NO: 30122 - DNA, 1071 bp, Artificial Sequence
  Description of Artificial Sequence: Synthetic coding sequence
atgacctcagttacacggtcggagatcatagatgaaaaaggaccagtgatgtcgaaaacacacgatcaccagctggaatcatcactgagccccgtggaagtattcgcgaaaacaagcgcctccctagagatgaatcagggtgtgtcagaggaacggatccacctcgggagcagtccaaagaagggcggtaactgcgacttgtctcaccaagaacgcctgcaaagtaagtctctgcatttgtcaccacaggaacagtctgccagctatcaggaccggaggcagtcttggaggagagcatcaatgaaagaaaccaatcgcaggaaaagcttgcaccccatccaccagggcattaccgagctgagtcggtcgatctccgttgatctggccgaaagtaagagactgggctgtttgctgttatcatccttccagttttcaattcagaaactggagccttttcttcgtgatactaagggcttcagcctggaatcatttagggccaaggcctcttccctgtcggaggagctaaagcacttcgcagacggcctggagaccgacgggactctacagaagtgctttgaggactctaatggaaaggcatccgactttagtttggaagctagtgtggcagagatgaaagaatacatcacaaagtttagtctggaaaggcagacctgggaccaactgctgctgcactaccagcaagaagctaaggagatcctgagtaggggtagtactgaggccaaaataacggaggtgaaggtcgaaccaatgacctacttggggtccagccagaacgaggtgctgaacacaaagcccgactatcagaagatcctgcaaaaccagtccaaagtttttgattgtatggaactggttatggacgagctgcaggggtcggtgaaacaactgcaggcctttatggatgaatccacccagtgtttccagaaggtctccgtccagctgggcaagcgctccatgcagcagctcgatccaagtcctgcccgtaagctcttaaaactgcagcttcagaacccacctgcaattcatggtagtggttccggcagttgtcaatag

SEQ ID NO: 30123 - DNA, 2748 bp, Artificial Sequence
  Description of Artificial Sequence: Synthetic coding sequence
atgcagggccctgacgcccctttactgctgtccgcaagggaactcggacccggaagacggggaagcgcgagctggtatcgacaggaaggaggtgccgtctgcaattggctgagaaagccccagccactggaacccaggacctcttttcccagtgccagacgctccgaatttagacccccacgcagactcccatgggcaggccctgcctcagcccagagcgaggaaggccacgctgggggtaggtgccaggcgggtagccccgctcccgctagacggctctctggtgcgtttaaaactttggtgcccggaacccacgctcagggggctagcgatacacaccccctgggccctccccatacccccgtcttggaccccagccctcaagatgggttccctgtgctttggaggggctccagcaaggcatctcacatgaatagactccgtaacgccaagatttatgtggagcgtgcagtgaagcagaaaaaaatattcactatccagggttgctaccctgtgatccgctgtcttctaaggcgccgtggctgggttgaaaagaagatggtgcatagatctggccctacattactgccgccacagaaagatttggacagctcggcgatgggcgacagcgatacaaccgaagatgaggatgaggacgaggatgaggagttccagccttcacagctctttgacttcgacgatctgctcaagttcgacgatcttgacggaacccatgcgttgatggttggactctgtctcaacctgagaaacctcccctggttcgacgaagtggacgcaaacagcttcttcccgagatgttattgccttggggcagaagatgacaagaaggcctttatcgaggacttctggctgacagccgcacggaacgtgttgaagttggtggtgaaatccgagtggaagagctatcccattcaggccgtggaagaggaagcctcgggagacaaacagcccaaaaaacaggagaagaatccggttctcgtgagtcctgagttcgttgacgaagcgctatgcgcctgcgaggaatacctgtccaatctggcccacatggacattgataaagatctcgaagcccctctttacctgacccccgagggctggagtcttttcctgcagagatactaccaggtggtgcacgagggggcagaactgcgacacctcgacacgcaggttcagagatgtgaagacatcctccagcagctccaggcggtagtacctcaaattgatatggagggcgacaggaacatctggatagtcaagccgggagccaagtcacgaggtcggggtattatgtgtatggaccacctcgaggagatgttgaagcttgttaatggtaatccagttgtgatgaaggatggaaagtgggtcgtgcagaaatacatcgagaggcctcttcttattttcggtacaaaattcgacctgcgccaatggtttttggtcactgattggaatccacttaccgtctggttctacagagactcctatatccggttctcgacccaaccatttagcctgaagaaccttgacaattccgtacatctgtgcaataatagtatacaaaaacatctggagaacagttgccatcggcaccccctgctgcctcctgacaatatgtggtcctctcaaaggtttcaagcccacttacaggagatgggtgcccctaacgcctggtctaccattatagttccaggcatgaaagatgcagtgatccatgcactacaaacttcccaagataccgtacagtgtaggaaagccagtttcgaactgtacggcgctgatttcgtgtttggggaagacttccagccctggctgattgaaatcaatgcctctcctacaatggccccaagcaccgcagtcaccgccagactgtgcgccggagtgcaggctgacacccttagggtggtcatcgatcgtatgctggacagaaattgcgacactggggcatttgaactcatttacaagcagccagccgtcgaggtccctcagtacgtcggcattagactgttagtggagggcttcaccattaaaaaaccaatggcgatgtgccatcggcgaatgggggttcgaccagccgtacccctgctgactcaacggggtagcggtgaagccagacatcactttcccagcttgcatacgaaggctcagttgccctcaccccatgttctccggcaccagggacaggttctccggcgacaacatagcaaactggtaggcacaaaggctctgtcgactacaggcaaagccctgcgaactctgccgacagcaaaagttttcattagtttgcccccaaatctcgattttaaagtggccccatccattctgaagccacggaaggccccagccttactgtgcctcagagggccacagctggaggttccctgttgtctgtgtccgcttaagagtgaacaatttctggccccagtggggaggtcgcgtcctaaggccaacagcagacccgactgtgacaaacctagggcagaagcttgccctatgaagagactgtcccccttgaagccacttcccttggtcggtactttccagaggcggagagggttgggggatatgaagttgggtaagcctctgctccggttccccaccgcactcgtcttggacccgacacctaataagaaaaagcaggttaaatatcttggacttgactcgatagctgtggggggttccagagtagacggggcacggccttgtactcccggatctactgccagggcctag

SEQ ID NO: 30124 - DNA, 2463 bp, Artificial Sequence
  Description of Artificial Sequence: Synthetic coding sequence
atgcggatctcttcatgcagcgatgagtccagtaatagcaatagttctcggaaaagcgacaaccacagcccggcagtagttaccacaacagtttcaagtaaaaagcagcccagcgtgctggttacattccccaaagaggagcggaagagcgtgagcggaaaggcatctatcaaactgtctgagactattagcgaaggaacaagcaattccctctctacatgcaccaagagcggcccaagccccctttccagccccaatgggaagctgactgtcgcctctccaaagaggggccagaagcgtgaggagggttggaaggaagtggtcagaagatcaaagaaagtatccgtgccctcaactgtcattagtcgggtcattggcagggggggttgtaacatcaacgcgattcgcgaattcaccggagcccacatcgacatcgacaagcagaaggataagaccggagatcggatcataactatcagaggcggaacggagtccacccgccaggcgacccagctgataaatgctctgattaaggatcctgacaaagagattgatgaattgatccctaagaacaggctgaaatccagctcagctaactcaaagatagggtcatcagctccaacaaccaccgctgctaacacatccctgatgggcatcaagatgacaactgtggccttgtccagcacatcccaaacagcaaccgctctgactgtaccggcaatttcctccgcaagcactcacaagaccattaagaaccccgttaacaatgttaggccaggcttcccagtgtccttgccgctcgcttaccctccacctcagtttgctcacgcattactcgctgcacagactttccagcaaatcagacctcctcgactgcctatgactcactttggaggcacatttccaccagcacagtccacttgggggcctttcccggttcgccctttatcacccgcaagggccacaaattccccgaaaccccacatggtcccccgacatagcaaccaaaactcaagcggatcccaggtcaacagtgctggtagcctcacttcctctccaacaacaacaacttcgtcctcagcaagcaccgttcccggaacctcaaccaacggcagcccctcttcgccaagcgtgagacggcaactgttcgtcaccgtggtgaaaacgtccaacgctactacaacaacggtgaccactacagcctcaaataacaacacggcccctactaacgcaacttaccccatgccaactgctaaggagcactaccctgtgagctcgccctcaagtccctcaccaccagcccagccgggaggagtctctcggaacagccctctggactgtggcagcgcctctcccaataaagtagcttcttcatctgagcaggaggccggttctcctccagtggtcgaaaccaccaacaccaggcctccgaactcatctagttcatctggatcatcaagcgcacactccaaccagcaacaaccccctggctctgtatctcaggagccacgtcctcccctccaacaatctcaggttcccccacctgaagttagaatgactgtcccccctcttgctactagcagtgcacccgtggctgtcccaagcactgccccagtcacctacccaatgcctcagacccctatgggctgtccccaaccaactcccaaaatggaaacgcccgctatcaggccccctccccacggaaccaccgcacctcataaaaattccgcttccgtgcaaaactcctcagtagccgtgctgagcgtgaaccacattaagcgacctcattctgtaccatcttccgtccagctgcctagtaccctgagcacacagtccgcgtgccaaaacagtgtgcatcctgccaataagccaatcgcccctaactttagtgccccactgccctttgggccattttcaacactgtttgagaacagtcctacttcggcccatgccttttgggggggatcggtggtgagcagtcagtcaacccccgaaagtatgttaagcggaaagtcttcctatcttcctaacagcgatccactgcaccagtctgatacctccaaagcaccaggcttcaggccccctctccagcgtcctgctccatctccttctgggatcgtgaatatggactccccctatggaagcgttacaccctctagcacccacctgggtaattttgcctctaacatttcagggggacagatgtacggcccaggtgcacctctgggtggcgcacccgcagccgcaaattttaaccgacagcacttctctccccttagtttgttgaccccatgctcttcagcctcaaatgatagcagtgcccagagcgtttcttccggggtgcgcgcacccagcccagcaccctcgtctgtgccgcttgggtcggagaagccctcaaatgtgagccaggatatcgtagcatctggacccctcaaaggcctcgttgctatcaagacgaagtag

SEQ ID NO: 30125 - DNA, 6032 bp, Artificial Sequence
  Description of Artificial Sequence: Synthetic coding sequence
atggagaaagctacagtgccagttgctgctgcaaccgcggctgagggggaagggtcgcccccagctgtcgcagccgtggcgggaccgcctgcagcagccgaagtcgggggaggagttggcggttcctcgcgagcacgtagtgcatctagccctcgagggatggtgcgtgtctgcgaccttttattgaaaaagaagcccccacaacagcagcatcacaaagcaaaacgcaaccggacatgtaggcccccatcctcatccgaaagtagcagcgattccgacaactctggaggcggtggaggcggaggcggtggcggtggaggcggtggcggtacatcctcaaacaacagtgaggaggaagaggacgatgatgacgaggaagaggaggtgtcagaggtcgagtcgtttatcttagaccaggacgatctagagaaccctatgttggaaactgcttccaaactgcttttaagtggcaccgctgatggggcagatttacgaaccgttgatccggagacacaagccaggctcgaggccctcctagaggccgcagggattggaaaactgagcaccgccgacggtaaagcatttgctgatccagaagtgctgcggcgactgacctctagcgtcagttgtgccctggacgaggcagccgcagccctcactcgcatgagagcagaatccactgcaaacgcaggacagtccgataaccgttcactagcagaggcttgcagcgaaggtgacgtgaatgccgttagaaagctgttgatagaaggcaggtccgtgaacgaacacaccgaagagggggaatctctgctttgtctggcgtgctctgccggatactacgaactggctcaggttcttcttgccatgcacgcaaacgtggaggaccgcggaattaagggtgacattaccccgctcatggccgcagccaatgggggacacgttaaaatagtcaaactgctgcttgcccataaagctgacgtcaacgcccagagctcaaccggcaataccgctcttacatatgcctgcgccggagggtatgtggacgtggttaaagtgcttctggagtcaggagcctctatcgaggaccacaacgaaaacggacacaccccgctcatggaagctggctctgctggccatgtggaggtggcccgattgctcttggaaaatggtgcgggaattaacactcacagtaacgagtttaaagaaagcgctctaactctcgcctgttataagggccatctggaaatggtgcgatttctgctggaggcaggcgctgaccaagaacacaagacagatgaaatgcacacggcgctcatggaagcgtgtatggatggacatgttgaagtcgctaggttactgcttgatagcggagcccaggtgaacatgccagctgattcctttgagtctcctctgactctggccgcttgcggaggacatgtggagcttgctgccctgctcattgagcgaggtgctagcctcgaggaggttaacgatgagggctacaccccactcatggaggcagctagagaggggcatgaggagatggttgctctcctgctggggcagggtgctaacattaatgcccagactgaagagacacaggagactgctctgaccctggcctgctgtggagggtttctggaggtagccgatttcctaattaaagccggtgcggatattgaactgggatgctctacacctcttatggaagctgcacaggagggccacctagaactcgtgaaatacctgctcgccgcaggggcaaacgtacacgcaacgacagctacgggagacactgcactcacctacgcctgcgagaacggtcatactgatgtggcggacgtcctgttgcaggccggagccgatcttgaacatgagagcgaaggtggacggacacccttaatgaaagcagcgagagccggacacgtgtgcacagtgcagttcctcatcagtaaaggtgcgaatgtgaaccgaacgacagcaaataatgaccacaccgtgctgtccctggcctgcgctggcggacatcttgccgtcgttgagcttctattggcccatggcgctgatccaacccatagactgaaggacggttccactatgctaattgaggccgctaagggaggtcataccagcgtggtatgttatttgttggattacccaaataacttgctgtccgccccaccaccagatgtgactcagctgacccctccttcccatgaccttaaccgggcaccgagggtgccagttcaggcccttcccatggtggttccgcctcaagagccagataaacctcctgctaatgtggcaaccacattgccaattcgcaacaaggctgctagcaagcagaaaagctctagtcaccttcccgctaattctcaagacgtgcaggggtatatcaccaaccagtctccagaaagtatcgtggaggaggctcagggcaagcttacagagttagagcaacgcataaaggaggcaatcgagaaaaatgcgcagctacaaagcctcgaactagctcacgccgatcaactgactaaggagaagattgaagaacttaacaagacccgggaggagcagatccagaagaaacagaaaatcctggaagagcttcagaaggttgaaagagagttgcagctcaaaacacagcaacaacttaaaaaacagtatctcgaagttaaagcccagagaatccagctacagcaacagcagcagcaaagctgtcagcacctaggattgctgacccctgtgggagtcggcgagcagcttagcgagggcgactatgcacgtctgcagcaggttgaccctgtgctgcttaaggatgagcctcaacagaccgctgctcagatggggtttgcaccgattcagcctttggctatgcctcaagccttgccactggcagctgggcctctgccacccggttctattgccaatctcaccgagctgcaagtcctgtcatcgttgctacaaccctgcttccttagtaccttgcctctcatccttatgcaccgccttagagtaatcatgaccagacctaagtcatcttctacctctgaatctggcgattccgacaatatgaggataagctcttgcagtgacgaaagcagcaatagcaattcatccagaaagtcagacaaccattcacccgctgtggttactaccacagtgtccagcaaaaagcagcctagcgtgcttgtcaccttccctaaggaagaaaggaaatcggtgagcggtaaggcaagtatcaaactatctgagacgataagcgaggggaccagcaacagcttgtcaacatgtacgaaaagtggtccttcccccctctctagcccaaatggaaagttaacagtggcaagtcccaagagggggcagaagcgggaagaaggctggaaagaagtcgtgcgcaggtcaaagaaagtgtccgtgccctcaaccgttatttccagagtaatcggtcgcggaggttgtaatatcaacgcaatccgtgaattcaccggggcacatattgacatagataaacagaaggacaaaactggagacaggataatcaccattcggggaggcacagagtctacaagacaggccacccagctcattaatgcattaataaaggaccccgataaagaaatagatgagctgatcccaaaaaatcgtctgaagtccagctccgccaatagtaagattggctctagcgcccctacaaccaccgctgccaacacaagcctaatgggcattaagatgaccactgtcgctttgtcatcaacttctcagaccgccaccgctctgaccgttcccgcaatatcttccgcctcgacccataaaaccataaaaaacccagtgaacaacgtccgaccaggatttcccgtgtcacttccgcttgcctatcctccccctcagttcgctcacgccttactagccgcacagacattccagcagatcaggcctccaaggctgcccatgacacatttcgggggaacttttcccccagctcagagcacctgggggccattccccgtccgcccactgtctccagcgagggctacgaactctcccaagccacatatggtcccccgacattcgaatcagaacagctctggctcccaggtgaattccgcagggtcactcacctcctcccccacaacaactacatctagctccgcctctacagttcctgggacgtcaacaaacggctccccgtctagtccttcagtccggaggcagctcttcgtgaccgttgtgaagaccagcaacgccactactaccactgtgacaaccacagcaagtaacaataataccgctccgaccaacgccacctaccctatgcccaccgccaaggagcactatccagtctcctcaccgtctagtccttcaccaccagcgcagccaggcggagtcagccgaaactcacccctggactgcgggagcgccagtccgaacaaggtggcgagttcctctgaacaggaggcgggttcccctcctgttgtggagaccacaaacacaagacccccaaactccagcagcagttcagggtcaagcagtgcacattcgaatcaacaacagcctcccggttctgtttcacaggagcctagaccacccctgcagcaaagccaggtgcctcctccggaagttcgaatgacggttccccctctagcaacttcctccgccccagtggccgtccctagtaccgctcccgttacctaccctatgccacagacacccatgggctgccctcagcccacaccgaaaatggagacgccagccatccgtcctccacctcacggtaccacggcacctcataagaacagcgcttcagtccagaactctagtgttgctgtgcttagcgttaatcatatcaagcggcctcacagcgtgccaagctcagtgcagctgccgagtactttgagtactcagagtgcctgtcagaacagtgtccaccctgcgaataaaccaattgcacccaatttcagtgcgccactgccattcggtcccttcagcacgctgttcgagaacagcccaaccagcgcccacgctttttggggcggatcagttgtgagcagccagagcactccggagagcatgctctccggaaagagttcctacctcccaaatagtgatccgctgcaccagagtgacacttccaaggcaccgggatttaggcctcctctgcagcgtcctgctcccagcccctcaggaatcgtgaacatggactccccttacgggtccgtgactccaagcagtactcatctgggcaatttcgcctcgaacatttccggcggacaaatgtacgggcctggcgcaccattggggggtgcacccgcagcggcaaacttcaataggcagcatttcagtccgttaagcctgctaacaccatgttcatcggcttcaaatgattcttccgctcagtcagtgtcaagcggcgtgcgcgcacctagccctgcaccatcttccgtacctctcggttccgaaaaaccaagcaatgtgtcccaagaccggaaagtgcccgtgccaatcggcactgagagatccgctaggataagacaaacgggcacaagtgcaccaagcgtgatcggcagcaatttatctaccagcgtcggacatagtggcatttggagctttgagggcattgggggaaatcaagacaaggtggattggtgcaaccctggtatggggaatcctatgattcatcgacctatgagtgatcccggtgtgtttagtcagcaccaggcaatggaacgggattctactggcatcgtgactccgtcagggacatttcatcagcacgtccctgccggatatatggactttcccaaggtcggcggtatgcccttctctgtgtatggaaacgccatgatcccccctgtggcccctatacccgatggagcaggaggcccaatttttaacggccctcacgctgccgatccttcatggaactctctcattaagatggtatcctccagcaccgagaataatggaccacaaactgtttggacagggccttgggccccacatatgaattctgttcatatgaaccagctggggta

SEQ ID NO: 30126 - DNA, 1446 bp, Artificial Sequence
  Description of Artificial Sequence: Synthetic coding sequence
atggccagtgcagcctccgttactagtttagccgatgaggtcaactgtcccatttgccagggaaccctccgcgaaccggttacgattgactgcggacataacttctgtagggcttgcctcacccgctattgcgagattcccggacccgatctggaagagagcccaacctgcccattatgtaaggagcctttccgtcctgggtcttttagaccgaactggcagctcgcgaacgtggtcgaaaacatcgaaaggctgcagttggtctctacgctgggccttggggaggaggacgtttgccaggaacatggcgaaaagatctattttttttgcgaggacgacgagatgcagctgtgtgtcgtatgtcgagaagctggtgagcatgctacacatacgatgagatttctggaggatgcagccgctccttaccgcgagcagatccataaatgcctgaagtgcttaagaaaggaacgggaggaaatccaggagattcagagtagggagaacaaacgtatgcaagtgttgctgacacaagtcagtactaaaagacagcaggtgattagcgagtttgcacatctcagaaagtttctggaggaacagcagtctatcttgctggcccagctagagtcacaggatggagacatcctccggcagagggacgagtttgacctgttggtggccggtgaaatctgcagattctccgcccttatcgaagagcttgaggaaaagaatgaaaggccagcccgtgaactcctcacagacattaggtcaacactgatccgctgcgagacacgaaaatgcaggaagcctgtcgccgtgtcgcccgagctgggccagcggattagggacttcccgcagcaggcgctacccctgcaacgagaaatgaagatgttcctggaaaaactgtgtttcgaactcgactacgagcctgcccatattagtttagacccccaaactagccacccgaagctgctgctgtctgaagatcaccagagggcacagttctcttacaaatggcaaaatagtcccgacaatccacaacggttcgatagggctacatgcgttctggcccataccggcatcacgggaggaagacatacgtgggttgtgtctatcgatctagcacatgggggatcctgcacagtcggcgttgtaagtgaggacgtgcagagaaaaggcgaactgcgtctcaggccagaagaaggggtctgggccgtaaggcttgcctggggtttcgtgtctgccctcggatcattccctacgcgtttaactctcaaagagcagccccgacaggtgcgtgtgagcctggactacgaggttggctgggtgaccttcacgaatgccgttacccgggaacctatatatacattcaccgcttcttttacccggaaagtgatcccattctttggcctttggggcaggggttccagcttcagcctttcctcctag

SEQ ID NO: 30127 - DNA, 1566 bp, Artificial Sequence
  Description of Artificial Sequence: Synthetic coding sequence
atgccttctccccaactccttgtgctgtttggctctcagaccggaacagcacaggacgtatctgagaggttggggagagaagctcggagacgcagactggggtgccgagttcaagctcttgatagttatcccgtcgtgaatctcatcaatgaacccctcgtgatcttcgtgtgcgctacaacgggtcaaggtgatccccctgataatatgaagaatttctggaggtttatctttcgaaagaatctcccttccaccgcgttatgccagatggactttgcagtcctggggctgggggactccagctacgcaaagttcaattttgttgcaaaaaagctacacagaagacttcttcagctgggcggaagcgcattacttccagtttgcctcggagatgatcagcatgaactgggcttgccaagcaagtttacccttctgtttctgcaagaagctccttctaccggatctgaagggcagagagttgcacaccccggtagccaggagcctccctcagagagcaagccattcctggccccaatgatcagtaatcagcgggtgactggcccttctcatttccaagatgtgcggctcatagagtttgatatcctagggagtgggatctcctttgctgcaggcgatgtcgtgcttatccagccgtcgaatagcgccgctcatgtccagagattctgtcaggtcttgggtctagaccccgaccagttgtttatgctgcagcctagggaacctgatgtgtcctctccaacacggctgccacagccttgctccatgcgccacctggtgagccattatctggacatcgccagcgtgccaaggaggtcttttttcgaactactcgcatgcctcagtttgcacgaactggagcgagagaagcttctggagttttcctcggcgcagggccaggaagagctgtttgagtactgcaaccggcctagacgcacaattttggaagtcctgtgtgatttccctcacacagctgccgctattccgcctgactacttgctggacctgattcccgttattcgaccacgggcattcagcatcgcctctagtcttctcacccaccctagccgcttgcagatccttgtggctgtggtgcagttccagaccagactgaaggaaccaagacgagggctgtgctcatcctggctggcatctcttgaccccggacaaggccctgtacgggtgcccctatgggtgaggcccggatctctcgctttccctgaaacccccgacacccccgttattatggtgggcccaggcaccggcgtcgcacccttccgtgccgcaatccaggagcgcgttgctcagggacagacgggcaattttcttttttttggttgcaggtggcgagaccaggatttttattgggaggccgagtggcaagaactggagaagagggactgcctgaccctaattcctgctttcagccgggagcaggagcagaaggtgtacgtgcaacataggctacgagagttggggtcactggtgtgggagttattagacagacaggctacgccttcaccctgccagcgtacctcccgcaagccttag

SEQ ID NO: 30128 - DNA, 753 bp, Artificial Sequence
  Description of Artificial Sequence: Synthetic coding sequence
tgacagccgagtcccgtggagccgagaggcccattctacttctgtaggctgcttctcgatgacctgggtatgaattcctgggaccggcgtaaaaacttccatctgctgaagaagaacagcaagttgcttcgcgaattaaaaaatctggactcaagacagtgccgagaaacacacaagattgcagtgttctatatcgccgaagggcaggaagataagtgtagtattttgtccaacgagcgagggagtcaggcttacgaagattttgtcgccggactaggatgggaggtggacctgtcaactcattgtggatttatgggcggtctgcagcgcaacggctctacgggtcagaccgccccttactatgccaccagcacagtggaagttatcttccatgtttcaacaaggatgccctccgattccgacgacagcctaaccaagaagctcagacatttgggtaatgacgaggtgcatattgtgtggtccgaacactccagagactatcgtcggggaattatacctactgcattcggtgatgtgtccatcattatctaccctatgaagaatcacatgttctttatcgcaatcaccaaaaagccggaagtccccttcttcggcccactgtttgacggggctatcgtctccggcaaattgctgccaagccttgtctgcgccacgtgcattaatgcttcgcgggctgttaaatgtctgattccgctgtatcaaagtctttacctgtttgcgctgaacgtttag

SEQ ID NO: 30129 - DNA, 345 bp, Artificial Sequence
  Description of Artificial Sequence: Synthetic coding sequence
atggtcttaattctggggagaagactgaaccgcgaggatctcggcgtgagagactctcctgccaccaagcggaaagttttcgagatggatcccaagagcctgacaggccacgaattctttgacttctcaagcggctcctcccatgccgagaacattctgcagatcttcaatgagttccgtgactctcgattattcactgacgtcatcatctgcgtcgaggggaaggagttcccatgtcacagggccgtcctgtcggcttgttccagctactttcgggcaatgttctgcaacgatcaccgcgaaagtcgggagatgttagtcgagattaatggcattctggcttag

SEQ ID NO: 30130 - DNA, 1830 bp, Artificial Sequence
  Description of Artificial Sequence: Synthetic coding sequence
atggctagccttagtcgagcacttagagttgctgctgcacaccctagacagtcccctacgcgtggtatggggccatgcaacctgtcctctgcagccggtcccactgctgaaaaatcggtcccgtaccaacgtacgctcaaagagggacagggcaccagcgtcgtggcacagggaccatcgcgccctctgccatccacagcaaacgtcgtggtaattggcggaggcagtctaggatgtcagacactgtaccatttagcaaagctgggcatgtcaggcgctgtacttctagagcgggagcgcctgacaagcgggaccacttggcacacagcagggttactctggcagcttcgacctagcgacgtcgaggttgagctgcttgcccatactcggagggtggtaagccgagagttggaggaggagacaggactccacacgggctggattcagaatggagggctgttcattgccagtaatcgccagcgtctggatgaatataagagactgatgtcactcgggaaggcgtacggagtggaaagccacgtcctgtccccggctgaaaccaaaaccctgtaccccctgatgaatgttgacgacttgtacggcaccctgtatgtcccccatgatggtaccatggatccagctggtacctgcaccactttggcacgcgcagcctcggcccgaggagcccaggtcatagagaattgtcctgtgaccggtatacgcgtgtggaccgacgactttggtgtccgaagggtcgcaggcgtagagactcaacacgggtcaattcagaccccttgtgttgtgaactgtgcaggggtctgggcctccgcagtgggaagaatggccggagtcaaagtgcctttggtcgctatgcaccatgcttacgtggtgacagaacgcattgaaggcatccagaatatgccaaatgtgagagaccatgatgcatctgtgtacttgcggttacagggcgacgcacttagtgtcggaggatacgaagccaatccaatcttttgggaggaggtatcggataaatttgccttcggcctgttcgatctggattgggaagttttcacacagcacatcgaaggggcaataaacagggtgcccgtgctggaaaagactggaattaagtctaccgtgtgcgggcctgaatctttcacaccagaccataagcctctgatgggtgaggctcctgagctgcgaggcttcttcctgggctgtgggttcaacagcgcaggcatgatgctgggcggaggttgcggacaggaactggcacactggatcatccacgggaggccagagaaggacatgcacggctatgacatccggaggtttcaccacagtctgaccgaccatccaaggtggataagggagcgatcccatgaatcttacgctaaaaattactctgttgttttccctcacgatgagccattagccggaaggaacatgagaagggaccccttgcacgaggagttactgggtcagggatgcgtctttcaagagcgtcacggctgggagcggcctggatggttccatcccagaggacctgcccctgtgctcgagtatgactactacggcgcatacggatctcgggcacatgaggattacgcttaccggagactcctagctgatgagtacacctttgctttccctccacaccatgatacaatcaagaaggagtgtcttgcttgccggggagcagccgctgttttcgatatgtcttactttggcaagttttacctggttggcctcgatgccagaaaggccgctgattggctgttttctgccgatgtgtcacggcctcccggattacaccgggtgcatgtatag

SEQ ID NO: 30131 - DNA, 129 bp, Artificial Sequence
  Description of Artificial Sequence: Synthetic coding sequence
atggataatatgagccctagactccgcgcttttctgtccgaacccatcggcgagaaagatgtgtgttgggttgacggcatctcccacgagcttgccattaacttggtcaccaaggggataaacaagtag

SEQ ID NO: 30132 - DNA, 3120 bp, Artificial Sequence
  Description of Artificial Sequence: Synthetic coding sequence
atggtttcatcggctcaaatgggttttaaccttcaggccctcctcgagcagctgtcccaggatgagctgagcaagtttaagtatctgattactaccttttccctggcccacgagctccagaagattccacacaaggaaatggcaagcttgcaggtattcgagaaaatgcacagaatggacctgtccgaaagagcaaaagacgaagtgcgtgaggcagctttgaaaagtttcaataagaggaagcctctcagcctgggtatcacacggaaagaacgccctcccttagatgtggatgagatgctggagcgctttaaaacggaggcccaggcgttcaccgagaccaaaggaaatgtgatatgtctcgggaaggaggtatttaaggggaaaaaacccgacaaagacaatcgctgcagatacatcctaaagacaaagtttagggaaatgtggaagtcatggcccggagactccaaagaggtccaggtgatggcagaacggtacaaaatgttaatccccttttcgaatccgagggttctccccggacctttttcatatacggtcgtgctgtacggcccagccggtcttgggaagaccaccttggcccagaaacttatgctagattgggctgaggataatctgatccataagttcaaatacgcattctacttgtcttgcagggaactgtctcgactgggtccttgttcttttgcggaactggtgttcagagactggcccgagctgcaagacgatatcccacacatcctggctcaggctcggaagatattgtttgtgatagacggctttgatgagctgggtgctgcccctggagcattaattgaagatatttgcggtgactgggagaaaaaaaagcctgtgcctgtgctgttggggagcctgctaaaccgcgttatgctccccaaagcagccttactggtgaccacacgaccaagagcccttagggatcttagaatactggcggaggaacccatttacattcgtgttgaaggcttcctggaggaggacaggcgcgcatatttcctgcgtcattttggggatgaggatcaagctatgagagctttcgagctcatgagaagcaatgcagccctgttccagctgggcagcgccccagcggtttgctggatcgtctgtacaactttgaaacttcagatggagaagggggaggaccctgttcctacttgtctgaccaggaccggccttttcctccggttcctttgtagtcgattcccccagggcgctcagctccgaggggcattgaggactttatccctgctggccgcacaagggctttgggcacagacatcagtactccaccgagaggacctcgaacgccttggcgttcaggagagcgacctaaggctgttcctggatggggacatcctgcgacaggaccgggtgtccaaagggtgttactcattcatccatctcagttttcaacaattcctcacagcactattttacaccctggagaaagaagaggaagaggacagggacggccacacctgggatattggtgatgtgcaaaagctccttagcggagtggagagattgagaaacccggatctcatacaagcaggctattacagctttgggctcgcaaatgagaagagagcaaaggaacttgaggcaacatttggatgccgcatgagtcccgacatcaaacaagaactgctacggtgcgacatttcatgcaaaggcggacacagtaccgtcacagacctgcaggagctgttagggtgcctttacgaaagtcaggaagaagagttagtaaaggaagtcatggctcagtttaaagaaatcagcttgcacttaaacgccgtcgacgttgtgccttcctctttttgcgtcaagcactgccggaatctgcagaaaatgtccttgcaagtgattaaggagaacctgccagagaatgtgacggccagtgagtccgatgcagaggtagaaaggtcacaagatgatcaacacatgctccccttctggacagacttatgctccatttttggcagcaacaaagatctgatgggactcgctataaacgattcctttttatccgcctcactagtccggattctgtgcgaacagatcgcaagtgacacatgccacctgcagcgggttgtgttcaagaatatatctcccgcagatgctcaccgcaatctgtgcctggccctgagaggacacaagaccgttacctatctcacactccaggggaatgatcaggatgatatgttccccgcattgtgcgaggttcttcgccacccagaatgcaacctccgatatttgggcctagtgtcctgtagtgctaccactcagcaatgggctgacttgtcactggctctggaagttaaccagagtttgacatgtgtgaacttaagtgataacgagctactcgacgagggggctaaactcctctacaccacactcagacaccctaaatgcttcctgcaacgcttgagccttgagaactgtcatttaacggaagcaaactgcaaggacctcgccgctgttttagtagtgtctcgcgagctgacgcacttatgcttggctaaaaatcctattggcaatactggtgtgaaattcctttgtgagggattacggtatcctgaatgcaaactgcagacgctggtactctggaattgcgatatcacttccgatggatgctgtgacttgaccaagttgctccaggagaaatcaagccttttatgtctcgatctgggacttaaccatatcggcgttaaaggaatgaagttcctgtgcgaagccctgcgaaagcccctttgtaacctaaggtgcctctggttatggggatgttccattccaccattttcttgcgaagacttgtgctctgctttgagttgtaaccagagtctagttacccttgatttggggcagaatccgcttgggtctagcggcgtcaaaatgctgtttgagacgttgacctgcagttcaggaaccttaaggaccttacgtctcaagatcgatgatttcaacgacgagttgaacaaacttctagaggagatcgaggagaagaacccacaactgattatagacaccgagaagcatcacccatgggccgagaggccgtcgtcgcacgactttatgatttag

SEQ ID NO: 30133 - DNA, 1899 bp, Artificial Sequence
  Description of Artificial Sequence: Synthetic coding sequence
atggacaccatgatgttgaatgtacgcaacttgttcgagcagctcgtcagaagggtagagatactcagtgaaggaaacgaggtacagtttatacaactagccaaggatttcgaagacttcaggaagaagtggcagcgtactgatcatgaactcggtaaatataaggatcttctaatgaaagcagagaccgagagaagcgccctcgacgtcaagctgaagcacgcacgcaatcaggtggacgtggagattaaaaggagacagcgagccgaggctgattgcgagaaactggaacgacaaattcagctgattagagagatgctaatgtgcgacacgagcggatccattcagctgtccgaagaacagaaaagtgcactggcttttcttaatcgtggacaacctagctcttctaacgcgggaaataaacgcctctctacaatcgatgaatccggctctatcctgtcggatattagctttgacaagactgatgagagcctggattgggattcttctctcgtgaaaaccttcaagctaaaaaagcgcgagaaacgtcgaagcacttcacgtcagttcgtggacggccctcctggtccagttaagaaaaccagaagcattggctccgctgtcgaccaggggaacgaatctattgtcgccaagacaacggtcacagttcccaatgatgggggacctatcgaggctgttagtactatcgagacagtcccctattggacgcgttcacgcagaaagacgggcacactgcagccctggaattctgacagcaccctgaatagcagacagttggaaccccgaacagagaccgactccgtcggcacaccacagagcaacggagggatgcgcttgcatgattttgtgagcaagaccgtgatcaaaccggagtcttgtgtcccatgcggcaaacggatcaaattcggaaaactctcgctcaaatgtcgggactgccgagttgtgtctcaccctgagtgtcgagaccgctgcccattgccatgtattccaactctgattggtactcctgtcaaaatcggagagggaatgctggctgactttgtgtcacagacttcccccatgattccaagtatcgtggtgcactgtgtgaacgaaattgaacagagaggactgactgaaacggggctgtatcgcatttccggctgtgatcgtacagtgaaggagctgaaagagaagttccttagggtgaagaccgtaccactcctgagcaaggtggatgatattcacgccatctgtagtctattaaaggacttcctgcgtaacctaaaggaacctctgctgactttccgccttaaccgagcttttatggaggcagccgagatcaccgacgaagacaattctatcgcagcaatgtatcaggccgttggtgaattaccacaggccaaccgggatactttggcgtttctgatgatacatctgcagcgggtcgcacagtctcctcacacgaaaatggacgtagctaatctcgccaaagtatttgggccaacgatcgtggcccacgccgtacctaatcccgaccccgtgaccatgttgcaggatataaagaggcagcccaaggttgtggagagactgctgtctctcccactcgagtattggtcacagtttatgatggttgaacaggagaacatcgaccccctccatgttatagaaaactccaatgccttctctacccctcagacccctgatattaaggtatctcttctgggcccagtaactacgcccgagcatcagctgttaaaaaccccaagctcaagctccttatcacagcgggtccgctccacactgacaaagaacaccccgaggtttggctccaagagcaagtctgccacgaacctgggtcgccagggcaacttctttgctagtcccatgctgaagtag

SEQ ID NO: 30134 - DNA, 189 bp, Artificial Sequence
  Description of Artificial Sequence: Synthetic coding sequence
atgtccatatcctctgatgaggtgaattttttggtctacaggtatctccaggagagtggcttcagccatagcgcattcacgtttggcatagagtctcatatttctcagtctaatataaacggcgcacttgtacccccagccgctctcatcagcatcatacagaagggtctgcagtacgtagaggcctag

SEQ ID NO: 30135 - DNA, 417 bp, Artificial Sequence
  Description of Artificial Sequence: Synthetic coding sequence
atggagcccagcgcacagcagctacagctagccgcatctctgcctgccaatctatctaatttctgccaaggatctgagatgccgacaacgtcacgcccagcactcgacgtcaaagggggtacatcccctgcaaaggaggatgccaatcaggagatgagctccgtggcgtacagtaaccttgcggtaaaagacagaaaggctgtggccatcctgcattacccaggtgtcgcctcgaacggcactaaggcatccggagccccaactagcagttccggttcgccaatcggaagccccaccactactccccctacaaaaccaccttctttcaatctccatcctgccccacacctgctggcctcaatgcacctccagaagttgaattcccaataccaaggaatggccgcagccactccatag

SEQ ID NO: 30136 - DNA, 1473 bp, Artificial Sequence
  Description of Artificial Sequence: Synthetic coding sequence
atgaacggcgctctggaccattccgatcagccggatccagatgccatcaagatgttcgtcgggcagatcccccgatcttggagcgaaaaggagctgaaggaattgttcgagccctacggagctgtgtatcagatcaacgttttgagagacaggtcccagaacccccctcagtctaagggctgctgttttgtgacgttttacaccagaaaagccgcactcgaagcacaaaacgcactgcataatataaagacccttccaggaatgcaccaccctattcagatgaaaccagcagactctgaaaaaagcaatgccgtggaggatagaaagctcttcatcggcatggtttctaagaaatgtaatgaaaatgatatccgcgtcatgttcagcccattcggacagattgaagagtgccgtatcttgagggggcctgacggcttgtccagaggatgtgccttcgtgaccttcagtacacgtgcgatggctcagaacgccattaaggcaatgcaccaatcacaaaccatggaaggatgcagttcaccgatcgtagttaaatttgctgacactcagaaagacaaagagcaaaggaggctgcagcagcaattagcccagcagatgcagcagctcaacactgccacatggggaaatctcacggggcttggagggctgaccccccagtatttagccctcttacagcaggccaccagctcttccaaccttggtgcgttttcaggcatacaacagatggctgggatgaacgctctgcagttgcagaatctcgctaccctcgcagctgcggctgctgcggcacagactagtgcaacaagtaccaatgcgaatccactgtctaccacctcaagtgccctgggagccctcaccagccccgtcgcagccagtaccccaaacagcacggccggagccgctatgaactcactgacttccttaggaacacttcaaggcctggccggtgcgactgtcggacttaataatataaatgctcttgcggttgcccagatgctttcaggcatggccgctctcaacggcggattaggggctaccggcctgacgaatggcacggcgggaaccatggatgctctgacgcaagcatactctggaattcaacagtacgcagctgcagcactgcccacgctgtattcccagtcacttcttcagcagcagtcagcggcaggatctcagaaggaagggccagagggcgcaaatctgttcatctaccacctcccacaggagtttggggaccaggacatactgcagatgttcatgcctttcggtaacgtgatctcagccaaggtgttcatcgacaaacaaacgaatctgagcaagtgtttcggctttgtgtcctatgataatcccgtatcggcccaggcagccatccaggctatgaacggcttccaaattggtatgaagagactcaaggtccaactgaaaaggagcaagaacgattctaaaccttactag

SEQ ID NO: 30137 - DNA, 357 bp, Artificial Sequence
  Description of Artificial Sequence: Synthetic coding sequence
atggccagttcggccagagagcacctcttgtttgtgagaagaaggaacccccaaatgcggtatacgctgagtccggagaatttgcagtctctcgctgctcaatctagcatgccagaaaatatgacgctgcagcgggcaaatagtgacaccgacttagttacgagcgagtcgcgttcatctttgactgctagtatgtatgagtacacactgggccaggctcaaaatctcattatcttctgggatattaaggaagaggttgatccatctgattggattggcctgtaccacatcgacgaaaattcccctgcgaatttctgggactcgaaaaaccgaggagttactggcacccagaaatag

SEQ ID NO: 30138 - DNA, 1620 bp, Artificial Sequence
  Description of Artificial Sequence: Synthetic coding sequence
atggccactagtgctccactgcggagcctggaagaggaggtcacatgcagtatctgcctcgactatttgcgcgatcccgtcaccatcgactgcggccacgtgttttgcagaagttgcaccacggacgtgcggccaatttccggatcccgccctgtctgcccactgtgcaagaaacccttcaagaaggagaatatccgcccagtgtggcagctggcttcacttgtggaaaacatcgaaagactcaaggttgacaaggggcgacagccgggagaagtgaccagagaacaacaggacgctaaactgtgcgaaaggcacagggaaaagctccactattattgtgaagatgatggcaagctcttatgcgtgatgtgtcgggaatcacgcgagcacagaccccatacagccgtactgatggagaaagccgcacaaccgcatagggagaaaatacttaaccacctctcaacacttcgcagggatagggacaaaattcagggctttcaggccaagggggaggctgacattctggccgctttaaagaagctgcaagatcagagacaatatattgtcgctgaatttgaacagggccaccagtttctcagggagcgagaggaacacttgctagaacagctggcaaagttggaacaggaactaaccgaagggagagagaaattcaaaagcagaggcgttggagaactggccaggctggcgctggtaatttccgagctcgaaggtaaggctcaacagcctgcggctgaactaatgcaggacacacgcgatttccttaataggtacccaagaaagaaattctgggttggaaaacccattgcaagggtcgtcaagaagaagactggcgaattctctgacaaactgctgtccctgcagaggggcctgcgagagtttcagggaaagctgctcagggacctcgagtacaagactgtttctgtgactctcgatcctcaatctgcaagtggctatttgcagctgtctgaggactggaagtgtgtgacgtatacttctctgtataaaagcgcttaccttcaccctcagcagtttgattgcgagcctggcgtgctgggctctaaagggttcacttgggggaaggtctactgggaagtagaggttgaaagggaagggtggagcgaagacgaggaggaaggagatgaggaggaggagggggaagaggaggaagaagaggaagaagctgggtacggtgacgggtatgatgattgggagactgatgaggatgaggagagtctcggagacgaggaagaagaggaggaggaggaggaggaggaagttcttgaaagctgcatggtgggggtggcccgagactcagtgaaacggaagggggacttgtcactccggccagaggatggcgtctgggcacttagactcagttctagcggaatctgggctaacaccagtcccgaagctgaactatttccagctctgagaccccgaagagtgggcattgccctcgactacgagggaggaactgtgaccttcactaacgccgagtcccaggagctgatctacacattcacggcgacctttactcggagactggtccccttcttatggctcaagtggcccggaacacggcttttactccggccatag

SEQ ID NO: 30139 - DNA, 270 bp, Artificial Sequence
  Description of Artificial Sequence: Synthetic coding sequence
atgagtgaacagggcgatctaaatcaagcaatcgccgaagaaggcggaactgagcaggagacagccaccccagaaaatggtatcgtcaaatctgagtctttggatgaagaagagaagctagaattgcagaggagattggaggcccagaatcaagaacgcagaaaaagcaagtctggtgccggaaaaggcaagctaaccagaagcctggcagtttgcgaagagagttccgcgcgaccaggaggcgaaagcctacaggatcaaacactctag

SEQ ID NO: 30140 - DNA, 909 bp, Artificial Sequence
  Description of Artificial Sequence: Synthetic coding sequence
atggtcacagagcaggaggtggacgccataggacaaacattggtggatcctaagcagcccctgcaagctaggtttagggccctgttcacacttcgagggcttggtggacccggagccatcgcctggatatctcaagcctttgacgacgactctgctcttctcaagcacgagctggcctattgtctgggtcagatgcaggacgccagggcgatccctatgcttgtggatgttctgcaagatacgagacaggagccaatggtacgccatgaagccggagaagcactcggcgctataggggatccagaggtgctggagatcctgaaacagtactcgtccgaccccgtgattgaggtcgctgagacttgccagctggctgtccggagactggagtggttgcagcagcacggcggagaacccgctgctggcccatacctgagcgttgacccggcaccacctgccgaggagcgggacgtggggcgactgagagaagcccttctggatgaaagccgccctctgtttgaacgatacagggcaatgttcgccctccggaacgccggtggtgaggaagctgcacttgctctggcagaaggactacattgtggaagcgctctgtttcgccatgaggtgggatatgtcctggggcaacttcagcacgaggccgcagtgcctcagttggcagctgctctggcccgttgcaccgagaaccctatggtgcgccatgagtgcgccgaagcacttggagctatcgccagacctgcctgcttggcagctctgcaggcacacgccgatgaccccgaaagagtggtgcgcgaatcatgtgaggtggccctggacatgtacgaacatgaaacaggtcgcgcttttcagtatgctgacgggcttgagcaacttaggggcgctccaagctag

SEQ ID NO: 30141 - DNA, 1521 bp, Artificial Sequence
  Description of Artificial Sequence: Synthetic coding sequence
atgagcgtattatctccgggagatctgaagcccaagcggggatcgccacacagaggatccttggaccggaccgatgcgtccactgacctggctatgcgctcatggccttccgaactaggctccagaacatgctctaccagcgccaccactactgccccatccaattctacacccattgccagacaccccggaaggaccaagggctacaacagcgatgataatctgtgcgagccatctctggaattcgaggtgccaaaccacaggcagtatgtgagccgcccaagcagcttagagagttcaagaaacaccagctccaattcatctcccctcaacctcaagggatcatccgaacaactccatgggcgatcagaatcattctcttcggaggatctgattcccagccgggatcttgcaacactgccgcgagaggcaagcaccccaggacggaacgctctgggtaggcatgagtacccgctgccaagaaatggtcccctaccccaggagggagctcagaaaaggggcactgcaccaccttatgttggggtgcggccttgctccgcaagcccatctagcgagatggtgaccttggaagagttcctcgaggaaagcaaccgcagctctcccacacatgatacgcccagctgccgtgacgacctgcttagtgattattttagaaaggcctcagacccccctgctattggtggccagcccggaccaccagctaaaaaagaaggcgctaaaatgcctacaaacttcgtggcccctactgttaagatggctgcgccaactagcgaaggtcggccactcaaacccggacagtatgtaaaaccgaattttcgactcaccgaggctgaggcacctcctagtgtggctccccgtcaggcccagccaccacaatccctgtctttgggacgtcctcgccaggctcccgaggccctcggaggtagagagacggggagccacacgctccagagtcccgctccaccgagctcgcactcattggctagagaacgcactccgcttgttggtaaggcaggtagcagttgccaggggccaggcccaaggagtagacctctggacaccaggagatttagcctggcccctccaaaggaggagcggcttgccccactgcaccaaagcgccaccgcgcctgcaattgccaccgctggcgctggagcagctgcggctgggtctggttctaactctcagttgctccatttttctcctgccgcagctcccgctgccaggactaagccaaaggcaccccctcgctcaggggaggtggccaccatcactcctgtaagagctggcctctcactcagcgagggcgatggtgtgccaggacaaggttgctctgagggtttgcccgctaagtccccaggccgttcacccgatctcgcccctcaccttggacgcgctcttgaagactgttccagaggaagcgtctcaaaaagctctcccgcttcccccgagcctgggggagacccacagactgtgtggtatgaatacggttgtgtttag

SEQ ID NO: 30142 - DNA, 678 bp, Artificial Sequence
  Description of Artificial Sequence: Synthetic coding sequence
atggcacaaacggtgccgccttgtgaactgccttgtaaggagtacgacgtggccaggaacaccggagcttatacctctagcggtctggcaacggccagcttcagaacatctaaatatctgcttgaggagtggttccagaactgctatgcccgataccaccaggcattcgctgatagagatcagtccgagaggcagcgacacgaatcccagcagctcgctacagagacgcaggccctggcccagcgcactcagcaggactcaacgaggacggtcggggaacggcttcaggacacacattcttggaagagcgagctccaacgcgaaatggaagctctagctgcagagacaaacctcctactcgctcagaaacagcggttggagagggcactcgacgccaccgaggttcccttttccatcacaaccgacaatctgcaatgtcgcgagaggcgcgagcatcccaacttagtgagggatcacgtagagactgaactgcttaaagccctgcctcctgcactctcccagtgcctgaaaaattcttgttcaagccgaaaattgtccgcgaggaacaagggtacatgccagctgatggaaactttgactgtacacggcgaggctaacccgggtattgaggggagacgcacaagagccctcgcgcacaaagaagtcccgagcggctag

SEQ ID NO: 30143 - DNA, 309 bp, Artificial Sequence
  Description of Artificial Sequence: Synthetic coding sequence
atggctaatgacagtcctgccaaatccttagtcgacatcgatctgtcttctctgcgggatccagctggcatttttgagcttgtcgaggtggtcggtaatggtacctacggacaggtgtacaaaggccgacacgtgaagaccgggcagctcgccgctatcaaggtgatggacgtgacagaagacgaagaggaggagatcaaactggaaataaacatgttgaaaaaatactcccaccaccgaaacattgctacatattacggcgctttcattaaaaagagccctcccggtcacgatgaccagctgtggtag

SEQ ID NO: 30144 - DNA, 369 bp, Artificial Sequence
  Description of Artificial Sequence: Synthetic coding sequence
atggcaacttcagccccactacgatcattagaagaggaggtgacatgtagtatttgccttgactacttgcgggatcccgtcaccatcgactgtggccacgtgttttgccgttcgtgtactaccgacgtgcgccctatttccggcagccgacctgtctgccccctgtgcaagaagcctttcaagaaagagaacattcggccagtttggcagctggcctccttagtcgaaaacatagaacgtctgaaggtggacaaggggaggcagccaggagaggtgacccgcgagcaacaagacgccaaactctgcgaacgacatcgcgagaagctgcattattactgcgaggatgacggtaaactgctgtgtgtgtag

SEQ ID NO: 30145 - DNA, 312 bp, Artificial Sequence
  Description of Artificial Sequence: Synthetic coding sequence
atgagcggcggactgttgaaagccctgcggtcagattcatatgtcgagttatctcagtaccgggatcaacacttcagaggagataatgaggagcaggaaaagctccttaagaagagctatgcggagaacgctatgcggtacatcaacgggacaagacttgatgatcggatcattagaacggactgggatgctggtttcaaggaagggaggcaatatggcagagggaggtctgggggacaggtgcgcgatgagtaccggcaggactatgacgctgggagaggaggttacggcaagctggcgcagaaccagtag

SEQ ID NO: 30146 - DNA, 894 bp, Artificial Sequence
  Description of Artificial Sequence: Synthetic coding sequence
atgtggccatttccttcccggtccctgttccctccaccaacccaagcgtggctccaaaccgtgagtagcgacccagaagcccagggttggggagcctggaatgaaacaaaggaaatactgggtccagaagggggagaagggaaggaagaaaaagaggaggaggaggatgctgaagaggatcaggacggagatgccggttttctgctctctctgctggaacaggagaacctggccgaatgtcctctccccgaccaagagttggaagccatcaagatgaaagtgtgtgcaatggaacaagcagaaggcacacccaggcctcccggagtccaacaacaagcagaggaagaggaaggaacggccgcaggacaattgctcagtcccgaaactgtaggatgtccactttcggggacacctgaggagaaagtggaggcagaccaccgttctgtgtacgtcggaaacctgtgcctacatcgcgtttgccaccaaggtctgcgcgcaggccgtcgtggcgctggacccgagcctttgcctgggcctggacaccagggggcagccgaaaagaatcagctaccctgggatcagctacaccgccctaggggaccctctcgaacaccaagattacaggggggaaccctgccacctcagcgtccccctggtcaggcccctgctcaaaccacgagggcggaaccaggtccatggaaaattctgaccatggtcttcactgtcctgaaagggcgacccgacttcgaaaggggggctggggcatggatacgctccaagcctttggtgctccatccgggagcaggcgcaggatccggtgcgggagctcgccctgaagagcgaggtgtgcagtcaagccactggccacccttggggggaggcatggcccagtag

SEQ ID NO: 30147 - DNA, 1059 bp, Artificial Sequence
  Description of Artificial Sequence: Synthetic coding sequence
atggacatcgataaagatctcgaggccccattatacttgacgccggaaggttggagtctttttctgcagcggtattaccaggtggtgcatgagggtgccgaattaaggcatctggatacccaggttcagcggtgcgaggacatcttgcagcagctacaggccgtagtacctcagatcgacatggaaggggatcggaatatttggatcgttaaacccggtgctaaatcaaggggcaggggtattatgtgcatggatcatctcgaagaaatgctaaagctcgttaacgggaaccccgtggtcatgaaagacggaaagtgggtggtccagaaatatatcgagaggccgctgttaatctttggtacgaaatttgacttgcggcagtggtttttagttaccgactggaaccctttgaccgtgtggttttacagagactcttacattcgatttagcacgcaacctttcagcctcaaaaatcttgacaattctgtccatctctgcaacaacagtattcagaaacatctagaaaattcctgtcataggcaccccctgctccctccagataatatgtggagctcccagcggttccaggctcacctccaggaaatgggggcacctaacgcctggagcacgataatcgtacctggaatgaaggacgccgtcatacacgcactgcagacgagccaggatacggttcaatgccggaaagcgagcttcgagctctacggagccgattttgtgtttggtgaggatttccaaccctggctgatcgagataaacgcctcgccaactatggcaccgtccactgcagtcacggcaagactatgcgcaggggtccaggcagataccctgcgggtggttatagatagaatgctggacaggaactgcgatacaggagccttcgagctcatttataagcagcctgttacgacctcccctgccagtacgcccagaccctcttgtctccttccaatgtattctgacaccagagcccgttcaagtgatgatagcaccgcctcatggtgggctctccgcccatgcagaccacaggccagaccatag

SEQ ID NO: 30148 - DNA, 363 bp, Artificial Sequence
  Description of Artificial Sequence: Synthetic coding sequence
atggaattagatctcttcctaggactggatgacgtctttcccagactgttacacggtctcctgcacagagccttctcagtgttcctgttcaatactgagaacaaattgctcctgcagcagaggtcagacgccaagattacatttcctgggtgctttacgaatacctgctgtagccaccccctctctaatcctgccgagctggaggaatccgacgccttgggcgttaggcgggctgctcaaaggaggctcaaagcagagctcggcatcccccttgaagaggttacttctagccctacacagccttataaactcaaaccaaagcataccataaaacggttcctgatcaaatttctgaattcctag

SEQ ID NO: 30149 - DNA, 339 bp, Artificial Sequence
  Description of Artificial Sequence: Synthetic coding sequence
atggaggagatccccgctcaggaggccgcagggagcccgagagttcaattccagagcctggagacgcaatctgaatgtctgtcgcctgagcctcagttcgtgcaggataccgatatggagcaaggcctaacaggagggttccctatttctaaaccggacggtatctcccaactggagcaggacctccaggtctttgatttggaaaccaaaacaagagaagtcttgagagatgattgttctgacggggaaactagagaggaaaataagttgctcatccccaagcagaaaatctcagaggaggtacacagttataaggtcagggttggcagacttaaatag

SEQ ID NO: 30150 - DNA, 1818 bp, Artificial Sequence
  Description of Artificial Sequence: Synthetic coding sequence
atgtccgaaatcctgaagcagaaggacacagaacctactaatttcaaggtcgcggcagggacactggatgcgtccaccaaaatctatgcagtgcgtgtggacgccgtgcacgcagacgtatacagagtgctaggcggattaggcaaggatgctcctagcctcgaggaggtggaggggcacgtcgccgatggtagcgcaactgagatggggactaccaagaaagcggtgaaaccgaagaagaagcacctccaccgcaccatagagcagaacatcaataatctgaatgtcagcgaagcagacaggaagtgtgaaatagacccaatgttccaaaaaactgccgcatcctttgatgagtgtagtactgccggtgtgttcctttctacactgcactgccaggattaccgcagtgaattgcttttcccctcggacgtccagaccctgagtactggagaacccttagaattgcccgaattaggctgcgtggaaatgaccgacctgaaagcaccactgcaacaatgcgccgaggatcgccagatatgcccgagcctggcgggttttcagttcacacaatgggactctgagacacacaatgaatctgtgagcgccttggtggacaagtttaaaaagaacgatcaagtgttcgatataaatgctgaggtcgatgagtctgattgtggcgattttccggatggctcattaggcgatgattttgacgccaacgatgaacccgaccacaccgctgtgggggatcacgaggagttccgatcttggaaagaaccctgccaggtacagtcatgtcaagaggagatgattagtttgggggacggagacatacggaccatgtgtccacttctctcaatgaagccaggagagtattcgtatttttctccacgtacaatgtcaatgtgggccggaccagaccattggcgcttcagaccacgtcgcaagcaagacgccccatcccagtccgaaaacaaaaaaaaatcaactaaaaaagacttcgaaatcgacttcgaggacgacatagactttgatgtgtatttcaggaagaccaaggccgcaaccatcctcactaaatcaactctagaaaatcaaaactggagggccactactttgcccaccgattttaattacaacgtcgacacattggtgcagctgcatctcaaaccaggcacacgcctgctgaagatggcccaggggcatcgcgtcgagactgaacactacgaggaaatagaggactacgactacaacaaccccaacgatacttcaaacttctgccccggtctgcaggcagccgatagcgacgacgaggacctggacgatctatttgttggccctgttggcaattctgatctcagcccgtacccgtgccatccccctaagaccgcacaacaaaacggggacacccctgaagcacagggattagacataacaacctatggggaaagcaacctcgtcgccgagccccagaaagtgaataagatcgaaatccactatgctaagacagccaaaaagatggacatgaaaaaactcaagcagtctatgtggagcctcctgacagccctgtctggtaaggaagctgatgctgaagccaaccacagagaggccggaaaagaggctgctctggcggaggtggctgacgagaaaatgctgagtgggttgacaaaagacttgcagcggtccctaccccctgttatggcacagaacctgtcgattcctctggccttcgcatgcttgttgcacctcgccaatgagaaaaacctgaaattagagggcactgaagacttgtctgatgtgctagtacgccagggggactag

SEQ ID NO: 30151 - DNA, 2253 bp, Artificial Sequence
  Description of Artificial Sequence: Synthetic coding sequence
atgagtagctccccagttaacgtcaaaaaattgaaggtttccgagctgaaggaggagctcaagaaacgtcgcctgtccgacaaaggacttaaggcggagctcatggagcgattgcaagcagctctggatgacgaagaagccggtggcagacctgctatggagcccggtaatggcgatgaccagggctttcaggagggagaggacgaactcggagacgaggaagagggagctggagatgaaaacggccacggcgagcaacagccccagccaccagcaactcaacagcagcagcctcagcagcagagaggtgctgccaaggaggccgctggtaagagctctgggccaacatctttatttgctgtgaccgttgccccaccaggagccagacagggacaacagcaggccggaggaaaaaagaaggctgaaggaggtgggggaggaggaagacctggtgctccagctgcgggtgacggaaagacagagcagaagggcggagataagaagaggggcgtgaagagaccccgagaggaccatggaaggggctattttgagtatatcgaggagaataagtatagtcgggctaagtcgcctcagccacccgttgaagaagaagacgagcactttgatgatacggtcgtctgtctcgacacctataactgcgatctgcattttaaaatctcacgggatagactgagcgccagttccttgactatggaaagtttcgcatttctctgggccggagggagagccagctacggcgtgtcaaaaggtaaggtgtgctttgaaatgaaggtgaccgaaaagatccctgtgcgtcatctgtacactaaggatatcgacatacacgaagtgcgtattggctggtctttgacaacttcggggatgttgttaggagaagaagaattctcttacgggtattcgctgaaaggcattaagacttgcaattgcgagactgaagattacggcgagaagttcgatgaaaatgacgttatcacatgctttgcaaactttgagagtgacgaggtcgagctgtcctatgcgaaaaatggtcaggatctgggtgtggcctttaaaatctccaaggaagtcctggcaggcagaccattgttcccccatgtgttatgccataactgtgccgttgagttcaactttggccagaaagaaaagccctatttccccatacctgaggagtataccttcattcagaacgtgccactggaggacagagtcaggggccctaaggggcctgaagaaaagaaggattgcgaggtcgtgatgatgatcggcttgcccggagcagggaagactacctgggtgactaagcatgccgctgagaatccaggcaagtacaatattttggggacaaacaccatcatggataagatgatggtagcaggctttaagaaacagatggcagacaccgggaaactaaatacactgttgcaacgcgctcctcagtgcctaggaaagttcattgagattgccgcacgaaaaaaacggaatttcatcctcgaccagaccaacgtttctgccgctgctcagcgacggaaaatgtgtctatttgctggcttccagcgaaaagccgtcgtggtctgccccaaggatgaggattacaagcagaggacacaaaagaaggccgaagtggagggcaaagatctgccggagcatgccgtgctgaaaatgaagggcaatttcaccctgccagaagtggccgaatgctttgacgaaatcacctatgttgagctacaaaaggaagaagctcagaaacttctggagcagtacaaggaggagagtaaaaaggccctaccccctgagaagaaacagaatactggaagcaaaaaatctaataaaaacaagtccggcaaaaaccagtttaacagggggggtgggcacaggggccgagggggatttaatatgcggggaggcaatttcagaggaggtgcccctggcaatcggggtggttacaacagacggggaaatatgccgcagagggggggtggagggggaggctcgggcggtatcggctacccctatcctcgggctccagtgtttcctggtcggggatcttactcgaacaggggcaattacaaccggggaggtatgcctaatagaggcaattacaaccaaaacttccgcggtcgtgggaacaatcggggatataagaaccaatcccagggctacaaccagtggcaacagggacaattctgggggcagaaaccttggtcccaacactaccaccaggggtattattag

SEQ ID NO: 30152 - DNA, 804 bp, Artificial Sequence
  Description of Artificial Sequence: Synthetic coding sequence
atgtgggatcagcggctggtaaaactggccttgcttcagcacctgcgggcattttacggaatcaaagtgaagggggtccggggtcagtgtgatcgaagacgccacgaaactgctgctacagagatcggcggtaaaatcttcggagtaccatttaatgccctgccccacagcgcagtgcctgaatatgggcatattcctagctttctggtcgacgcttgcacatcgctggaggagcacatacacaccgaggggcttttcagaaagtccgggtcagtgatccgtttgaaagcactcaaaaacaaagtggaccacggcgaagggtgcctcagctctgccccaccatgcgacatagccggactgctgaagcaatttttcagagagcttccagaacccatactgccagccgatctccacgaagctctgcttaaggcccaacagctgggtacagaggaaaagaataaggccatactactacttagctgcctgttggctgatcataccgtccacgtgctgcgctacttctttaacttcctacgaaatgtctccttgcgaagtagtgaaaataaaatggatagcagcaacttggctgtgatttttgctcctaacttattgcagacaagcgaggggcacgagaagatgtcatccaatgccgagaagaagggcgtctatcaaacactttcttggaagcgttaccagccatgttgggtactaatggtctcagtgctgctgcatcattggaaagcgctcaagaaggtgaacatgaaactgctggtcaatatacgcgaacgggaagataacgtctag

SEQ ID NO: 30153 - DNA, 600 bp, Artificial Sequence
  Description of Artificial Sequence: Synthetic coding sequence
atgccccacaaaattggcttcgtagttgtgtctagttcagggcacgaggatggctttagcgcacgcgagttgatgattcacgctccaactgtgtcaggttggagatcccctagttacgtgtctctctgtgacaatgagaagactggctgcaaggctagggagttaaaaagtgtctacgttgacgccgtaggccagttcctgaagttgatattccatcaaaaccacgtaaacaaatacaatatctacaatcaggtggccctggtggcaatcaacatcattggtgatccagccgacttcagcgacgaatccaacactgctagcagggaaaaactgatcgaccattaccttggtcacaacagtgaagacccagccctcgagggaacttatgccagaaaatctgactatataagcccgcttgacgatttggctttcgacatgtaccaggaccccgaagtggcacagattatcagaaagctcgacgagaggaaacgagaggcagttcagaaggaacgatatgactatgccaaaaagttgaaacaggccatcgccgatctccagaaggtgggcgagaggctgggaaggtacgaggtggagaagtag

SEQ ID NO: 30154 - DNA, 471 bp, Artificial Sequence
  Description of Artificial Sequence: Synthetic coding sequence
atgacagaagactcccagagaaacttcagaagcgtttactacgagaaagtaggatttcgcggagtcgaggaaaagaaaagtcttgagattctgcttaaggatgaccgactagatacagagaaactatgtactttctcacagagatttccgctgccctcaatgtatagagctttggtctggaaggtcttgctgggaattctgcccccacaccacgagtctcacgccaaagtcatgatgtacaggaaggaacaatacctcgacgtgctacacgcactgaaggtggttcgcttcgtgtcagatgccactcctcaagcggaagtctatttacggatgtaccaattggagtcaggcaaactgccacgctccccctcttttccactcgagcctgatgatgaggtcttcctggctatagcaaaggctatggaggaaatggttgaggattcagtggattgctattggatcacaaggtag

SEQ ID NO: 30155 - DNA, 2730 bp, Artificial Sequence
  Description of Artificial Sequence: Synthetic coding sequence
atgataaggcatgcaggggctcccgctcggggagacccaactggcccagttccagtcgttgggaagggcgaagaggaagaggaagaagacggtatgcggctgtgcttacccgcaaatcctaagaactgtctccctcaccggcgaggtatcagcatcctagagaaattgatcaaaacttgtcccgtctggctgcagctgtcgttaggacaggctgaagttgccaggatacttcaccgagtcgttgctgggatgttcttggtgaggagagactcatccagtaaacagctggtcttgtgcgtgcattttccaagtctcaacgagtcctctgcagaagtcctggaatatacaattaaagaagaaaaaagcattctctacttggaaggaagcgctcttgtgttcgaggacatcttcagacttatcgcattctactgtgtctctagagacctgctccccttcacactgagacttccgcaggccattttggaggcaagcagctttacggatctggaaacaatagcaaacctcggcctagggttttgggactcctcactgaatccccctcaggaacgcggaaaacccgcagagccccctagggaccgggctcccggattcccattggtgtctagtcttcggcctaccgctcatgacgccaattgcgcatgcgagatcgaactctcagttggcaatgatagactttggtttgttaatcctattttcatagaggactgtagtagcgcactccctacagatcagccaccgcttggcaattgtccagcacggcctctacctcctacctccgatgctactagccccacatcccgatgggctcccagacggccaccccctcctccaccagtgctgcccctgcagccctgctctcctgcccagcctcccccactgccagctaagaaaaacctacccaccgcccctccacggagacgcgttagtgagagagtgagtctggaggatcagagcccgggaatggcagctgagggggatcagctctcccttccaccacagggcaccagtgatggacccgaagacacacctagagaatcaacagagcagggacaggacacagaagttaaggccagtgatccccattccatgcccgaactcccgcgaactgcaaagcagccccctgtcccgccacccaggaagaagcggataagccggcagctggctagcacgttgccagccccattggagaatgccgaactttgtactcaggctatggccctggaaactcctacaccagggcctccccgagagggtcagtctccagctagtcaggcgggtactcagcaccctcccgcacaggccaccgcccactcccagagcagccccgagttcaagggctccctagcaagtctcagtgactccctgggggtatctgtgatggcaacagatcaggatagttactccacctcgtctacagaggaagaattggaacagttcagtagtccttctgtcaaaaaaaagccgagcatgatcctcggaaaagcccgtcatcgcctgtcctttgcgtccttcagcagcatgttccatgcctttctaagcaacaaccggaaactctataaaaaagtcgttgagctggctcaggacaaaggctcttattttggaagcctcgttcaggattacaaggtgtattcactggaaatgatggcacgccagacgtcctctaccgagatgctacaggagattaggacgatgatgacacagctgaagtcatatctcttgcaatcaaccgagctgaaagctctggttgaccctgcactccactctgaagaggagctggaggccattgttgagtccgctctctacaagtgcgtcctcaagcccctgaaggaggctattaattcctgcctgcatcagatccatagcaaggatggtagcctacagcagctgaaagagaatcagttggtaatcctggcaacaaccacgaccgacctgggtgttacgactagtgttccagaagtgccaatgatggagaaaatcctccaaaaattcacttctatgcataaagcatattctccagaaaaaaagatttccattctgctgaaaacttgcaaacttatttacgattcaatggccctgggcaaccctggcaaaccatatggggcagatgacttcttaccagttctgatgtacgtgttggcccgatccaatttgactgaaatgctgctgaatgtggaatacatgatggaactgatggacccggctttacagctcggtgaggggtcttactatctgaccacgacatacggtgcactcgaacacattaaaagttatgataaaatcacagtgactcgtcagctatccgtcgaagtgcaggattccatacacaggtgggagagaagaagaaccctaaacaaggccagggcttcgcgatcctccgtgcaggactttatttgtgtcagctatttagaaccagagcagcaggccaggacgctggcttcccgcgctgatacccaggcgcaggcactctgtgcacagtgcgcggagaagttcgctgtcgaacgccctcaggcccaccgactctttgtgttggttgacgggcgatgtttccagcttgcagacgatgctctgccacattgcatcaagggctatttactcagaagcgagcctaaacgcgacttccacttcgtttatagaccactcgatggaggcggaggcggtgggggtggctcccctccatgcctagtggttcgagaacctaacttcttgtag

SEQ ID NO: 30156 - DNA, 1728 bp, Artificial Sequence
  Description of Artificial Sequence: Synthetic coding sequence
atgagcagtgatgaggagaagtattcgctacccgtggtccaaaacgattcaagtcgcggatccagcgtgagctcaaatctgcaggaagaatacgaggaactgcttcactatgcgatcgtaacacctaatatagaaccatgcgcttctcagagttcacatccaaaaggtgagcttgtgcccgatgtgcgtatttccactattcacgatattttacacagccaaggaaataacagtgaagtccgtgagactgccatcgaagtaggcaagggatgcgatttccacatttcttctcactccaaaaccgatgaatcatctcctgtgttatcccccaggaaaccgtcccacccagtgatggattttttctctagtcatctgttagccgactctagcagccccgctaccaactcaagccacacagatgcccacgagatcttagtttctgattttctcgtcagcgacgaaaaccttcaaaagatggagaatgtcctggatttatggtctagcggcctcaagaccaacatcatctcagaactaagtaagtggcggcttaactttatcgattggcaccggatggagatgcgcaaggagaaagagaaacacgcagcccatctgaaacagctgtgcaaccagattaacgaactgaaagagctacagaaaacatttgagatcagtataggtcggaaagatgaggttatctctagtttgtcccacgccattggaaagcagaaagaaaaaatagagctaatgaggaccttcttccactggaggatcggccatgtcagagcaagacaggacgtgtacgagggcaagctagcagaccagtattaccagcggacacttctgaaaaaggtgtggaaagtctggaggtccgtcgtgcagaaacagtggaaggatgtggtagagcgcgcatgccaggcacgggcagaagaagtgtgcatccaaatctccaacgactatgaagcaaaagttgccatgctgtcaggggctctagaaaacgcgaaagcggaaattcagcgcatgcagcacgaaaaggagcattttgaggactccatgaagaaggcattcatgagaggggtatgcgctctcaacctcgaagccatgaccatatttcagaacaggaatgacgctggtattgatagtactaataacaagaaagaggagtacggaccaggtgtacaggggaaagaacacagtgctcacttggacccaagcgcacccccaatgcctctcccagtaacttcgcctctgctgcctagccctcccgctgcagtgggaggggcttccgccaccgctgtgccctctgccgcaagtatgacctccaccagggccgcatccgcctcctccgtccacgtgccggtttctgctcttggtgccggtagcgccgctaccgcggcatccgaagaaatgtacgtgccaagagtggtaaccagcgctcagcagaaggctggtaggaccatcaccgcacgcattacagggaggtgcgatttcgcttctaagaaccggataagctcctcccttgctatcatgggcgtgtcaccccctatgtcaagtgtggtcgtcgaaaagcaccaccctgttacagttcagaccatccctcaagcgacagccgcaaagtaccccaggaccattcatccagagtcgagcacatcggcttcaagatccctggggaccagatcagctcacacccagagtctgacttctgttcactccatcaaggtagtcgattag

SEQ ID NO: 30157 - DNA, 2091 bp, Artificial Sequence
  Description of Artificial Sequence: Synthetic coding sequence
atggcgaactatcggaatacttccgaaatacctctggttctggtcggaacccaggacgcaatctcatctgcaaacccaagggtcatcgacgatgcaagggccagaaaactgagtaacgacttaaagcgctgcacttattacgagacctgtgccacgtatgggctgaatgtggagcgggtattccaggatgtagcgcagaagatcgtggccacgcggaagaaacaacaactctctatagggccttgcaagtctctgccaaattcaccatcgcactctagtgtgtgttctgcacaagtgagtgcagtgcacatcagtcaaacctccaacggtggcggatcattgtcagactactcaagctcagtgccatccactccgagcacatcacagaaagaactgagaatcgacgtgccccctacagccaacactcctacccctgttcgcaagcagtctaagaggcgctctaacctttttacctctaggaagggctcggacccggataaggagaaaaaaggattggagtcccgagccgactccattgggtctggacgtgccattcctattaaacagggcatgttgctgaagagatcaggcaaatcccttaataaagagtggaagaagaagtatgtgacactgtgtgacaacggcgtgttgacataccacccttcactgcacgactatatgcagaatgtgcatggaaaggagattgacctcttgaggacaacggtgaaggtgcccggaaagaggccccctcgggctaccagcgcatgcgcccctatttcctccccaaaaaccaacggcctgtccaaagacatgtcttctctgcacatttctccaaattctgggaatgtcactagtgcctctggttcccagatggcttcaggaatttccctcgtcagcttcaactctagacccgatggcatgcaccagagatcctactccgtatcaagtgctgaccagtggagtgaggctacggtgatagctaactctgctatcagttcagacacaggtctcggggatagcgtctgttccagcccaagcatttcaagcacgacgagccccaagttagatccccctcccagtccccacgccaacaggaagaagcacaggcgcaaaaagtctacgagcaacttcaaagctgatggtctaagcggaaccgccgaagaacaggaagagaacttcgagtttatcatcgtgagcctgacagggcagacttggcacttcgaggcaaccacctacgaagagagggacgcctgggtccaggccattgaatcacagattctcgcgtcactccagtcatgcgaatctagtaaaaacaagagtcgcttgaccagccagagcgaggcaatggccctgcagtcaatccggaacatgagagggaattcccattgcgtggattgcgaaacccaaaacccaaactgggcatcactgaatctcggcgctctcatgtgcattgaatgttctggaatccataggaacctcggaactcatctcagccgtgttcgctccctggacttggatgattggcccgtagaactgattaaggtgatgagttcaataggcaacgagctggcaaactcggtttgggaagagtcctcccagggacgcaccaagccgtccgtcgattccacccgcgaggaaaaggaacgctggatccgcgctaaatacgagcagaaactctttctggctccactaccatgtacagagctgtcattaggccagcatttacttagggcgacggccgacgaagatctacgcacagccatcctactgcttgcccacggtagccgggacgaggttaatgagacctgtggggagggcgatggcagaactgccctgcatctcgcgtgtaggaaaggcaacgtggtattagcacagctgctcatatggtacggagtggacgtgaccgcacgcgatgcccacggtaacaccgcactcgcgtacgccaggcaggcttctagccaggaatgtattgacgttctactccaatacgggtgtcccgatgagagatttgttcttatggcaacgccgaatctgtctcgtcggaataataaccgcaataacagttcaggacgggtcccaactatcatttag

SEQ ID NO: 30158 - DNA, 270 bp, Artificial Sequence
  Description of Artificial Sequence: Synthetic coding sequence
atgagcgaacagggtgatttaaaccaagcaatcgctgaagagggaggaaccgaacaggagaccgctacacctgaaaatggtatagtaaagtcggaatcattggacgaggaagagaaactcgagctccaacgcaggctggaggctcaaaatcaggaaagacgaaagagcaaaagcggggctggcaaggggaaattgactaggagtctggctgtgtgcgaggaaagttcagccaggcccggtggcgagagtctgcaagatcaaaccctctag

SEQ ID NO: 30159 - DNA, 1785 bp, Artificial Sequence
  Description of Artificial Sequence: Synthetic coding sequence
atgacagacacacgacgacgcgtgaaagtctatacactaaatgaggatcggcagtgggacgacaggggtaccggacacgtatccagcggctacgttgagagactcaaaggaatgtcgctgctagtccgtgcggagagcgacgggtcactgttgcttgaatctaagattaaccccaatacggcctatcagaagcaacaagaagatgagaaattcctgaccgatctgtttgcacagttgaccgacgaggcaaccgatgaggagaaacgacaggagctggtaaactttctgaaagaattttgcgccttctcacagacccttcagcctcaaaaccgcgacgccttctttaagacactgtctaacatgggcattctaccagctctggaagttatactcggcatggacgacactcaggtgcgcagtgccgcaactgacatcttctcttatctcgttgagtacaacccctcgatggtgagagagttcgtcatgcaggaggctcagcaaaacgacgacgtcagcaaaaaattgacagaacaaaagataacctccaaggacatccttctgattaacctcatcatcgaacacatgatttgcgacactgatcctgagctgggcggagcagtccagttgatggggttattaaggactctggtcgacccagagaacatgttggctacagccaataagaccgaaaaaaccgagttcctggggttcttctataagcattgtatgcatgtcttgaccgcccctttattagcgaacactaccgaggataaaccttctaaagatgacttccagacagcccagttactggctctggtgctggagctgcttacattttgtgtagaacaccacacctaccacattaagaactacattatcaataaggatatcctgaggcgtgtcctggtgttaatggcgtctaagcatgcttttctagccttatgtgcattacgcttcaagagaaaaatcatcggtctgaaagacgagttttacaacaggtacattatgaaatcatttctgtttgaaccggtagtgaaggcttttcttaataacgggtcccgttacaaccttatgaattctgctattattgagatgttcgaatttatacgcgttgaagatattaagtcactgacagcccatgtaattgaaaactattggaaggctctggaggatgtggattacgttcagacattcaagggcctcaagctccggttcgagcaacagagggagcgccaagacaaccctaaactagacagtatgaggtcaattctgagaaatcaccggtaccgaagggatgccagaactttggaggatgaggaggagatgtggtttaacaccgacgaggacgatatggaggatggggaggccgtcgtcagcccttctgataagacgaaaaatgacgatgacattatggatcccatatctaaattcatggaacggaagaagcttaaggaatccgaagagaaggaggtactactgaaaaccaacctgtccggtaggcaatcacccagcttcaagctgtctttaagctccggtacaaagacgaatctcacatcccagagcagcactaccaatctgcctggttcacctgggagtcctgggagcccaggaagtcctggaagcccaggtagtgtcccaaaaaatactagtcagacagctgccataactacaaaggggggactggtgggcttggtcgactatccagatgatgacgaagacgatgatgaggacgaggacaaggaagacacattgcctctcagtaagaaggctaagttcgacagttag

SEQ ID NO: 30160 - DNA, 522 bp, Artificial Sequence
  Description of Artificial Sequence: Synthetic coding sequence
atgttcactgagggggaggaaatgtacctccaggggagtaccgtttggcatccggattgcaaacagtccactaaaacagaggagaagttgaggcctactagaacctcctctgaatctatctacagtaggccgggttccagcattcccggttcccccggtcatacaatctacgccaaagttgacaatgagatcctcgactataaagacctcgcagctattcccaaagttaaggctatctacgacattgagcgccctgacctcattacctacgagcccttctatacttcaggatatgatgacaagcaggagcgccaatctctgggcgagtcccccagaacgctgtcccccactccgtctgctgagggctaccaagacgtgagagatcgtatgattcaccgaagtacctcccagggctcaatcaactccccagtctacagccgtcatagctacacacctaccacctcgcgatctccccagcacttccaccggcctgaccagggcatcaacatttaccgcaagtag

SEQ ID NO: 30161 - DNA, 1620 bp, Artificial Sequence
  Description of Artificial Sequence: Synthetic coding sequence
atggccacgtccgctcccctgcgctccctcgaagaagaggtgacatgttctatctgtctcgactacctgagggacccagtaaccatcgactgtggccacgttttctgcaggtcttgcaccaccgacgtgcgtcctatttctggctcgagacctgtctgcccgctttgtaagaagccatttaaaaaggagaacattagacccgtgtggcaactcgcaagtttagtggaaaacattgagcgtctgaaagtcgataaggggagacagccaggcgaagttaccagagaacaacaggacgccaaactgtgcgagaggcatagagaaaagctccactattactgcgaagacgatgggaagctgctttgcgtaatgtgtcgcgagtcgcgcgaacatagaccccacacagctgttttgatggaaaaagcagcgcagcctcacagagagaaaatcctcaaccaccttagcacattgaggcgggacagagataagattcagggcttccaggcgaaaggggaggccgacattctggccgcactgaagaagctgcaagatcaaaggcaatatatcgtcgctgaattcgaacaagggcatcagttcttacgcgagcgggaggagcatcttctcgagcaactggcaaaattagagcaggagctaacggagggacgagaaaagtttaaatcacggggagtgggcgaactcgcgaggctcgctctcgtgatctctgagctagagggtaaagcccagcagcccgctgccgagttgatgcaggatacccgcgatttcttaaaccgctaccctcggaagaagttctgggttggaaagccaatcgcccgagtggtcaaaaagaaaacgggtgagttctctgataagctgttgagtttacaaaggggactgcgcgaattccaagggaaactgctgagggacctggagtataagaccgtatcagtgaccctggaccctcagagcgcatctggctatctgcagctgtccgaggactggaaatgcgtcacctatacttccctctataagtctgcataccttcatccacaacagtttgattgcgagccaggggttctgggcagcaaggggtttacttggggcaaggtctattgggaggtggaagtggagcgtgagggttggtctgaggatgaggaagaaggcgatgaggaggaagagggtgaggaggaggaagaggaggaggaggcaggctacggagacggatacgatgactgggagaccgacgaggatgaggagtctctgggggatgaggaggaggaggaggaggaagaagaggaggaagtcctggaaagctgcatggttggagtggcacgcgacagtgtaaaacggaaaggggatcttagtctgcggccagaggacggcgtgtgggcgttgcggctctcttctagcggcatatgggcaaacacctcccctgaagcagagctgttccctgccctacgccctcgaagagtgggtattgccctggattacgagggcggaacggtgacctttacaaacgcagaatcacaggaactgatttatacgtttaccgccacttttaccaggagactggtcccgttcttatggctgaagtggccaggaaccagactcctactgcgaccttag

SEQ ID NO: 30162 - DNA, 2112 bp, Artificial Sequence
  Description of Artificial Sequence: Synthetic coding sequence
atgtttaggtatgaaagcctggaagactgtcctttagacgaagatgaagatgcctttcaaggtctaggcgaggaggatgaggaaatcgaccagttcaatgacgatacgttcgggagcggagcagtagatgacgattggcaggaggctcatgagcgactagcagagctcgaagaaaaactacccgtcgcggttaacgaacaaaccgggaatggagagcgcgacgagatggatctattaggggatcatgaagagaacctggcagagcggctcagcaaaatggtcatagaaaatgagctcgaggatccagctataatgcgcgcagtgcagaccagaccggtcctgcagcctcagcccggtagtctcaactcctctatatgggatgggtcggaagttctgaggaggattcggggaccgctgctggcccaggagatgcctacagtgtctgtgctcgagtacgccttgcctcagagaccgccacagggtcccgaagacgatagagatctcagcgaaagggcccttccccgtcgatcgactagtcccatcattggctcaccgccagtgcgtgccgtgcccattgggactcccccaaagcaaatggcagtgccgtctttcacccaacagatcctgtgcccaaaaccagttcacgtaagaccaccgatgccaccccgatatcctgccccttatggtgaacgcatgagtcctaatcagctctgttcagtgccactgcagccgggaaggatgtccccatcccagttcgccagagtgccaggcttcgtaggttctcctctagctgcaatgaaccccaaactgctgcaggggcgagtgggtcagatgctccccccagccccaggctttcgcgctttcttctcagcccctcccagcgcaaccccacccccacagcagcatccacctggcccaggcccacacctacagaacctgcgttcccaagcacccatgttcagaccagacaccacacaccttcaccctcagcatcgcaggctgctccatcagcgtcagcagcagaatcggtcacagcacagaaatctgaacggggcaggtgacagaggcagccataggtcaagtcatcaggaccatctgcgcaaagacccctatgctaacctcatgttgcagcgtgagaaagattgggttagcaagatccaaatgatgcagttgcagtcaacggatccttatttagatgacttctactatcagaactattttgagaagttagagaagctgtcagccgcagaggagattcagggcgatggaccaaaaaaagagaggaccaagctcattacccctcaggtggccaaacttgagcatgcttataaaccggtgcagttcgagggcagtctggggaagcttactgtttcctcagttaataatcccagaaaaatgatcgacgcagtcgtgacctcccgttcagaggacgacgaaacaaaagaaaagcaggtcagagataaaagacgtaagacactcgtgataatagagaagacttactccttgctcctggatgtagaggactatgagaggcggtacctgcttagcttggaggaagagcgtccggctctaatggacgatcgcaagcacaagatctgtagtatgtacgacaatctgcgcggtaagctgccgggtcaggagaggcccagcgacgatcactttgtgcagattatgtgtattcgcaagggtaaacgaatggtggcaagaatcctgcctttcctgagtacagaacaggctgctgacatcctgatgacaacagctagaaacctccctttcctgatcaagaaggatgctcaagacgaagtactcccttgcctgctgtcaccattctccctgctcttataccatctgccttctgtgtcaataacatcactgctccgccagttgatgaatctgccatcctcagatcctgctacagaatctactcagaataaccagtggactgaagttatgttcatggcgacaagagaattgttacgcattccccaggccgcattagctaagcccatctccattcccacgaatcttgtctcactgttttctcggtatgtggaccggcagaagctaaacctgctcgagacgaaactgcagctagtacaaggcatccgttag

SEQ ID NO: 30163 - DNA, 957 bp, Artificial Sequence
  Description of Artificial Sequence: Synthetic coding sequence
atgagcgcacacaatcgcggtactgagctggacttgagctggatttccaagatccaggtgaatcacccagcagtcctccggagggcagaacagattcaagccagaagaactgttaaaaaggaatggcaggccgcttggttgcttaaggccgtgacttttatagatctcacaaccctttctggtgatgacacatctagcaatattcagcggctgtgctataaggccaagtaccctatcagggaggacctgctgaaggccctgaacatgcacgataaaggcattactaccgctgccgtgtgcgtgtaccctgcaagagtttgtgatgcagttaaagccttgaaagcggcaggatgtaacatccccgtggcctcagtcgccgcagggtttcccgcaggtcagacgcatctgaagaccaggctggaggaaataagacttgcagttgaggacggggctaccgagatcgacgtagtgatcaatcgtagcctggtgctcaccggtcagtgggaagcactctatgatgagatccgtcagtttcgcaaggcctgcggcgaggcccaccttaaaaccattctcgccactggagaactgggaacactgaccaacgtctacaaggcttcaatgattgctatgatggcgggttctgactttatcaaaacctcaactggaaaggagacggttaacgcaaccttccctgtggcgattgtgatgctacgcgcaatcagggacttcttctggaagaccggaaataagattggctttaaacctgctggcggtattcggtccgctaaagatagccttgcctggctgagcctcgtgaaagaagagctgggtgacgaatggttaaagcccgagttatttaggatcggcgcttccactttgctttcagacatagagaggcagatttatcaccatgtgaccgggagatatgcagcgtatcatgatctgcctatgagttag

SEQ ID NO: 30164 - DNA, 1188 bp, Artificial Sequence
  Description of Artificial Sequence: Synthetic coding sequence
atggctagcgcggcttccgtaacaagcctggcggatgaagtcaattgcccaatttgtcagggaaccctgcgggagcccgtcacgatcgactgcggacacaacttttgccgcgcttgtttgacgcgctactgtgaaatccccggacccgacttagaagagagtcccacttgccccctctgcaaagagccattcaggcctggcagcttcaggcccaactggcagctcgccaacgtagtggagaatatcgagagacttcagctggtctcaacactagggttgggggaggaggatgtgtgccaagagcatggggagaagatatacttcttttgcgaagatgacgaaatgcaattatgcgtggtctgcagagaggccggtgaacatgccacccacaccatgcgcttcctggaggatgccgctgctccctacagagagcagattcacaagtgtcttaaatgtctcaggaaagagcgggaagagatacaagagatccagagccgcgagaataagcgcatgcaggttctgcttactcaagtcagtacgaaaaggcaacaggtaatttcggaatttgcccacctgcggaagttccttgaagagcagcagtcaattctcttagctcagctagaatcacaggacggggacatactgaggcagcgagacgagtttgatctccttgtagcgggagagatctgtagattttcggctctgatcgaagagttggaggagaagaacgagagacccgctagagagcttttgacggatatccgctccacgctgattcgatgcgagaccagaaaatgcagaaagcccgttgccgtgtctccggagctggggcagaggatccgggacttcccccagcaggctctgccactccagcgcgagatgaaaatgtttctggaaaaactctgttttgagctggactacgaacccgcacacatcagcttagacccacagacctcacacccgaagctgcttctatctgaagatcatcagcgtgcccagttctcatacaaatggcaaaattcgccggacaaccctcagcgttttgatcgcgcaacgtgcgtgctggctcacactggcattactgggggtcgccacacatgggtgtggatggcacgggtgccaggtgactcaggctgctgccagttctgttctccgccttcagtcctcgggacagaggtggccgcttag

SEQ ID NO: 30165 - DNA, 3288 bp, Artificial Sequence
  Description of Artificial Sequence: Synthetic coding sequence
atggctgagggagcagctggcagagaagacccagcccctcctgacgccgctgggggagaagatgatcctcgcgtgggcccagacgctgccggagattgtgtgactgcagcttccggaggccgtatgcgggatagacgtagcggtgtagcgttgcccggagccgcaggtacaccagccgattctgaggccggactcctagaggccgctagagccacccctcggagatccagcattataaaggacccctccaaccagaaatgcggcggaagaaaaaaaacagtcagcttttccagcatgcctagtgagaaaaagatctctagtgccaacgattgtatttcgtttatgcaagcaggatgcgagctgaaaaaggtgagaccaaactctcggatttataacagattcttcacgctcgatactgatctccaggccctgcgttgggaaccaagcaagaaagacttagagaaggccaagctagatatctcagctataaaagagattcgactgggaaagaatactgagacctttaggaataatggcctcgccgaccagatatgtgaagactgtgcctttagtattcttcatggtgaaaattatgagagccttgacctcgtggctaatagcgcagacgtggcaaacatatgggtgagtggactaaggtaccttgtgagcagatctaagcagccactggattttatggaaggtaatcaaaacacacccagatttatgtggttaaaaacggtatttgaggctgctgatgtggatggcaatggaattatgttggaagacacctccgttgagctcattaaacagctgaacccgaccttaaaggaagccaaaatccggctcaagttcaaagaaatccagaagtctaaagaaaagctgacgacgcgagtaacagaagaagaattttgtgaggctttttgcgaactgtgcacaaggcccgaggtctatttcctgctagtacagatcagcaaaaataaggaatatctggacgctaacgacttgatgctgttccttgaggctgaacagggggtaacacatataacagaggacatttgcctggacatcattaggagatacgagctttctgaagaaggccgtcagaagggttttctggccatcgacgggtttacccagtatctgttgtcatcagaatgcgacatctttgaccctgaacagaagaaggtcgctcaggacatgactcagcccctaagccattattatattaacgccagccacaacacctatctgattgaggatcagtttaggggaccagccgacataaatgggtacatccgcgctcttaagatgggctgcaggagcgtggagcttgacgtctcagacggcagtgacaacgagcctatcctgtgtaatcgcaacaatatgactacccacgttagcttccgatccgtcatcgaggtcatcaataaattcgccttcgtggcgtcagaataccccctgattctgtgtctcggtaaccactgtagtctgccacaacagaaggtgatggcacagcagatgaagaaggtgtttggaaataaactgtacaccgaagcccctcttccgagcgaaagctatctgcccagccccgagaagctgaaaagaatgatcatcgttaagggtaaaaaactgcccagcgaccctgatgtcctggaaggcgaggttactgacgaggacgaggaggccgaaatgagcagacgaatgtctgtggactacaacggggagcaaaaacaaatacgcctgtgcagagagctgagcgatctcgtgtcaatttgtaaaagcgtgcagtaccgggattttgaactctctatgaagagccaaaactactgggagatgtgctccttttctgaaacagaagccagcaggatcgcgaatgaataccccgaggattttgtcaactataataagaaattcctgtctagaatctatccatcagcgatgcggattgactcttccaacctgaacccgcaggacttttggaattgtggatgccagattgtcgccatgaactttcagactccaggacctatgatggatttgcacacgggctggttcctccagaacggaggatgcgggtacgtcctgcggccatctattatgcgcgatgaggtgtcatactttagcgcgaacacgaaagggatcctgccaggtgtcagccctctcgcactacatatcaagattatttccgggcagaatttccccaaacccaaaggagcctgcgctaagggggacgtaattgatccctacgtgtgcatcgagattcacggcatccccgcagactgctcagagcaaagaactaaaactgtacagcaaaatagcgataatccgattttcgacgagactttcgagttccaagtcaacctccccgaattggctatgataagattcgtggttctcgatgacgactacataggagacgaattcattggacagtacactattccatttgaatgcctgcagcccggataccggcatgtgcccctgaggagctttgtgggagatatcatggagcatgtgaccctttttgtacatatcgctatcactaataggtctggaggcggtaaggctcaaaaacgcagtctgtccgtcaggatgggcaagaaagttcgcgagtataccatgctccgcaacatcggtttgaaaactattgacgacatcttcaaaatcgcagtgcatccactcagggaggccatcgatatgcgggaaaacatgcagaacgccattgttagtatcaaagagctgtgcggcctccccccaatagcttcactaaaacaatgcctgctgactctgtcttcccggctgattacgagcgataatactccctccgtatccttagttatgaaggactcttttccctaccttgaacctcttggagctattcccgatgtgcagaaaaagatgctcaccgcgtacgacttgatgatccaggaatccagattcctaatagagatggctgatacagtgcaagagaaaatagtgcaatgtcaaaaagccggaatggagtttcacgaggaactccataatctaggggcaaaggagggcctcaagggaagaaaactgaataaggcaacagagtcgttcgcctggaacatcaccgtgttgaaagggcaaggtgacctgttgaaaaatgcaaaaaacgaggccatcgagaatatgaaacaaatccagttggcatgtctgtcttgtggattgagcaaggccccatccagttccgcagaggccaaaagtaaaaggtcacttgaggccatcgaggaaaaggagagctctgaagaaaacggcaagctgtag

SEQ ID NO: 30166 - DNA, 543 bp, Artificial Sequence
  Description of Artificial Sequence: Synthetic coding sequence
atggaacagcctaaaggggtcgactggactgtaattattttgacatgccagtacaaagatagcgtacaggtctttcaaagagagttggaagtccgccaaaaacgagagcagatccctgcaggcaccctattgctcgctgtcgaggatcccgagaaacgggtgggcagcggcggagcaactttaaatgcactactggtggctgctgaacatctgtcagcaagggctggcttcaccggcagagattttccatttgacgactgcggtcgtgcattcacgtgcctgccagtcgagaaccccgaggctcccgtggaggcactggtatgcaatctggattgtctcttggacatcatgacctacaggttgggccctggatccccgccaggcgtctgggtatgttccacggatatgttgctttcagtgcctgccaatcctggggagcctgagaccacatgggactgtttgccctcttcacagccccagcaagaagctagtagcgctctcctggcgcacccagcaagcggaccagccccattgccgtattag

SEQ ID NO: 30167 - DNA, 429 bp, Artificial Sequence
  Description of Artificial Sequence: Synthetic coding sequence
atgaatgaagtggttcacacatctcctaccataggaagcaatgttgaggagatcgtaattaacaatactcgttttttgatgtgggacattggcggacaggaatcgttaaggtccagctggaacacatattacaccaatacggaattcgtgatcgtagtagtggactcgaccgatcgggaaaggatatctgtgacccgggaagagctgtataaaatgctggcccacgaggacctgagaaaagccggtttgttaattttcgcaaataagcaggatgtaaaggagtgtatgaccgtcgcggaaatcagccagttcctgaagcttactagcatcaaggaccaccagtggcatattcaggcctgttgcgcccttactggcgagggcctctgtcagggtttagagtggatgatgtccagactgaagatccgctag

SEQ ID NO: 30168 - DNA, 342 bp, Artificial Sequence
  Description of Artificial Sequence: Synthetic coding sequence
atggaaggggttttgtacaagtggacaaattacctatccggctggcagccaagatggttcctgctttgcggtggcatcctatcttactatgactctccggaagacgcttggaaagggtgcaaaggctctattcagatggctgtttgcgagatacaggtacactccgtcgataatactaggatggatctgatcatacctggggaacagtacttttacctcaaggcaagatcggtcgccgaacggcaacggtggctggttgcactgggttcagccaaagcctgccttactgattcccgcacacagaaggaaaaaggcaatctgctcaagactctgaagacttag

SEQ ID NO: 30169 - DNA, 1119 bp, Artificial Sequence
  Description of Artificial Sequence: Synthetic coding sequence
atggcatctaaccataagtcttctgcagcacgccctgtgtcgagaggaggcgtggggctcaccgggcgtcctccatcagggatcaggcctctttccggaaatattcgggttgccactgcaatgccaccaggcactgcacggccaggatcgagaggctgtcctataggcactggcggtgttctgtcctcccaaatcaaagtggcccacaggcccgtgacacagcagggcctgaccgggatgaaaactggaactaaaggtcctcaaagacagatccttgacaagtcgtattacctgggcctgctgcgctctaagatcagtgagctcacaacggaagtgaacaaactgcagaagggtatcgagatgtacaatcaggaaaactccgtctatctctcatatgagaagagggcagaaacattagctgtagagattaaagagctacaaggtcagctcgccgactacaacatgctggtggataagttgaacaccaacaccgagatggaggaggttatgaatgactacaatatgctgaaggcccaaaatgatcgggagactcagagtctggatgtcatctttacagaacgacaagcaaaagagaagcaaattcgaagcgtggaggaggagatcgagcaagaaaaacaagcgaccgatgatattatcaaaaacatgtcattcgaaaatcaggtgaagtacctggaaatgaaaaccaccaacgaaaaactacttcaggagcttgacaccctgcagcagcagctggacagtcagaatatgaagaaagaaagccttgaagccgaaattgcccacagccaggttaagcaagaggcagttctcctccacgagaagctgtacgagctggaatctcatagggatcaaatgatcgcagaggataagtccattggcagccccatggaggagagagaaaaactgctgaagcagatcaaagatgataatcaggaaatagcaagtatggagagacagcttactgacaccaaggagaagattaaccagttcattgaggagatccggcaactggacatggatttagaggaacaccaagatcccactaactacgggtggaagatactggagaagaacacaggatcatttaaaaagcaggtatag

SEQ ID NO: 30170 - DNA, 345 bp, Artificial Sequence
  Description of Artificial Sequence: Synthetic coding sequence
atgtggtccctgaccgccagtgagggtgagtcaacaaccgcccacttctttctgggtgctggcgacgagggactgggaactagggggatcggcatgcggccagaagagtcagattcagaactcctggaagatgaagaggacgaagtgccccctgaaccgcaaatcatagttgggatctgcgccatgacgaagaagagtaagagtaagccgatgacacagatcctcgagaggctgtgccgttttgattatctgactgttgtgattctcggcgaagatgtgattctgaacgaaccagtggaaaactggccctcttgccattgcctcatatcatttcacagcaagtag

SEQ ID NO: 30171 - DNA, 327 bp, Artificial Sequence
  Description of Artificial Sequence: Synthetic coding sequence
atggcgatggccccttctcctagtttagtgcaagtatatacaagtcctgccgcagtggctgtctgggaatggcaggacgggctcggaacttggcatccctacagtgccactgtgtgttcttttatagaacagcagtttgtacagcagaaaggtcaacgtttcggactcggtagtctggctcactcgattccactcggacaggctgatcctagtcttgctccctatattattgacctacccagctggacccaatttagacaggacactgggacaatgcgggctgtccggaggcacctgtttccgcagcattcagcgcctgggaggtag

SEQ ID NO: 30172 - DNA, 549 bp, Artificial Sequence
  Description of Artificial Sequence: Synthetic coding sequence
atgcgggagtgcatctcaatccatgtaggacaagctggggtacagatcggcaatgcgtgctgggagctgtattgtctggaacatggtatccagccggatgggcagatgcctagcgacaagactatcgggggaggcgacgattccttcaacactttcttttcagagacaggcgctggcaagcatgtgccgcgagcagttttcgtcgacctagagccgactgtgattgattggtgccccacagggtttaaggtaggcattaactatcagcccccaacagtggttccaggaggcgatctcgcaaaagtgcaaagggcagtgtgtatgctttccaatactactgccatcgcagaagcctgggcccgtctcgaccataagttcgatctcatgtatgcaaagcgtgcttttgttcactggtacgtaggtgagggcatggaagaaggagaattctcagaggcacgcgaggatatggcagcgctggaaaaagactatgaggaggtgggtgtggacagtgtcgaaggggaaggcgaggaggagggggaggagtattag

SEQ ID NO: 30173 - DNA, 483 bp, Artificial Sequence
  Description of Artificial Sequence: Synthetic coding sequence
atggaagcggagaggcctcaggaagaagaagacggtgagcagggcccaccacaggacgaggagggctggcctccgcctaactcaaccacacgcccttggcgttcggctcctccctcgccccctcctcctggtacgcgtcacacagcactcggccctcggtctgccagcctgctgagtctgcagaccgagctgctcctagatctggttgcagaagcacagagccgcaggcttgaggagcagagggcaacgttttatacgccacagaacccaagctctctggctcccgctcctctccggccactggaggatagggaacaactctacagcactatcctgtcgcaccagtgtcagcggatggaagctcagcgctccgagcctcccttgcccccaggcggtcaggagctgcttgaactgctgctgagagtccagggagggggtagaatggaagaacagagatccagacctcccacccatacctgctag

SEQ ID NO: 30174 - DNA, 3483 bp, Artificial Sequence
  Description of Artificial Sequence: Synthetic coding sequence
atggcttgccggaggaggtatttcgtcgagggtgaagctccttcctcagagaccggaacctccctagacagtccgtctgcctaccctcaaggccctctagtgcccggttcttccctgtctcctgatcattatgagcatacctctgtgggagcttatgggctctacagtgggccacccggtcaacaacagcgcactaggagacccaagttgcagcactctacatctatacttcgcaaacaagctgaggaagaggccatcaaacgctctaggagtctcagcgagtcatacgaactgagttctgacttacaagacaagcaggtggagatgctagaaaggaagtatgggggtcgactcgtaacaaggcatgcagctcgaacaatacagacagcatttcgacagtaccagatgaacaagaacttcgaacggctgcgctcctctatgtctgagaacagaatgtcccggcgaattgtgcttagcaacatgaggatgcagttttctttcgagggccctgaaaaagtgcatagctcttactttgaaggtaaacaggtcagtgtaacaaacgatggctcacagctcggcgctttagtgtcgcccgagtgtggggacctctcagagcctaccactctgaagtcacccgcaccctcttcagattttgcagacgcaatcacagagctggaggatgcattcagtcgccaggtgaagtctctggcggagagcattgacgatgctttgaactgccgatccctgcacactgaggaggcgccagcgctggacgcagccagggcccgagatactgaaccgcagaccgccttacacgggatggaccacagaaaacttgatgaaatgacagcgtcatattctgatgtcacgctctacatcgatgaggaggagctttcccctccactgcctctatcccaagctggcgaccgcccatccagcaccgagagtgatctccgactgcgcgcaggaggggcagctcccgactactgggcgttagcgcataaggaagataaggctgatacggacacgagctgcaggtcgactccatctctggagcgccaggaacagcgcttacgggttgaacacctgcctctgctgacaatagagccacccagcgactcaagcgtggacctcagtgatcgatctgagcgcggttctcttaaacgccaaagtgcctacgagagatctctcggcggacagcagggatcccctaagcacggcccacattcaggggcaccaaaaagtctgccacgcgaagagcctgagctgcgccctagaccaccgcgaccgctcgattcgcatctggccattaatggcagtgctaaccgacagagtaagagcgagagtgattattcagacggcgataacgactctatcaactctacctctaactcgaacgataccattaattgttcttccgagtcatcatcgcgagatagccttagagagcagacattatcaaaacagacataccataaggaagcacgtaattcttgggatagtcctgcgttctctaacgatgtgatccgaaagcgccactatcgaatcgggctcaatctatttaacaaaaagcctgagaaaggtgtgcagtacctgatcgagagaggttttgtacctgatactcctgtgggcgtggcccactttctcctgcagagaaaaggcctgtcacgccagatgatcggagagtttttgggcaatcgccagaaacaatttaatcgtgatgtgctcgattgtgtcgtggatgaaatggacttttccacaatggagctggacgaagcgctgagaaagtttcaggcacatatccgcgtgcaaggcgaagcacagaaggtagaaaggcttatagaggcgttttcacagcggtattgcatctgcaatcccggagttgttaggcagttccgtaaccccgacacaatcttcattctggcatttgctattattctgctgaatacagatatgtacagccctaatgtcaaacccgagaggaaaatgaagctggaggattttattaaaaaccttaggggggtcgacgacggagaagatatacctcgtgagatgttgatgggcatctacgaaaggatcaggaaaagagaactgaaaacaaacgaagaccatgtctcccaagttcagaaggtcgagaagctcattgtaggcaagaagccaatcggcagtctgcacccaggcctcggctgtgtgctaagcctcccacacaggagattagtgtgctattgtcgattgttcgaagtgcccgaccctaacaaaccacagaagctgggcctccaccaacgggaaatatttctgttcaacgatctactggtggtaacgaagatctttcagaaaaagaagaactccgtgacatattcattcagacagtccttcagcctgtatgggatgcaagtgctcctgttcgaaaaccagtattatccaaatggcatcaggctcacatcttccgtccccggagcagatatcaaggtccttattaatttcaacgcaccaaaccctcaagacagaaagaagtttactgacgatctgagagaaagcatagccgaagtgcaagaaatggagaaacatcgcatcgaatctgagcttgagaagcaaaagggcgtggtccggccaagcatgtctcagtgctcaagtttgaaaaaggagtccggaaatgggaccctcagcagagcctgtctcgatgattcctatgcctctggtgaggggcttaaaagaagcgccttgtcatcctctttacgggatctgtctgaggccggtaaaagaggcagaagatcttctgccggatcactggagtccaatgtagagggatcaattatcagtagccctcacatgcgaaggagggccacaagtaccagagagtgcccttcgagacctcaccaaaccatgcccaacagctcctctttgctggggagtcttttcggcagtaagcgaggcaaaccaccgcctcaggcacacttgcccagcgccccagccctcgccacccccccacctacagggggaccagctagccttgcagctctgtgtggttggcctccccctggagccccaaggggcgcagccgcaggacgccacgccagagcatctcaccccgtcctgccccatgccgagccaagccccgtgcctccctcaccccctccaccgcctacaccagcccatcccgctaggacaccagtgccgcctaggccaccatggggaccacctagcctgagagggccatgtccgagacctcctgctgcagcgctcggaccacgtggggctcattcagcaccaccctgggcagctccgtgccctgccgcaccccatcagcagcaggggcaaactcaacggcaccagcacaattgtgtggactccctgggcagaggccctcgtctgcccgaaactccggcacaccatacggggcacgctcgcggaagccctgccgcacaccagacgcgcggaaccagtgtggcaatttcacctctgtgtcccagccgccctaattag

SEQ ID NO: 30175 - DNA, 378 bp, Artificial Sequence
  Description of Artificial Sequence: Synthetic coding sequence
atgaagaaggagcatgtgcttcactgccagttctccgcatggtaccccttttttagaggcgtaacaattaaatcagtcattttgcccttaccacagaatgtaaaggattaccttctggacgacggtacgctcgtcgtttctgggagggatgatccacccactcactctcagcctgactctgacgatgaagccgaagagatacagtggtctgatgacgaaaataccgctaccttaaccgatgcctattggattgctatgaactcgtctttgaagtgtaagaccctgtcagatatcttcctgctgtttaaatctagcgatttcatcacacgtgatttcacacaaccgttcattcactgcacagacgacagccccgactag

SEQ ID NO: 30176 - DNA, 414 bp, Artificial Sequence
  Description of Artificial Sequence: Synthetic coding sequence
atgagtctttttgggacaacctcaggcttcggtacatccggcacaagtatgtttggatctgccaccaccgacaatcataacccgatgaaggatattgaagtgacatcctcacctgatgacagcattggatgcctttcgttctccccaccgacgctgccaggcaattttctgattgccggaagttgggcaaatgatgtgagatgctgggaagtccaggattctgggcagacgattcctaaagctcagcagatgcacacaggccctgttcttgatgtgtgctggtctgacgacggctcaaaagtgttcaccgcctcatgcgataagaccgcaaagatgtgggatttaagcagtaaccaggctattcaaattgcacagcatgatgcaccagtcaaaaccatccactggattaagtag

SEQ ID NO: 30177 - DNA, 3222 bp, Artificial Sequence
  Description of Artificial Sequence: Synthetic coding sequence
atggaggaacgcaagcatgagactatgaaccctgcacacgtactgttcgataggttcgtccaggccacaacatgtaagggcacattgaaagctttccaggagttgtgcgaccatctcgaacttaaacctaaagattatagaagcttctaccataaactgaaatccaaactaaactattggaaagcgaaggccctttgggctaagttggataagagagggagccacaaggactacaaaaaagggaaggcctgcacgaacactaaatgcctgattattggggcagggccttgcggcctgagaacagccatcgacttatctcttctgggggcaaaagtggtagtaattgagaagagggacgccttcagcagaaacaacgtactccacttatggccatttaccatacacgacctgcggggtctcggggcaaagaaattttacggcaagttttgtgcaggcgcaatcgatcatataagcattcgtcaactccaactgatcctgctgaaagtggccctcatactgggaatcgagatccacgttaacgtcgaattccaggggctaatacagcccccagaggatcaggagaacgagcggatcggctggagagcactagttcaccctaaaactcaccctgtgagtgaatatgaattcgaggtgattattgggggagatggtcgacggaacaccctggaggggttccgcagaaaggaattccggggaaaactagctatcgcaataaccgctaacttcattaaccggaacactactgctgaagcaaaggtggaggagatctccggggtggcctttatatttaatcagaagttcttccaggagctgagagaggccactggaatcgacttagagaatatagtgtactataaggatgatacccactacttcgtcatgactgcaaagaaacagagcctgcttgataaaggcgtgatcttacatgattatgctgacacagagctgctgctctctagagaaaatgtggaccaggaggcactcctttcctacgctagagaggccgctgactttagcactcaacagcagcttccttcccttgacttcgcaattaaccattacggacaacctgatgtggcgatgttcgactttacctgcatgtatgccagcgagaatgccgctcttgtgcgcgagcaaaatggccaccagcttttggtggcccttgttggcgatagtctcttagaacctttttggcccatgggaaccggcatcgccaggggcttcctggcagccatggactcagcctggatggtacgcagctggtctcttgggacaagcccactggaagtgctcgcagagagggagagtatatacaggctgttaccccagacgactcctgaaaacgtgtcgaaaaacttttctcagtatagcatcgacccagttacgaggtacccaaatatcaacgttaattttctgcgcccttctcaggtgcgtcacctgtacgatacaggcgaaacaaaggacatccatctggaaatggaatctctcgtcaactccaggacaactccaaaattaactcgaaatgagagcgtggctcggagctctaagttactgggctggtgccagagacagaccgatggatacgcaggcgtgaatgtgactgacctgaccatgagttggaagtctggtcttgctctgtgcgccataatccatcgctaccgcccagacctaatcgattttgacagcctggacgaacagaatgttgagaagaataatcagctggcatttgacatcgccgaaaaggaattaggaattagcccgatcatgaccggaaaagagatggcaagcgttggagagcccgataaactgtccatggtgatgtacctgactcagttttatgagatgtttaaagactcccttccttccagcgacacccttgacctgaatgctgaggagaaagctgtactgatcgctagcacacgttcacctattagctttctttcaaaacttgggcagaccatttcccgcaagcgatccccgaaggacaaaaaggaaaaggatctcgatggggcaggaaagaggcggaagacaagccaaagcgaggaagaagaagctccaagaggacaccgcggagagagaccgaccctcgttagcacactgacagatagacgcatggacgtcgctgttggcaaccaaaataaggtgaagtacatggctacacaactactagccaaatttgaggagaacgcccctgcacagtctattgggatcagacgccagcagcgggaaaaggagtgttcgagaacatgtcctaaaaaggtgataaccctgagccctcctcccacgccaccgccttgtcgggcacatgggggacagcagacttaccgcgacctcgacgctgacaatcgcggaaagcagtctccccaccatgaaagacctgaacccgaaccaccacgcagattctttgtggatcagtgggagctctccctctcgctgagatcatccgctcgcccagccagcccgagctctgattcactgcgacagaagtacattaagatgtatacaggcggagtctctagtctcgccgagcagattgcaaatcagttgcagcgtaaggaacagcccaaggcactgctggacaagaaagaactcggctccatgaagaaagagtttccccaaaatctgggcggttcggacacttgctacttttgccagaagagagtttatgtcatggaacgactatcagctgaaggcaagttttttcatcgttcatgctttaagtgcgagtactgtgcgacaaccctgcggctcagcgcctatgcctacgatatagaggatgggaaattttactgcaaacctcactactgttaccggctgtcagggtatgcccagcgtaaacggcctgccgtcgcaccattatctggcaaggaagccaaaggtccactccaggatggggctaccaccgatgctaacggacgggcaaatgcggttgcgagcagcacagagcggacacctggaagccttaccagtctcttcggatgggtggccaggcactccttggggctgtgcgataaagcgaaaggaatgagtcaacatctgcagtccaatatctcgtcctttggccaacaggtagcgcaaaacccactcgacagtttttttatgtgccagctcctcgcatttggagtcccattcttatacgggctatccgaagtcctggtgcagatccgcggagagtttcactggcaagcagtcgcacagtag

SEQ ID NO: 30178 - DNA, 543 bp, Artificial Sequence
  Description of Artificial Sequence: Synthetic coding sequence
atgtttctaagctgcggatcactgcaccaaagaggtcccgagaccgacggcactgtgttccgcattcatacaaaggctgagggattcatggatgtagatatccccctggaactagtattccacctccccgtcaattatccatcctgcctgcccggaatctcaatcaattctgaacagctgacccgcgctcagtgtgttaccgtgaaggaaaatcttctagagcaggctgaaagtttactttcagagcccatggttcacgaactggtgctgtggattcagcagaacctcaggcatatcttgagccaacctgagaccggctcaggaagcgagaagtgtacctttagcacaagcaccaccatggatgacggtctgtggatcaccctgctgcatcttgaccatatgagagcaaagacgaagtatgtgaaaattgttgagaagtgggcttccgacctgcggctgacaggcagactgatgttcatggggaaaattatcctgatcctgctgcagggcgaccgcaataacctgaaagttcccaagagttag

SEQ ID NO: 30179 - DNA, 1521 bp, Artificial Sequence
  Description of Artificial Sequence: Synthetic coding sequence
atgaaaaggagatccgtcaccatgaccgacggcctcaccgctgataaagtgacacggtctgacggatgtcccactagtacctcactccccaggccgagagattctatccgatcctgcgccctgagcatggaccagatcccagacctacactcacctatgagtcccatcagcgagtcgccctcatctccagcctactcaaccgtgacccgcgtgcatgcagccccagctgccccttctgcgaccgctctaccagctagccctgtggcacgaagaagcagcgagccacagctctgtcctggttcagcccctaagactcacggtgaatccgataagggacctcataccagcccgtcccatacattgggaaaggcgtccccctctccttcgctgtcttcctactcagacccagactcaggccactactgtcagctgcagcccccagtgaggggcagccgggagtgggctgcaaccgaaacaagttcacagcaagcccgatcctacggtgagcgactaaaagagctcagcgaaaacggcgctccggaaggcgactgggggaagacgtttaccgttcccatcgtcgaggtgacatcctccttcaacccggctacctttcagtccctactcatcccaagagacaatagacccctggaggtgggcctcctccgcaaagtgaaggagctgctggccgaggtcgacgcccgtaccctggcacggcatgtcaccaaggtggattgcctggtggccagaatactgggagttacgaaagagatgcagaccttaatgggcgtccggtgggggatggagctgctgacgctgccccatgggaggcagctgcgtctggatctgttagagcgctttcacacaatgagtatcatgttggctgtcgacatccttgggtgcaccggcagcgcagaagaaagggcagcccttttacataaaactattcagctggctgccgaacttcgtggaacaatggggaacatgttttctttcgccgctgtgatgggtgctctggatatggcccagataagtagactggagcagacctgggtaacattaaggcaacgccacaccgaaggcgcaatactctatgagaagaagctgaaaccattcctaaagtcgctgaatgaggggaaggagggcccacccctctccaacaccacattccctcatgtgctgccgttgataactctcctcgaatgtgacagcgccccacctgaggggcctgagccttgggggtcgacggaacatggtgtggaggtggtgttggcccacttagaggccgctcgcacagttgctcaccacggagggctctaccatactaatgccgaggtcaagctccagggctttcaggctcgacctgagctgcttgaagtcttctcaacggaattccaaatgcgactcctgtggggcagtcaaggagctagtagcagtcaggctagaagatatgaaaagttcgacaaagtcctgaccgctctttcacacaaactagagcctgctgttcggtccagcgaattatag

SEQ ID NO: 30180 - DNA, 369 bp, Artificial Sequence
  Description of Artificial Sequence: Synthetic coding sequence
atggcgacatctgcaccactgaggtctctggaggaggaggtcacatgctcaatttgcttggactatcttcgggacccggtgacaatcgactgtggtcatgttttctgcagatcttgtacaacagatgtgagacccatctcaggctccaggcctgtatgtccactgtgcaaaaagccatttaagaaggagaacatccggccagtgtggcagctggcttctctggtggaaaatatagaaagattaaaggtcgacaagggcaggcagccaggggaggttaccagggagcagcaggatgccaaactgtgtgagagacatagagaaaaactgcattattattgtgaggacgatgggaaactgctatgtgtctag

SEQ ID NO: 30181 - DNA, 369 bp, Artificial Sequence
  Description of Artificial Sequence: Synthetic coding sequence
atgcccgagataaatacaaaccatctggacaaacaacaggtacaactcttagccgagatgtgcattctcatcgacgagaacgacaataagatcggagccgagaccaagaagaattgccacctcaacgagaacatagaaaagggcctcctgcatagagccttctcagtattcctgttcaataccgaaaataaactcttgctgcagcagaggtctgacgccaagataacattccccggatgcttcactaatacctgttgctcacacccactctcgaatcctgccgaactcgaagagtccgacgcactcggcgtccgacgggctgcccagagacggctcaaggccgagcttggaattcctctcgaggaatag

SEQ ID NO: 30182 - DNA, 408 bp, Artificial Sequence
  Description of Artificial Sequence: Synthetic coding sequence
atggccgctctgagaccgctggtgaagccaaaaatcgtgaaaaagaggactaaaaaattcatccggcatcaaagcgaccgctatgtcaaaataaagcgcaactggcggaagcccagaggcatcgacaaccgggtcaggaggcggttcaaaggtcagatcctcatgccgaatatcggctatggaagcaataagaagacaaaacacatgttgccttctgggtttagaaaattcctggtccacaacgtgaaagagctggaagtgctgctcatgtgtaacaaaagttactgcgcagagatcgcccacaacgtgtcctctaagaatagaaaggccatcgtcgaaagggcggcacagctggccattcgggtcactaatcccaacgctagactgcgaagcgaggagaatgaatag

SEQ ID NO: 30183 - DNA, 3282 bp, Artificial Sequence
  Description of Artificial Sequence: Synthetic coding sequence
atggggactggcgattttatttgcatcagcatgactggcggagccccttgggggtttaggctacaaggagggaaagagcaaaaacaacctctgcaggttgccaagatccgtaatcaaagtaaggcttccggaagtgggctttgcgagggcgatgaggtagtgagcatcaatgggaacccttgcgccgatcttacttatcctgaggttattaagcttatggaatctatcaccgattctctgcagatgcttataaaaaggccctcgtccggtatcagcgaagctctcatatctgaaaatgaaaataagaatcttgaacacctgacgcacggcggttacgtcgagtctaccactctgcagatccgccctgccaccaagacccaatgcaccgagtttttcctggcccctgtcaaaactgaggtaccactggccgagaaccagcgatcaggcccagattgtgcagggtccttgaaggaggagacaggacccagctatcagagggcccctcagatgccagactctcagcgcggacgggtggcagaggaactcatcttgcgcgaaaaggtcgaagccgtgcagcccggtccagttgtcgagctgcagctgtccctcagccaggaacgccataagggggcatccggcccacttgtcgcgctgcctggcgctgagaagtccaaaagtcccgacccggacccaaacctaagccatgacaggattgttcacattaacagtattccgacaaatgagaaggccgatccttttcttcgcagcagcaaaatcattcagatctcctctgggagggagctaagagttatccaggagagtgaggcgggagatgctgggttgcctcgagtggaagtgatactggactgttcagatcgccagaaaacggaaggctgcaggcttcaggccggaaaggagtgtgtggactctccggtggagggcggacaatccgaagctccaccctctctggtatcctttgcagttagctctgagggtaccgagcagggagaggaccccagaagtgagaaggaccatagccgcccacataagcacagagccagacatgccagactgagaagatcagagtccctgtctgagaaacaggtaaaggaggccaagagtaaatgcaaatctatcgccttgctcttaacagatgccccaaatcccaactctaagggtgtgctgatgttcaaaaaacgcaggagacgcgctagaaaatatacactggtgtcctacggcaccggggaactggagcgcgaagcggacgaagaggaagagggagacaaggaagatacatgtgaagtcgccttccttggggcatccgagtcggaagtggatgaagagctcctgtctgacgttgacgacaacacccaagtggtcaatttcgactgggatagcggactagtggatatagaaaaaaagctaaacaggggcgataaaatggaaatgctgccagacaccacaggcaagggggctctgatgttcgctaagagacgggaaagaatggaccagatcacggcgcaaaaagaagaggataaggtagggggaaccccctctagagagcaagatgcggctcagacggacggactgcggacaactacaagttaccaacgaaaagaagaggagtctgtcaggacacagagttctgtgagcaaatcatatatcgaagtcagtcacggactgggacatgtgccccagcagaacgggttctccggcacaagcgagacagcgaacattcaaaggatggttcccatgaaccgcacagctaagcccttccccggatctgttaaccaaccagcgaccccattcagcccaacccgaaacatgacatcaccaatcgcagacttccctgcccctcccccttatagcgccgtgacccctccccctgatgctttctcacggggagttagttcaccaatcgcagggccagcgcaacctcccccatggccccagccagccccttggagtcagcctgctttctatgattccagtgagaggatcgcatcccgcgacgagcggatatccgttcctgccaagaggacaggtatccttcaggaggctaaacgcagatcaacaaccaagcccatgttcacatttaaggaacccaaagtgtctcccaaccccgaattactcagtctcttgcagaatagcgaagggaagcgcggtacaggcgctgggggagattccggccctgaggaggactatctgtccctaggggctgaagcctgtaacttcatgcagagtagctcagccaagcagaagacgcccccacctgtggcccctaagccagcggttaagtcaagttctagccagccagtgaccccagtgtccccagtgtggtcccccggagtggctcccacccagccacctgccttccccacctcaaatccatctaaaggtacagtggtgagttccattaaaattgctcagccatcctacccgccagccagacctgcatcaacacttaatgtagccggtccctttaagggccctcaggcagccgtggcatcccagaactacaccccaaagcctactgtgtccactcctactgttaacgcagtacagccgggtgccgtcggacctagcaatgagcttcctgggatgagcgggaggggggcacagttgtttgccaagcgacagagtcgcatggagaagtatgttgttgacagtgacactgtgcaggcacatgctgccagggcccaatccccgacaccatcactgccagcttcgtggaagtacagctctaatgtgcgggcaccaccccctgtggcatataatcccatccactctccctcataccccctggccgcactcaaaagccagccatcagccgctcagccctctaaaatggggaaaaaaaagggtaagaagcccctcaacgccttggacgtgatgaaacatcagccctaccagctgaatgcgagcttgttcacattccaaccacccgatgccaaagacggcttgccacagaaatcgtccgtgaaagttaatagcgcactcgcaatgaaacaagctcttccacctagacctgtaaacgcagcctccccaaccaatgtccaggcaagttctgtttatagcgtgcccgcttacaccagccctccatcattttttgctgaggcgtcatcccctgtgtccgctagtccggtccccgtaggcatcccaacatctccgaaacaggagagcgctagtagtagttactttgtggcacccagaccaaagttctccgccaaaaaatctggcgtcaccatccaagtttggaagcctagcgttgttgaggagtag

SEQ ID NO: 30184 - DNA, 600 bp, Artificial Sequence
  Description of Artificial Sequence: Synthetic coding sequence
atggcaattgtccagactcttccggtgccgctggagcctgcacccgaagcggcaacagcaccccaggcaccggtgatgggcagtgtgtcctcccttatcagtggccgtccctgccctggtggacctgcccctcctaggcatcacggaccccctggaccaacattctttcgccagcaggacgggctactgcgcggagggtacgaagcccaggagccactgtgtccggctgtgcctccaagaaaggcagtccctgtgacaagctttacctacataaatgaagatttccggactgagtccccacctagcccttcgagcgacgtggaggacgctcgcgaacagcgagctcacaacgctcacctgcgcggaccgccacccaagttgatcccagtaagcggcaaactcgaaaagaatatggaaaagatcttgatcaggcctaccgccttcaaaccagtactgccaaaaccacggggagcaccctctctccctagttttatgggaccgagggccacaggcctcagtggaagccagggaagtcttacacagttatttggagggcctgcttctagttcgagcagttccagcagttcatccgccgcttag

SEQ ID NO: 30185 - DNA, 612 bp, Artificial Sequence
  Description of Artificial Sequence: Synthetic coding sequence
atgccctccacgccagcgtctactatatctgccagggaggagcttgtacagcggattcctgaagctagccttaacttccagaaagtgcccccaggatccctgaacagtagagattttgatcaaaacatgaacgatagctgtgaagatgccttagcaaataaaactagaccgcgaaaccgcgaagaggttatcttcgacaacctcatgctgaatccagtgtctcagctcagccaggcaatccgtgaaaataccgaacacctagccgaaaagatgaagatcctgtttcagaacacaggcagggcatgggaagatctggaggcgagaatcaacgctgagaatgaagttcccatcttaaagacttcaaataaagagatctcttcaatactcaaagaactccgtcgagttcagaaacagctagaggtcatcaacgccatcgttgacccatcaggatctctggatctgctgttacccactcttagctcatttgtgcctccaccccctgctttcgcgtgggagctggtcctggtctgtagggccagtcgtagagttcactgcacctttgtgttaaggtggtcatgtggttgcttaagtgaaaatggttatttcatttag

SEQ ID NO: 30186 - DNA, 321 bp, Artificial Sequence
  Description of Artificial Sequence: Synthetic coding sequence
tagcccacaacaagccgcccagcactcgacgtcaagggcggaacctcaccggctaaggaggacgccaaccaggaaatgtcaagtgtggcgtatagcaatctggccgtaaaggaccggaaagccgtggccatcctccattacccgggtgtggcaagcaatgggacaaagagccctgcgattatagactccgatcctgtcgatgaagaggtcctcatgtctttggtcgtagaactgggactcgatagggcgaatgagctgcccgagctgtggctgggtcagaatgagttcgactttacggctgattttccctccagttgctag

SEQ ID NO: 30187 - DNA, 456 bp, Artificial Sequence
  Description of Artificial Sequence: Synthetic coding sequence
atggcagcctttagagacatcgaagaggttagtcaaggactgttatcgctgctaggagcaaatcgtgccgaggcacagcagagacgattattgggtagacatgaacaggtggttgaaaggttgctagagacacaagacggtgcagagaagcaactgcgcgaaatccttacaatggagaaagaggttgctcagtcgctgctgaatgccaaggagcaggagagacaagagaaggaggtagacgaggacacgaccgttaccattcccagcgcggtgtatgtggcacagctgtaccaccaggtcagcaaaattgaatgggactatgagtgcgaacccggaatggtgaaaggaatccaccacggaccatcagtcgctcagcctatccaccttgactccactcagctatcccgcaagtttatatctgattatctctggagcctcgtggacacggagtggtag

SEQ ID NO: 30188 - DNA, 444 bp, Artificial Sequence
  Description of Artificial Sequence: Synthetic coding sequence
atgctacgctgcggccaaatgatatttgcacaggccctcgtctgtcgacacctgggaagagactggaggtggacccagagaaagaggcagcctgactcctacttcagtgtgttgaacgcattcatcgacagaaaagatagttattactcaatccatcaaatagcccaaatgggcgtcggggaggggaagtccatcgggcagtggtatggacccaatacggtggcccaggttctcaagaagctggctgtgttcgatacctggagttcattagccgttcacatagcaatggacaacaccgtagttatggaagaaatcagaaggctgtgtcgcacatctgtgccctgtgcaggagcgacagcctttccagctgattctgaccgccactgcaatggatttcccgctggagcggaggtgactaataggccttccccatggcgcccttag

SEQ ID NO: 30189 - DNA, 1482 bp, Artificial Sequence
  Description of Artificial Sequence: Synthetic coding sequence
atggaaaaatacgaaaacctggggctggtgggagaaggaagctacgggatggtgatgaagtgcaggaacaaggataccggacgtatagtggcaataaagaaattcctggaatccgatgacgataagatggtgaagaaaatcgccatgagggagattaagttacttaagcagctgcgtcacgagaatttggttaatttattagaagtgtgcaaaaaaaagaagaggtggtatctggtctttgagttcgtggaccacaccatcctggacgacctggagctgttccctaacggactggattaccaggttgtgcagaagtatttgttccagattataaatggcatcggtttttgccattcacacaacattattcatagggacattaagccagagaatatccttgtgagccaaagtggggtcgtcaaactctgcgacttcggctttgctcgtaccctggcagctcccggtgaggtctacacagactatgtcgccacacggtggtacagagccccagagctcctggtcggggatgtaaagtacggcaaggccgtggatgtgtgggccatcggatgcttggttaccgagatgttcatgggagagcctctattcccaggcgattcagatatcgatcagctgtaccatattatgatgtgcctggggaacctcattcccaggcaccaggaactgttcaacaagaatcctgtattcgctggtgtgcgactgcccgaaataaaagaaagggagcctctggagcggcgataccctaaactgagcgaggttgttatagacctggctaagaaatgccttcacatcgatcccgataaacggccattttgcgcagaactgctgcaccacgatttcttccagatggatgggttcgccgagcggttcagccaagagctgcaacttaaggtccagaaggacgctagaaatgtgtccctgagcaagaaatcccagaatcgtaaaaaggaaaaggaaaaggacgattcactggttgaggagcgcaagaccctggtcgtgcaggataccaacgccgatcccaagatcaaggactacaagctgtttaagattaaaggatccaagatcgacggggagaaggcagagaaggggaatagggcatccaacgcctcctgtttacatgacagccgtacgtctcataataagattgtgccctccacaagcctcaaagactgcagcaacgtgtcggttgaccacactcgcaatccatctgtcgctattccaccattgactcataacctgagcgcagtggcaccgtctatcaattccgggatgggtaccgagacaattcctatccagggatatcgtgttgatgagaagaccaaaaagtgctccattccgtttgtaaagccgaaccgtcactccccctccgggatctacaacattaacgtgacgactctggtgagcggccctcctttgtcagatgactcgggggctgacctaccgcagatggagcatcagcattag

SEQ ID NO: 30190 - DNA, 6188 bp, Artificial Sequence
  Description of Artificial Sequence: Synthetic coding sequence
atggatggttgtctcgacaccgaaacccccacagtctcaattcaagagaacgtggatgtggccagcctaaaacctatcagcgacagcgggattaactttacagacgctatatggtcccctacttgcgaacgcaggacttgcgagtgccacgaatcaatcgaaaagaataaggataagacagatctccctcagtctgtggtttaccagaacgaggaaggaagatgggttacagatcttgcctactacacctcttttaactctaaacaaaacttaaatgtgtctctaagcgatgagatgaatgaggacttccggtcaggttccgaggctttcgatctgattgcccaggatgaggaagagttcaataaagaacatcagtttatccagccatcctttgggtattttattcgctcccccgaaaaacgggaacctatcgcgctgatcagaaagtctgatgtatcacgtgggaatctggagaaagagatggctcatcttaaccatgacctttattccggggacctaaatgaacaatctcaagcccagctctccgagggatctatcacactccaagtagaggcggtggagtctaccagccaggtcgacgagaatgacgtgacactcaccgcagacaagggtaagacggaggacacatttttcatgtccaacaaaccacagcggtacaaagataagttgcccgacagtggggattccatgctgcggataagcactatcgccagtgcaatagctgaggcctctgtaaacacggatcccagtcagctggcggctatgattaaggcactttccaacaaaaccagggacaaaacgtttcaagaagatgaaaaacaaaaggattactctcacgtgcgccactttttgccaaacgatctggaaaagagcaatgggagcaatgccttggacatggagaagtacctgaagaagactgaagtttctcgttatgagtccgccctggagaacttctcacgtgcgtccatgtcagacacttgggacctgagtttgccaaaagaacagaccacccaggatatacaccccgtcgacctctccgctacatctgttagcgtccgcgcaccagaagagaataccgccgctatcgtgtacgtagagaacggagaatctgagaatcaggaatccttcaggactatcaattcctccaattctgtaaccaatcgtgagaacaatagtgccgtggtggatgtgaagacatgctctattgacaataagttgcaagatgtgggcaacgacgaaaaggctacctctatatctaccccaagtgactcctactcttctgtgcgaaaccccaggattacgagcctgtgcctgctcaaagactgtgaagagatcagagacaacagagaaaatcaacgacagaatgagtgcgtctccgagatcagtaatagcgagaaacacgttacctttgaaaatcaccgaatcgtctctcccaaaaacagcgacctgaagaatacctctcccgagcacggagggcgaggaagtgaggatgaacaggaatcattcagacccagcactagccccttgtctcactcctccccttccgaaattagcggcacctccagctcagggtgcgccctagaatcttttggcagcgctgctcaacaacagcagcctccttgtgagcaagagctgtccccactagtgtgtagtcccgcaggcgtgtccagactgacttatgtgagtgaaccagaatccagttacccaaccaccgccacagatgacgctttggaggaccgaaagtctgatataacctccgagctgtccacaaccatcattcagggcagcccagctgctcttgaagagagggcaatggaaaaactgcgcgagaaagtcccattccagaaccgcggtaaggggactttaagctccattatacaaaataattccgatacccgcaaggcaacagagaccaccagcctgtcctccaagccagagtatgtaaagcccgacttccggtggtccaaggacccctcatcaaaaagcggaaatctgctggaaacatctgaggtgggatggacctccaatccagaggagttggacccaatacgtttagccctgctggggaaatccggtctctcgtgccaggtgggatctgctactagtcatccagtctcctgccaagaacccatagacgaagatcaacgaataagtcccaaagacaagtccactgctggtagggagttcagtggccaggtcagccaccagacgacttctgaaaatcagtgcacccctatccctagttctactgtgcatagctccgttgctgatatgcagaacatgccagccgctgtccatgccctgctgacccagccgtccttgtccgcagcccctttcgcgcagaggtacctgggcactctgccttcgactggctctaccactctcccacagtgtcatgccggaaacgccacagtgtgtggattctccggtggcttaccataccccgcagtggctggagagccagtgcagaactcggtggcagtcggcatctgtctgggaagcaacattggatccggttggatgggcacatcttccctttgcaacccctacagcaatacactcaatcagaatctcctcagcactactaaaccttttccggtgccctccgtgggcacaaactgtggcatcgagccatgggatagtggagttactagcggactcggctcagtgcgtgtacccgaggagctaaagttaccacacgcatgttgtgtggggatcgctagtcagacactattaagcgttctgaatcctacggatcgttggcttcaggtcagcatcggagtactctctatatcagtgaatggggaaaaagtggacctgagcacctacagatgtttggtgttcaagaacaaagcaatcatccggccacatgctactgaggagatcaaagtgctcttcattccctcaagtcctggcgtgtttcgctgtacgttcagtgtggcaagttggccctgcagtaccgacgcagaaacaattgttcaggctgaagccttggcgtccacggtaaccttaactgccatcgccgagtcgcccgtgatcgaggtggagacagaaaaaaaggacgttctggactttggggacctgacctacggaggctggaaagcactaccacttaagctaataaaccggactcatgcaactgtgcccatacgtctcatcattaatgccaatgccgtggcctggagatgcttcactttctctaaggagtcggttagagcccctgtggaggtggcaccctgtgccgatgtggtgacaaggctagccggtcctagcgtcgtgaaccacatgatgcccgcatcgtatgatggtcaagatccggaatttctgatgatatgggtgctttttcactcacccaagaaacagatctcatcctcagatatcctcgacagcgctgaagaattcagcgcaaaagtggacatcgaagtcgatagtccaaatcctacccccgtgctgcggagtgtcagcttaagagcacgtgctgggatcgccaggatccatgcccctcgagatctccagactatgcactttttggcaaaagtggcctccagccggaagcagcaccttccactcaagaacgccggtaatattgaagtgtaccttgatatcaaagtccccgagcagggtagtcactttagcgttgaccccaagaatctgctgctaaaacctggcgaagagcacgaagtgatagtttcgttcacccccaaagacccagaggcttgtgaagaaagaattctgaagatctttgtacagcctttcgggccacagtatgaagttgttcttaagggagaggtgatttccagtgggtctaaacctctctcccccggtccatgcctcgatataccatctatactttctaacaagcagttcctcgcctggggcggagtacctctggggagaacacagttacagaagctggccctacgtaacaattcggcttccaccacccaacatctgaggttattaatcagaggacaggaccaggattgtttccagcttcaaaacacatttgggagcgagcaaagactgactagtaattgtgaaatccgaatccacccgaaggaggatatcttcatttctgtcctgttcgccccaactcggctcagttgcatgttagctcgactggagataaagcagctgggcaaccggagtcagcctggcattaaatttaccatacccctgagcggctatggcggaaccagtaatctcatcttagaaggcgtgaagaagttatcagacagctacatggtgacagtcaatggccttgtgccaggtaaggagagcaaaattgttttttcagttaggaataccggctctagggctgcttttgttaaagctgttggcttcaaggacagccagaagaaagtattgctggaccctaaagtcctccgaattttccccgataaattcgtgctcaaggagcgaacacaggaaaacgttactctgatctacaacccatctgaccgtggaatcaacaataaaactgctacggagttatccactgtgtacctcttcgggggagatgagatttcgcgccagcagtacagacgggctctgctgcacaagccggagatgattaagcagatcctgcctgagcacagcgtgcttcagaacatcaatttcgtggaggcattccaggatgagctgctggtgaccgaagtgtacgatttgcctcagcggccaaatgacgtgcagcttttctatgggagtatgtgtaaaattatattgtccgtcatcggggaatttcgggactgtatttcctcaagagaatttctacagccttccagcaaggcctccctggaaagcacgtctgacctgggcgcttccggtaagcacggaggaaatgtgtccctcgatgtgctgcccgttaagggaccccaggggagtccgctcctgtctagggcagcccgacctcccctggatcagctggccagcgaggagccttggacagtattgcctgaacacctgatcttggtggccccttcaccatgtgatatggcgaagacaggacgatttcaaatcgttaataacagtgttaggttactacgattcgaactgtgttggccagcccactgtttgaccgttactccgcagcacggatgtgtagctcccgaatcgaagctccagatcctggtgagccccaattcctccctgagcactaaacaaagcatgtttccatggagcggcctaatatacatacattgtgacgacggtcaaaaaaaaattgtgaaagtgcagatccgagaggacctgactcaggtagagctgctgactcggctgaccagcaaacctttcggaatcctgtctccggtctccgaaccatcggtgagccacctggtcaagcccatgacaaagcccccatccacaaaagtcgagatcagaaataagtcaatcacctttcctacgaccgaacccggtgagactagcgagtcttgtctggagttagaaaatcatgggaccacagatgtaaaatggcacctcagctccctggcccctccctacgtcaagggggtcgatgagagcggagacgtgttccgtgccacgtatgctgccttcagatgcagtccgatcagcgggctgctcgaaagtcacggtatccagaaagtgtctataacattcctgccaaggggcaggggcgactatgcgcagttctgggacgtggagtgccatcccctgaaggaacctcacatgaaacacaccctgcgattccagctgtctgggcagtccatcgaggccgaaaatgaacccgaaaacgcgtgtctgtccacagatagtcttatcaaaatcgaccaccttgtaaaacctcggcgtcaggccgtgagtgaggcctccgcccgaattcccgaacagttggatgtcacagccagaggcgtgtacgcaccggaagacgtgtaccggttcaggccaacctctgtgggggagagcagaacgctgaaggtgaatctccggaacaattcctttattacgcatagcctcaagtttctctctcctcgggaacccttctatgtgaaacactccaaatactcacttcgcgcacagcattacattaatatgccagttcagtttaagccaaagtctgctggtaaattcgaagcactactggtgatacagacagatgaaggcaagtctattgcaattcgcttgatcggcgaggccctcggcaagaatta

SEQ ID NO: 30191 - DNA, 1545 bp, Artificial Sequence
  Description of Artificial Sequence: Synthetic coding sequence
atgagtatcagtagtgacgaagtgaattttcttgtttacaggtacctccaagaatccgggttctctcatagtgccttcacattcggtatcgagagccatataagtcagagcaacatcaacggcgctctcgtgcctcctgcagctctgatctcgattattcagaaaggccttcagtatgtagaggcagaggtctcgattaacgaagatgggacgttgtttgacgggcgaccgatcgagagcctgagtctaatagatgcggtgatgcctgacgtcgtgcagacgcgccagcaggcctatcgcgacaagctggcacagcagcaggcggctgccgcagcagctgcagcggcagccgctagtcagcagggcagtgcaaaaaacggcgaaaacacagctaatggggaagagaatggcgctcatacaatagccaataaccatacagatatgatggaagtggatggggacgtagagattccacctaataaagccgtggtcctccgcggacacgaatctgaggttttcatctgtgcctggaaccccgtcagtgatctgctggccagtggctcgggtgactccaccgcccgaatctggaacctgagcgagaattctacctcaggatctacccagctggtgcttcggcactgtattcgggaaggcggacaagacgtgccaagcaataaagacgtgacctctctggattggaactctgaaggtacgctcctggcgacagggagctacgacgggtttgccaggatctggacgaaggatggaaatctggcctcaacactgggccaacacaaaggccctatctttgcacttaagtggaataaaaagggcaacttcatcctctcagcaggtgttgacaaaaccaccattatctgggatgcccataccggagaagctaaacagcagtttccattccattcagccccagcactggacgtggattggcagtctaacaatacattcgcttcttgttccacagatatgtgcattcatgtgtgcaaactaggccaggacaggccgattaagacttttcaggggcatacgaatgaagtgaatgccattaaatgggatcctaccgggaatctgctggccagctgctcggacgatatgacattgaagatctggagcatgaagcaggacaactgcgttcatgatttgcaagcccataacaaggaaatctacactatcaagtggtccccgactgggcctgggacaaataatccgaatgcaaacctgatgctggcctctgccagtttcgacagcaccgtacgcctgtgggatgtggacagggggatttgcattcacacactgactaagcatcaagagccggtctatagcgtcgcattttcccctgacggccgatatttggcttcaggatcctttgacaagtgtgttcacatttggaacacacagacaggagccctggtacactcctaccggggtaccgggggaatctttgaggtttgctggaatgccgcaggcgacaaggtaggggctagcgctagcgacggatctgtatgtgtgctggatctacgcaaatag

SEQ ID NO: 30192 - DNA, 2034 bp, Artificial Sequence
  Description of Artificial Sequence: Synthetic coding sequence
atggaggagactatgaaactggcgaccatggaagatacagttgagtattgcttgtttttgattcccgatgaaagccgagattcagataagcataaagaaatcttgcagaagtacattgaacggatcatcacgaggttcgcccctatgctggtgccatatatctggcagaaccagccctttaacctcaagtacaaacctggaaagggaggagtgccagctcatatgtttggcgttacaaaattcggagacaatatcgaggatgaatggttcattgtatacgtgatcaagcagattacgaaggagtttcctgagctggtcgccaggatagaagacaatgacggcgaattcctcctgatcgaggcagccgacttcctacccaagtggcttgatcccgaaaactcaactaatagagttttcttctgccacggcgagctctgtattattcctgcccctcgcaaaagcggtgccgaaagctggctccccaccactccaccgacaatcccccaagcactgaacataataacagcacactcggagaagattttagctagcgagtcgattcgagccgcagtaaatcgtcgcatccgcggatacccggagaagatacaggcttctctacacagagcacactgttttctgcccgctggaatcgtggctgtgttgaaacaacggccacgcttggtcgctgctgccgtccaggctttctatctccgagacccaattgatctgagggcctgtagagtgtttaagacatttctgccagagacccgaattatgaccagtgttacgtttacgaaatgcctttatgcgcaactcgtacaacagcgcttcgtgcccgaccgacgctccggttaccggctccctcccccatctgacccccagtatagagcacacgaactggggatgaaacttgcacacggcttcgagatcctgtgctctaagtgcagtcctcacttttccgattgcaagaaatccctcgttaccgcgtcccccctctgggcctcttttctggagtccttaaaaaagaacgactacttcaagggcctgatcgaaggcagtgcacagtatcgcgaacgcctcgaaatggcagagaattatttccagctttccgtggattggcctgagcgcttagaggtgcaatggcgagacccgggtctgctgcaagctcctccgcctggatttacccctttcatatgcctgagtctgctgtcaacctgggacaactcgagccttgccatgagtcctggagaggaaatcctgaccctgctacagacaattccattcgacatcgaagacttgaagaaagaagctgccaatttgccacctgaagatgacgatcagtggctggatctgagccctgatcagctggatcagctgttacaggaagcggtgggtaagaaagaatctgaatcagtaagtaaggaagaaaaggaacaaaattacgacctgaccgaggtgtctgagagcatgaaggcgtttatttccaaagtgtcgacccacaagggggctgagctcccacgcgagcctagtgaggctcccataacttttgacgctgacagctttttgaattactttgacaagattctgggtccacggccaaacgagagcgattctgacgatctggatgatgaagatttcgagtgtctggactcagacgacgaccttgacttcgaaacgcatgagcccggtgaggaagcttccctaaaaggaaccctggacaatttgaagtcatatatggcgcagatggaccaggagctagcccacacatgcatctcaaagtccttcacgactcgtaaccaggtcgaacctgtgtctcagactactgataataacagcgatgaggaggatagcggaaccggggagtccgttatggccccagtggacgtcgatctgaatctcgtaagtaacatactggagagttatagttctcaggccggactggctggccctgcgagcaacctgctgcagtcgatgggagtacagctgccagataacaccgatcataggccaacaagcaagcccaccaagaactag

SEQ ID NO: 30193 - DNA, 1821 bp, Artificial Sequence
  Description of Artificial Sequence: Synthetic coding sequence
atggaagaatctccgttgtctcgggctccaagccggggtggagtgaacttcctcaatgtggctcgaacttatatcccaaatacaaaagttgagtgtcactatacccttccaccaggtactatgccatcagcttctgattggattggcatatttaaggttgaagcagcctgtgtgagagattaccatacatttgtgtggagctcagttccagagtcaactactgatggcagtccaatccacacaagtgtgcaattccaagagcctcggcctatggatgagttagtgacactggaagaagccgatggaggctccgatatactgttggtggtccccaaggccaccgtcctgcagaaccagctggacgagagccaacaggaaaggaacgatctaatgcaactgaagctccagctggagggacaggttactgaactgcggtctcgcgttcaagagctggaaagggccctggcgacggctcgtcaggaacacaccgaactgatggagcaatataaaggcatcagccggtctcacggagaaattaccgaggagcgcgatattctatcgcgccaacaaggtgaccacgttgcccgaattcttgaactagaagacgatatccagaccatctcagaaaaggtccttacaaaggaagttgagctggatcgtcttcgcgatacggtgaaggctctgaccagagagcaggagaagttgctcggccagctgaaggaggttcaggcggataaggagcagagtgaagcggagctcgagcctctgaaggagcagctgaggggggcacaggaactcgccgcatctagccagcagaaggccacattactgggagaggagctggccagcgctgcagccgctcgggatcgtaccattgctgagttgcacaggtctagactggaagtggctgaggtaaacggcaggctggccgaattggggcttcaccttaaggaggaaaaatgccagtggtcaaaggaacgagccggtctattgcaatctgttgaagctgagaaggacaagatcctcaaattgagcgcagagattctcaggctggaaaaggcagtccaggaagagaggactcaaaaccaagtatttaagacggaactggccagggagaaagatagttctctggtccagctgtctgagagtaagagagagctgacagaactgagatccgccctgcgggtcttgcaaaaggaaaaggaacaattgcaagaggaaaagcaggagctattagagtacatgagaaagctcgaagcccgactagaaaaagttgcggacgagaagtggaacgaagacgctaccactgaagacgaggaggctgcagtgggcttgagctgcccagccgctctgacagactcagaggacgagtcacctgaagacatgaggctacccccatatgggctctgcgagcgcggtgatccaggctcttcacctgctggaccgagagaggcttccccgttagtggtgatctcccagcctgctcccattagtccgcacctgtcaggcccagctgaggactcgagctcggactccgaagctgaagacgaaaaaagcgtactaatggccgctgtgcagtcggggggagaggaagccaacctgcttttgccagagcttgggtcggccttctacgacatggcgtctgggttcaccgtaggtactcttagcgagacttcaactggtggcccagcaacgccgacctggaaggagtgccccatttgcaaagaacgctttccagccgaaagtgataaggacgctttggaggaccacatggatgggcactttttctttagtacgcaggacccttttacattcgagtag

SEQ ID NO: 30194 - DNA, 2997 bp, Artificial Sequence
  Description of Artificial Sequence: Synthetic coding sequence
atgaacaggcgcaggaaattcttgttggccagcgtcctggccctgcagaattcttcctttatttatccttcctgccagaaatgtttttctagaattatacttgtcagtaagcgtagcaactgtccaaaatgcggaagtaccggcgagtctggtaacgctaattaccgttataaactctccctgaaggtggccgaatctaacaagctgttcgttatcactgtatttggaagttgtctggatacttttttcggcctgaccgctaccggtcttcataggtatatccaggatccgaataagattccggaaaccttggacaacgatactacacagaatctcttaacgaaggccgtggaaacatgcttcgtaggccagtcatttatttttggtgtgacaaatttcgagaaccaacccggacaaggcagcgacgcctcaaactttctgcagcagtgctccgatcacaaaaggaaggccaaggctttagtcgcttgtcagatcgttttgcccgatccaggcatcgccggttttaccgtgattgattattttcatcagctgttgcaaacctttaatttccgaaaactgcagtgtgattcccaggccccaaataatcacttactggctctcgaccacagcaattctgacctgtctagcatttacacctcagactctaccagcgatttttttaaaagctgctccaaagacacattttctaaattctggcagccatcactagaatttacctgtatcgtctctcagcttaccgacaacgatgactttagcgcgtctgagcagtctaaggcattcgggactctccaacaaaaccgtaagtccatctcaatcgcagaggcaacaggtagttcgagctgccacgatcctatccaggactcatggtcactcgtcagctatatggacaagaagagcaccgcagaaaagctcggcaaagagttaggcttacaagccaaggagctgagcgctgttcattctagtcaccatgaaattggcgttaatgactccaacctgtttagtctggagatgagggagcccttagaaagcagcaacacaaagtcgttccacagtgctgttgagatcaagaatcggagccagcatgaactgccatgttttcaacaccatgggatcgatactcctacatcattgcaaaagagatctgcctgctgcccaccttccttgttgcggctggaagaaaccgcctctagctcccaagacggggaccctcagatttgggatgacctgccattcagtgagagtttgaacaagttcctggctgtcctggagagcgagatcgctgttacccaagcagacgtttctagccgaaaacatcatgtggataacgatatcgacaagtttcatgcagaccattccagactgagtgtgaccccccagagaaccaccggcgcactgcatactccgcctattgcactgaggagctcccaggtgattgtgaaggctaattgctccaaggatgacttcctcttcaactgcaaagggaacctgtcaccctcagtggagaaggaatcccagcccgacaataaggtcgaggcggtctcagtgaaccataacggcagagatatgagtgagtattttctcccaaacccgtatctgagtgccctttcatcctcaagtaaagacctggaaactattgttacccttaagaagactattagaattagcccacaccgagaatcggaccattcaagtctgaataacaagtatctcaacggctgtggcgagataagcgtgtcggagatgaacgagaagctgactacactgtgctacagaaaatataacgacgtatccgacttatgcaagcttgaaaacaagcaatactgccgctggagcaaaaaccaggacgactcatttaccatctgccgaaaactgacatacccgttagaaacgctgtgcaatagtccaaaccggtcaaccaataccctcaaggagatgccatggggccacataaataataacgtcactcagtcttactctatagggtatgaggggagctacgacgcaagcgccgacctatttgacgacatcgcgaaggagatggatatagctaccgagattactaagaaaagtcaggacatcttgctgaaatggggtacatccctcgcagaatcccatccgagcgaatctgattttagtctaagaagcctgagcgaagactttatccagccaagtcagaagctgagtttgcaaagtctcagtgactcccgacactcgcgcacatgttccccgaccccgcacttccaatctgactcggagtataactttgagaattcccaggactttgttccatgctctcaatctacccccatatctggcttccaccagaccagaattcatggcatcaaccgcgcattcaaaaaacccgtcttctactcagatcttgacgggaattacgagaagatcagaatctttccagagaacgacaagcagcaggcctctccatcttgcccgaaaaatattaagacccccagtcagaaaattcggtctcccatcgtctcaggcgtttcccagcctgatgtgttcaaccattacccattcgcggaatgtcatgagacggactcggatgaatgggtgcctccaacgacccagaagatatttcccagcgatatgctggggttccaagggatcgggctgggcaaatgtctggcagcatatcacttcccagaccaacaggaactaccaaggaagaaactgaagcatattcggcagggaacgaacaaagggcttatcaagaaaaaactgaagaacatgctcgcagccgttgttacaaaaaagaaaactcataagtacaactgcaaatcttccggctggatcagtaagtgtccagatattcaagtgctcgccgcaccacagttgcaccccattctgggcccagattcctgtagcgaagtcaagtgttgtctaccattcagtgagaagggccctccctccgtatgcgaaacgaggagtgcatggtccccagaactctttagctag

SEQ ID NO: 30195 - DNA, 471 bp, Artificial Sequence
  Description of Artificial Sequence: Synthetic coding sequence
atggccgattcacctggaggatacaaagagtgcgggaccaatgagggaccccaggaggacgagaatggcagtagcgcctctggatcaagcaaagtcagacagctttggtccgaagatagctgcgaatcaggcaagctgccagcaactaggaccgtgtactgtatgaacgaggctgagattgtggatgtggccttaggcatccttatcgagtctagaaagcaagagaaagcctgtgaacagcctgccctggccggagcagacaatccagagcattcgccgccttgctctgtctccccccacactagctccggctcctcttctgaagaagaggacagtggcaagcaggccctcgcccctgggctctcaccgagccagaggccaggaggctcatccagtgcgtgctcaaggtccccagaggaggaggaggaagaggacgtgctgaagtatgtaagagagatatttttttcctag

SEQ ID NO: 30196 - DNA, 1377 bp, Artificial Sequence
  Description of Artificial Sequence: Synthetic coding sequence
atggccgagctgcaaatgctccttgaggaagagatcccaggcggacggcgagctctgtttgatagctacacaaatctggaacgggtcgcagactattgtgaaaataactatatccagtctgcagataagcagagggccctagaagagactaaggcctataccactcagagccttgccagtgttgcctacctcattaacaccctggctaataacgtgctgcagatgcttgatattcaggcatctcagctgaggaggatggaaagtagcattaaccatatatctcagacggtggatatccacaaagaaaaggttgcacggcgagagatcggaattttgacaaccaacaagaacacgtcccgtactcataagatcatcgccccagcaaatctggaacgaccggtgaggtacattcgcaaaccgatcgattacacaatcctcgacgacatcggacatggggtgaaggtctcaactcagaacatgaagatgggcggtttgccaaggaccactcccccaacccaaaagcctccgagcccaccaatgtcaggaaaaggcaccctgggctcttcaggcagtagcggaggatcgcacccctctagccgaagcagctctcgggaaaattctggatccggctcagtgggggtcccaatcgctgtcccgaccccctctcctccctctgtgtttccagcacctgccggaagtgcagggactcccccattgcccgctacttctgcctccgccccagccccactcgtgccagctacggttcctagctccacagcgccagacgcggctgcgggaggggctcagaccctcgcagacggatttacttctcccacccccccagtggtctccagcacccctccaactggtcatccggtgcagttctattctatgaatcggcctgcctcaaggcatacacccccaacgattgggggaagtctcccttatcggaggccacctagcatcacctcccaaacttccttacagaaccagatgaatggagggcctttctattcccagaatcccgtatctgataccccccctcccccacctcctgtcgaggaacctgtgttcgatgaatcccccccaccaccaccccctcctgaggattacgaggaagaggaggcggctgtggtcgagtactctgacccatacgctgaagaggaccctccctgggcccctcggtcctacctagaaaaagtcgttgccatctacgactacactaaggacaaagaagacgagctttcatttcaggagggggctattatatatgtcatcaaaaaaaatgacgacgggtggtatgagggcgtgatgaatggggtaacagggctgttccccggtaattatgtggagtctatcatgcactattcggagtag

SEQ ID NO: 30197 - DNA, 5222 bp, Artificial Sequence
  Description of Artificial Sequence: Synthetic coding sequence
tgaaaaatctaccctgaggagatcactccactccttccggcaatcagtggcgagaagattgctgaagatcagacctgcttttttctgcaaatcttgctgaagtatatggtgatccaggcagcttctctggaatggaagaataaggagaaccaggacactggattcaagtttctgttcaccctgttccgcaaatactatttgccacatctgtttccttcttttacgaaattgaccaatatttacaagccagtcctggatatcccacacctcaggcccaaaccggtttacatcaccaccaccagggacaacgagaacatttattccaccaagatcccgtacatggcggcaagggtggttttcatcaaatggatagttacttttttcctggagaagaagtacttaaccgctacacagaataccaagaatggcgtcgacgtgctgcccaaaatcattcagacggtgggagggggagctgtccaggagcgtgcgcctgagctcgacgggggtggccctacagaacaggataaaagccattctaatagttccaccttgagcgaccgtcgcctcagcaatagttcgctgtgctccatcgaggaagaacaccgaatggtgtacgagatggtccagcgaatactcctctccacccgtggatacgtaaactttgtgaatgaggtctttcaccaggctttcctcttgccaagttgcgagatcgcagttacccggaaagtggtgcaggtgtaccggaagtggatcctgcaggacaaacccgttttcatggaagaacctgataggaaagacgtcgcccaagaggacgctgaaaagcttggctttagtgagacagattccaaagaggcgagctcggaatcgagcggccacaagcgcagttcctcttggggccgtacgtattcctttacatcagcgatgagtagaggatgcgtgaccgaggaggagaacaccaatgttaaggccggagttcaggcattattacaagtcttcctgacaaactccgccaatatcttcttgctggaaccatgcgccgaagtgccggtgttactgaaagagcaagtggatgcctgcaaggcagtgctgattatctttagacgtatgatcatggaactgaccatgaataaaaagacatgggagcagatgctccagatcttactccggatcacagaggcggttatgcaaaagcccaaagataagcagattaaagacctgttcgcacaatcacttgcaggtcttttattcaggactctgatggttgcttggattcgcgctaacttatgtgtgtatatctcccgcgagttgtgggatgacttcctgggggtgctctcatcccttactgaatgggaggagctgattaacgagtgggctaacatcatggacagcctgactgctgtgttggccagaaccgtctacggagtggagatgaccaaccttcctctggacaaactttcagaacagaaggagaaaaagcagaggggaaaaggttgcgtgctcgatcctcaaaagggtactaccgtaggtaggagctttagcctatcatggcggagtcaccctgacgtgacagaaccgatgagattccggagtgctaccacctcaggcgctccaggggtggaaaaagcgagaaacatcgtgcggcagaaagccaccgaagtggaggagtgtcagcagtctgagaacgccccagcagccggttctgggcacctgacagttggtcaacagcaacaggttctgagaagtagtagcacctccgatatcccagagcccctgtgcagcgatagttcgcagggccagaaggcggagaatacgcagaacagctcatcgtccgagcctcagcctatccaagagaataagggccatgttaagcgcgagcatgaaggaataactattttagttagacgcagttcttccccggcagagctggatttaaaggatgacctgcagcaaacccaggggaagtgtcgagagaggcagaaaagcgaaagtactaactcggataccacgctaggctgtaccaatgaagccgagctgagcatgggtccttggcagacctgtgaagaagacccggaattaaatacccccaccgatgtggttgctgatgccgacgcacggcactggctgcagctgtctccgacagacgcgagcaacctgaccgactcctccgagtgtctgaccgatgattgcagcatcatagccggagggtcactgaccggctggcaccctgacagcgccgctgtcttgtggagacgggtcctcggaattctgggtgacgtaaacaacattcagtcccctaagatccacgctcgggtgttctgctatctctatgaactctggtacaagttagcaaaaattcgagacaacctggccatttccctcgacaaccaatcatccccctcaccccctgtgctgataccgccactgcgcatgtttgcctcatggctctttaaagcagcaaccctgccaaatgaatacaaggagggtaagctgcaggcttataggctgatttgtgccatgatgactcgtcgccaggatgtgctgcctaactcagatttcctcgttcatttttacttggttatgcatctggggttaaccagtgaggaccaagacatcttaaatactatcattcgacactgtccacccagattcttcagcctgggatttccgggttttagtatgctcgtcggggactttataacggctgccgctcgggtgctgtctacggatatcctgactgcgccacgaagtgaggccgtcactgtgttaggatctctagtgtgctttccaaatacataccaggagattcctctgctgcagtccgtgcctgaagtgaatgaagcaataactggtaccgaggacgtcaagcattatctgattaatattcttttgaagaatgccactgaggagcccaacgaatacgcgaggtgcatcgcagtctgctcacttggagtctggatatgcgaggagctggcgcagtgtacctcccatccacaggtcaaggaagccatcaacgtcatcggagttactctcaagttccccaacaagattgtagcccaggttgcctgtgatgtgctgcagttactggtgtcttattgggagaaactccagatgttcgagacctctctccccagaaagatggctgaaatcttggtggctaccgtggccttcctgctgccctcagccgagtattcatccgttgaaaccgacaagaagttcattgtttcgctactgctctgtcttctggactggtgcatggcattacccgtttctgtactgctgcacccagtatcaactgccgttctggaggaacagcattccgcacgcgctccccttctagactatatttaccgcgtgctccattgttgcgtttgcggcagtagcacatacacccagcaaagtcattacatcttaaccctggcagatctgtccagcactgattatgacccttttcttcccctcgctaatgtgaagagctctgagcccgtgcagtatcacagctccgccgaactgggcaacctgttgacagtcgaagaagaaaaaaaacgacgatctctagagctgattcccctgaccgcaagaatggtgatggcacatctggtgaatcacctcgggcattatccactgtccggcggtcctgccattctgcacagtttagtctctgagaatcacgataacgcccacgtcgagggttctgaactgtctttcgaggtattccggtcaccaaacctacagctgttcgtcttcaacgattcgaccctgattagttatttacaaaccccaacagaaggtccagttggcggaagtcccgtggggtcgctctccgatgtcagagtgattgtgcgcgatataagtgggaaatattcctgggatgggaaggtgttgtacgggcctctggaagggtgcttggcgccaaacggaagaaacccaagctttctcatctcgagctggcaccgagacactttcgggccacagaaagatagttcacaagtcgaggaaggagacgacgtgctcgacaaattgctcgaaaatattgggcacaccagtcccgagtgcctgcttccctcccagctcaacctgaacgaaccctcacttacaccgtgcggcatgaactacgatcaagagaaagagattatcgaagtcatcttacggcaaaacgcccaggaggatgaatatattcaatcacacaattttgatagtgccatgaaagtgacaagccaggggcaaccctccccagtggaaccaagaggtcctttttatttctgcaggctgctgctggacgacctcggcatgaactcgtgggaccggagaaagaacttccatctgctcaaaaagaactccaagctgttgcgagagctgaaaaatctggacagccgtcagtgtagagagactcacaagattgcagtcttctatatcgccgagggtcaggaggataagtgttctatattgtcaaacgagcgcggaagccaggcatatgaggatttcgtcgcaggactcggctgggaggtagacttgtctactcattgtggcttcatgggtgggctgcaacggaatgggtcaactggacagacagccccatactacgccactagtactgtggaggttatttttcacgtgtccacccgaatgccttctgactccgacgacagcctgacaaaaaagctgaggcacctgggaaacgacgaagtgcacatcgtatggagcgagcacagtagagactatcgacgcggtattatcccaaccgccttcggggatgtttccattataatctaccctatgaaaaaccatatgttcttcattgccattaccaagaaacccgaggtaccgtttttcgggcctctatttgacggcgcaatcgtcagcggtaagctgttgccctcacttgtgtgcgccacctgcatcaatgcctctcgggcagtcaagtgtctgatcccactgtaccagtctttttatgaggagcgggcactgtatttggaagccatcattcagaatcatcgagaggtcatgacctttgaagacttcgccgctcaggtcttctccccttccccatcttactcactgtccggaaccggggctctagctagcagcttgtccgccgatctggaagaaccgctgtctgaggaggaaacggaacacccactactaccgctgcccagagctactaaaccacgcataagtaggaaatttagatgttgcacgtcagccctttcccgatcctcccatta

SEQ ID NO: 30198 - DNA, 1836 bp, Artificial Sequence
  Description of Artificial Sequence: Synthetic coding sequence
atgcctcacctggatatgaaaacgcacgtttgtccatcagtggagggtccaaaaaagaaaggcggaatcacatgcttctgttgtggaggaccatttagagccgcagaccgcagtaagactaggtcccccaagctgtctcatagcccccagcccccatcactgggcgaccctgtggagcatctgagcgagacgagtgccgattcgctggaggccatgtctgagggcgacgcccctaccccctttagcagaggctccagaacccgcgcatctctgccagtggtccgctccactaaccagactaaggagcggagtctgggtgtgttgtacttgcaatacggggatgagactaagcagttgcgtatgcctaacgagatcacatctgcagatacgattcgagcactgttcgtctctgcttttccacagcagttaacaatgaagatgcttgagagcccctcggtggctatttacattaaggatgagagtaggaatgtgtattacgagctgaacgacgttaggaacatccaggacaggtccctgttgaaagtttataataaggaccctgcccatgcattcaaccacacccctaagacaatgaacggcgacatgcggatgcaacgggagttggtttacgccagaggcgatgggccaggagccccacgaccgggaagcaccgctcacccaccacacgcaataccaaattcaccaccctccaccccagtgccccatagtatgcccccatcccctagcaggatcccctacgggggtacccgctccatggtagtaccaggcaatgcaacaataccaagggacagaattagctccttgccagtatcccgccctatttccccctcaccgagcgctatcctagagaggagagatgtgaaacctgatgaagatatgtctggcaagaatatcgccatgtataggaatgagggcttctacgcggatccatacttatatcacgaggggaggatgagcattgctagcagccacggaggccatcccctggacgtgccagaccacattatagcctaccacaggaccgccatcaggtcggccagcgcatactgtaaccccagcatgcaggccgaaatgcacatggaacagtcactctacaggcaaaaatcccgtaaatacccggattcccacctgcccacactaggaagcaaaacacctcctgcgagtccccatagagtgtcagacctgagaatgatcgacatgcacgcccactacaacgctcacgggccaccgcacactatgcagccagaccgcgctagcccgtctagacaggccttcaagaaggagcccggtaccctcgtctatattgagaaacccagatcggccgcaggcttgtcctctctggtggatctgggcccacctctcatggaaaagcaggttttcgcttattctactgcgaccatacccaaggatcgagaaaccagtgaaaaaatgatgaagaccactgccaaccgcaatcacactgattcagcgggtaccccccacgtttcgggaggtaaaatgctgtctgctttagagagtaccgtacctccctcccaaccaccgcctgtaggaaccagcgctattcacatgagcctgctggagatgcggaggtcagttgcggagttgcgcctgcagctccagcaaatgcggcagttacagttacagaatcaggaactgctgagagccatgatgaaaaaggctgaactcgagattagtggtaaggtcatggagactatgaagcgactggaagatcctgtacagcggcagcgagtactcgtggagcaggagcggcagaaatatctgcatgaggaggagaagatagtcaagaaactgtag

SEQ ID NO: 30199 - DNA, 189 bp, Artificial Sequence
  Description of Artificial Sequence: Synthetic coding sequence
taagaaaacccgctcgtttattgcgacgggcacggatgctcagttgcagtgcatcaggcctgttacggaatagtgcaggttcctacgggcccatggttttgtaggaaatgcgagagccaggagagggcggcaagggtagttggaccaatgtggtttgttccttgtattttccagagatataacctgtag

SEQ ID NO: 30200 - DNA, 1869 bp, Artificial Sequence
  Description of Artificial Sequence: Synthetic coding sequence
atggccatggccccaagtccttctctcgttcaagtttacactagccccgcagcagtcgcagtctgggaatggcaggatggcttagggacctggcatccttattcagctactgtctgcagctttattgaacagcagttcgtgcagcagaagggtcagagattcggccttggcagcctggcccactcaatccctctgggacaggccgatccctctctcgcaccgtatatcatcgacctcccatcctggacccagtttcggcaggatacaggcaccatgcgcgctgtgaggaggcatttgttcccccagcattccgcccctgggcgaggagtggtgtgggagtggctatccgatgatggttcctggactgcatacgaggcgagcgtttgcgactacctggaacagcaggttgcaagaggtaaccagctggtggacctggcacccttgggctacaattacacagtcaactatacaacccacacccagacaaataaaacatccagcttttgtagaagcgtgcggcgacaagcaggcccaccatacccggtcaccactattattgcgcctcccggacataccggcgtcgcgtgttcctgtcaccagtgtctgagcgggagccggacaggtccagtatccggcagatatagacactcgatgaccaacctgccagcttaccctgttcctcaacacccaccccacagaacagcttcagtgtttggaacacaccaagcgtttgcgccttacaataagccatctctgtctggcgcaagatctgcccctagactgaacaccaccaatgcctggggagccgcacccccaagcctgggatcacagcctctttaccgatcctccctgtcacacctcggcccacagcatctccctcctggatcctccacgtcaggcgctgtttcagcgagcctgccatcaggccctagctcttcaccagggagcgtacccgctaccgtccctatgcaaatgcctaaaccctcgcgtgtgcagcaagcacttgccggaatgacatccgtgctcatgagcgccattggtcttccagtgtgcctgagccgtgccccacagccaactagtcctcctgcttcacgattggccagcaagtcccacggtagcgtcaagcgtcttagaaagatgtctgttaaaggtgcaacaccgaagcctgaaccagaaccagaacaggtcatcaaaaattacaccgaggagctgaaagtgccccctgatgaagattgcatcatttgcatggaaaagctgtccaccgcctccggttattccgatgttactgacagcaaagcaattgggtcactggctgtagggcacctcactaagtgttcacacgccttccatcttctatgtctactggctatgtattgcaacggaaataaggatgggtccctgcagtgtccaagctgcaaaacaatatatggggagaagaccggaacacagcctcaggggaaaatggaggtactaagatttcagatgtcccttcccggacatgaagattgtggtacgatcttgattgtctactccatcccccatggcattcaggggccagaacatccaaaccctggaaaaccgtttactgctcgaggttttccgaggcagtgttacctgccagacaacgctcagggcagaaaggtgttggaacttctgaaagtcgcctggaagcgacggcttatttttaccgtcggcaccagttcaacgacaggggagaccgataccgttgtgtggaacgagattcatcataaaaccgagatggatcggaacattacaggtcacggttaccctgatcccaactatctacaaaacgtgctggctgaacttgccgctcagggcgtgaccgaggattgcttggaacagcagtag

SEQ ID NO: 30201 - DNA, 546 bp, Artificial Sequence
  Description of Artificial Sequence: Synthetic coding sequence
atgggcggaaggtccgcccaggccggattaggcacaagaatcactccaatgatggagctgaagccaaacgctggatccgaccgagcctgggtgtggaacacgcacgccgatttcgctgatgagtgtcctaagcctgagctgctagccattaggtttcttaatgcagagaacgcccagaagtttaagacaaagtttgaggagtgtcggaaagaaatcgaggagagagaaaagaagggggacgtcgttccatgggttgggggtctcttatgccggctgactctgcacctcactatccttcccggtggttgttttttctgcctgcccgacaagcactctagggtgttgtggcctccccatgtctcaagagttatgcagttgcccggagacacaggcgcatcatggggagcccttagtacctgccaatgctgttggccgcagagcaattgggcgggaatcggtgttagagctctgcccggagcgcatcagaaagtcctctacgatgggcctcggtttgtgtctcaacgggcttggagtccactgccatag

SEQ ID NO: 30202 - DNA, 378 bp, Artificial Sequence
  Description of Artificial Sequence: Synthetic coding sequence
atgagctctagcggctacccaccaaaccaaggtgccttctccacggagcagtctagatatccccctcactccgtgcagtacacgttccccaacacaaggcatcagcaagagtttgccgtgccagactaccgcagtagccacctcgaagttagccaggctagtcagctgcttcagcagcagcagcagcagcaactgcgtcggagaccctcattacttagcgaatttcatccaggctctgatcggcctcaggagcgcaggactagttatgaacctttccacccaggaccttccccagttgaccacgatagtttggagagtaagcggccaaggctcgagcaggtgtccgatagtcatttccagcgggtgagtgcagcctag

SEQ ID NO: 30203 - DNA, 318 bp, Artificial Sequence
  Description of Artificial Sequence: Synthetic coding sequence
atgctgcgatgcggtcagatgatcttcgctcaggccctggtttgcagacatctggggagggactggcgttggacacaaaggaagaggcagcctgatagctatttcagtgtcctgaacgcattcattgataggaaggatagttactattctattcaccagatcgctcagatgggtgttggagaaggcaaaagtattggccagtggtacgggccaaacactgtggctcaggtgctgaagaagctcgctgtgtttgatacatggtcctctttagctgtgcatattgcgatggataacaccgtggtcatggaagaaatatag

SEQ ID NO: 30204 - DNA, 1305 bp, Artificial Sequence
  Description of Artificial Sequence: Synthetic coding sequence
atggacatcgacaaggacctagaggccccactgtacctgactcccgagggatggtctctcttcttacagcggtactatcaggtggtacacgagggggctgaacttaggcatttggacacacaggtacagagatgtgaagacatcctgcagcaactccaggctgtggtgccccaaatcgacatggagggtgaccgcaacatatggatcgtgaaacccggagcaaaatcccgaggaaggggcatcatgtgtatggatcatcttgaggaaatgctaaagctggtgaacgggaatcccgtggtcatgaaggatggtaaatgggtggttcagaaatatattgagcggcctctgcttatcttcggcaccaagttcgatttaagacagtggttcctggtcacagactggaacccattaaccgtctggttctacagggacagctatattcggttctctacccaacccttttcccttaagaacttggacaatagtgtccatctctgtaacaattcgatccagaagcacctcgaaaacagttgtcaccgccatccccttcttcccccagataatatgtggagcagtcagcgctttcaggcacacctgcaggaaatgggcgctcctaatgcctggtccacaatcatcgtgcccggaatgaaggacgccgtcatccatgcgctgcagacatctcaagacaccgttcagtgtcggaaagcttccttcgagctctatggggctgactttgtattcggagaagactttcagccgtggctcattgagataaacgcatcgcctacaatggctccaagcacagcagtgacagctaggctttgtgccggagtgcaggccgacacccttagggtggtgatcgaccgaatgctggacagaaactgtgacactggagcattcgaattgatttataagcaaccggcagtggaagtgcctcagtatgtgggcattcggctgctggtagagggctttaccataaagaaacccatggctatgtgccataggagaatgggtgtgaggcctgctgtgccactgttgactcagcggggtagcggtgaggctagacaccacttcccctctctacacacaaaggcacaactgcctagcccacatgtgttgcggcatcaaggacaggttctgaggcgacagcactcaaaattggtcggcactaaggctctgtccacaacaggcaaggcgctgcgcactctccccactgctaaagtgttcattagcttacctcccaatctggacttcaaggtagcaccgtcaatccttaagcccagaaaggttggtcttgatttatag

SEQ ID NO: 30205 - DNA, 576 bp, Artificial Sequence
  Description of Artificial Sequence: Synthetic coding sequence
atggcaatcgggaaaaggcttgctacactacctacaaaggaacagaaaacccaacggctgataagcgaattaagcctgttaaatcacaagcttcctgcacgagtttggttacccaccgcaggtttcgaccatcatgtcgtgagagtccctcacacccaagccgtcgtgctgaactccaaagacaaagccccttatctcatttacgttgaagtgttggaatgtgaaaatttcgatactacttccgtcccagctcgcatcccagagaaccggatcagatccacgcgttctgtggagaatttgccagagtgcggcatcacacatgaacagagagccggatcttttagtaccgtcccaaactatgataacgacgatgaagcctggtccgtggacgacatcggggagttgcaggtggagcttccagaggtccacaccaattcttgtgataacatatcccagttttctgtggattccatcacaagccaggaaagtaaagaacccgtctttatcgccgcaggcgatattcgcaggagactgtccgagcagttggctcatacacccaccgcattcaagcgctag

SEQ ID NO: 30206 - DNA, 903 bp, Artificial Sequence
  Description of Artificial Sequence: Synthetic coding sequence
atggccaagtgggggcaggggaacccccactggatcgtcgaagagcgagaggacgggactaacgtgaacaattggagatggcggactgaacgagacgccacctcactgagcaagggtaagttccaggagctgttggtcggaatagtggtggagaacgatgccggtaggggggaaatcaacgagctcaagcaggtggaaggtgaagcaagctgttcttcccgcaagggaaagctgatctttttctatgagtggaacatcaagctgggctggaagggaatagtaaaagagagtggtgtgaagcacaaggggctgattgagatcccaaatttaagcgaagagaacgaagtggatgataccgaagttagcctgagtaagaagaaaggcgacggagtgattctgaaagatttaatgaagaccgccggaacagctaaagtgcgggaggctttaggtgactacctcaaggccctcaaaactgagtttaccactggcatgatcctgcctactaaggccatggcaacacaggagcttaccgtgaagaggaagctatccggaaacacactgcaggtgcaggcaagcagccccgtggcactcggagtgaggattcctaccgtagctctacacatgatggaactcttcgacaccacggtggaacagctctacagtattttcactgtcaaggaattgactaataagaagataattatgaaatggaggtgtgggaactggcccgaggagcactatgcaatggttgctctgaacttcgtgcctacacttggtcaaaccgagcttcagttgaaggagttcctctctatatgtaaagaagaaaatatgaaattctgctggcagaagcagcacttcgaagaaatcaaagggagtttgcagctcaccccgttgaacggctag

SEQ ID NO: 30207 - DNA, 1137 bp, Artificial Sequence
  Description of Artificial Sequence: Synthetic coding sequence
atgaaggacgtgcccggttttctgcaacagagccagaatagtggccctggtcaaccagctgtctggcacagactggaggaactgtataccaaaaatttcatgaaaacgctcagcgtgaatctaaatactggaaaatctctcagctccgtcttccactttgagaacgagtgcatcgacgccagacgatgcagtaaggcaggcggattctacttcagagtcaatccactgtctttggtcgaaatcatcctgcacgtggtgcggcagatgaccgacccgaatgtcgccctcacgtttctggaaaagacccgggaaaaagtaaaaagctcggacgaagcggtcattctctgcaaaaccgccatcggtgccctgaaactaaacatcggagacctgcaagtaaccaaggagaccattgaggatgtggaggaaatgctgaataatcttcccggtgtgacttctgtgcactctaggttttacgacttgtcatctaaatactatcagactatcggaaatcatgcttcgtattataaagatgccctcaggttcttaggatgtgtggacataaaggatctcccagtgtctgaacaacaagagcgagccttcacattgggcctagctgggctgctgggagaaggcgtgttcaattttggagagttactgatgcaccctgttctggagagcctgcggaacactgatcgacagtggcttatcgatacactgtacgctttcaacagcggcaatgttgagaggtttcagaccctgaaaaccgcatggggccagcagcctgatctagctgctaatgaagcacaacttctgagaaaaatccagctgctgtgcttgatggagatgacctttacacggccagctaaccaccgtcagttaacatttgaggaaatcgctaagtcagctaaaatcacagttaatgaggtggagctgctcgttatgaaagccctgtctgtcggactggttaagggctccatcgacgaggttgacaaaagggtgcatatgacctgggttcaacccagggttctggatcttcagcaaataaaagggatgaaagatcgtctggaattctggtgcacagatgtgaagagtatggaaatgctagtggagcaccaggcacacgatatcctgacatag

SEQ ID NO: 30208 - DNA, 603 bp, Artificial Sequence
  Description of Artificial Sequence: Synthetic coding sequence
atgctcttggaacagaacctaatcactgttgatatgcagaagcattcactcaccttctggtggcttgtggaatgttggccacaggtgttcaacaaactcatacggaggtacaagtacctggagaaaggcttcgaggatgaggtgaagaagctcttattgttcctgaaggggttctccgaatctgaacgcaataaactggcaatgttgacaggcgttctcctcgcgaacggcaccttaaatgcatctatactcaacagcctgtataacgaaaatctcgtgaaagagggggtgagcgccgcatttgcagtcaaactgtttaagtcatggataaatgaaaaagacattaacgcagtagctgcatccctgcggaaggtgtcaatggataacaggttaatggagctgttccctgccaataagcagtccgtagagcacttcaccaagtatttcactgaagccggactgaaggagctgagcgagtatgtcaggaatcagcagacaatcggagcacgcaaggaattacagaaggaactccaggagcagatgagccggggagacccttttaaggacatcatcctctatgtgaaggaagagatgaagaagtag

SEQ ID NO: 30209 - DNA, 1446 bp, Artificial Sequence
  Description of Artificial Sequence: Synthetic coding sequence
atggcttccgccgcatccgtgacatctcttgctgatgaggtgaattgtccaatctgccagggcaccctgcgggagcctgtgactatcgactgcgggcataacttttgtcgggcttgcttaacccgttactgcgagattccaggccctgatttggaagagtctcccacctgcccactgtgcaaagagcccttcaggcctggatctttccggcctaattggcagctcgccaacgtggttgagaatatcgagagattgcagctagtctctacgctggggttgggagaggaggacgtttgtcaggaacacggcgaaaaaatttactttttctgtgaggatgatgaaatgcaattgtgcgtggtttgtagagaagcgggagaacatgctacccacactatgcgcttcctggaagatgctgcggctccataccgcgagcaaattcacaagtgcctgaaatgcctaagaaaagagcgcgaagaaatacaggagatacagagtcgagagaataagcgaatgcaggtgctgctcactcaggtgagtactaagcggcaacaagtgatttcagagttcgctcacctccgaaagttccttgaggagcagcagagtatactcctcgcccagctcgagagccaggatggcgacatccttagacagagggatgagtttgaccttctggttgcaggtgagatatgcaggtttagtgccttgattgaggagttagaggagaaaaacgaaaggccagcccgtgagttgctgaccgatattaggtcaaccttaataagatgtgaaactcgaaagtgcagaaaaccggtggccgtgtcccccgaactgggccagaggattcgagatttcccacagcaggcactacctctgcagcgggagatgaagatgtttctggaaaagctgtgttttgaacttgattatgagccagctcacatttccttggatccacagacttcacaccctaagctcctgctatccgaagaccaccagcgggctcagttcagctacaagtggcaaaatagtcccgacaacccacagcgtttcgacagagccacatgtgtccttgcccacacaggaattacaggcggaaggcacacctgggtcgtgtccattgatctggctcacggaggttcatgcacagtcggtgttgtcagcgaggatgtgcagcgaaaaggggagttgaggttacgcccagaggagggggtttgggcagtgaggcttgcctggggatttgtgtctgcactggggagcttcccgactaggctgactctcaaagaacagccgcgtcaggtcagggttagtttagattacgaggtcggttgggtgacatttacaaatgccgtcacacgcgagccaatctatacctttacagccagcttcacacgaaaggtgattcctttcttcgggctatggggtcgtggttcaagcttttcgcttagttcatag

SEQ ID NO: 30210 - DNA, 261 bp, Artificial Sequence
  Description of Artificial Sequence: Synthetic coding sequence
atgggcaaaatggtgtccgtcatcaatactgttgatactagccatgaagacatgatccatgatgcacagatggattattatggcactaggctagcaacatgtagttcagatagatctgtgaagattttcgatgtacgtaatggcggtcagattctgatcgccgatctaagaggccatgagggaccagtgtggcaggtcgcatgggcccacccgatgtacgggaacatactggccagttgctcatacgacagaaaagtttag

SEQ ID NO: 30211 - DNA, 660 bp, Artificial Sequence
  Description of Artificial Sequence: Synthetic coding sequence
atggagccctcagcccaacagcttcagctggccgcttctcttcctgctaatctgagcaatttctgtcaggggtctgaaatgccaacaacttccaggcccgctctggacgtgaaggggggaacgagccctgccaaagaagatgctaaccaggagatgtcctctgtggcctactcaaatttagccgtgaaggatcggaaggccgtcgcaatcctccattatccaggtgtggcctctaatggaacgaaagcaagtggtgctccgacgtcatccagtgggtccccaatcggatcccccacaactacgcccccaactaagcctccaagtttcaatctgcacccggcaccccacctcctcgcatccatgcaccttcaaaaactcaatagccagtaccaaggtatggcagccgctacacctgggcaacctggagaggctgggcctcttcagaactgggactttggcgcacaggcgggaggtgccgagagcctttcacccagtgctggggcacagagtcccgcaatcattgatagtgatccagtagacgaggaggtgttgatgtcactcgtggtagaactgggattggatagggccaacgaactgccagaactgtggctcgggcagaatgaatttgattttacagccgattttccatcatcatgctag

SEQ ID NO: 30212 - DNA, 396 bp, Artificial Sequence
  Description of Artificial Sequence: Synthetic coding sequence
atgctgtgttggggctactggagcctgggccagcctgggatctccaccaatctgcagggaattgtggcggagcctcaggtgtgcggctttatatcagatcggtctgtgaaggaggtcgcctgcgggggtaaccacagtgtcttcttactggaagacggcgaagtctacacctgcggactcaatacaaagggtcagctgggtcatgagcgcgaggggaataaacctgagcaaatcggggcactggctgatcagcacatcatccacgtagcctgtggagaaagccacagcctcgctctcagcgatcgaggtcaactgttttcttggggcgcagggtctgatggtcaactgggcctcatgacgaccgaggacagcgtggccgtgccccgattgatctag

SEQ ID NO: 30213 - DNA, 3099 bp, Artificial Sequence
  Description of Artificial Sequence: Synthetic coding sequence
atggagggagcgctcacagctagagataaggtcggggtgcaggattttgttctgctggacgcctatacatctgagtctgccttcgtcgacaacctgcggaagaggttcagcgaaaacctgatttatacctacataggaaccctgctggtcagcgtgaacccctaccaggagctgggaatttatactgtgtcacaaatggaactgtatcaaggtgtgaacttttttgaactgccccctcacgtgtatgctatcgccgacaatgcgtatcgaatgatgtgcgctgagctgaacaaccacttcattctgatctctggagaatccggcgctggaaagactgaggcgtccaagaaaattctggagtactttgcagtcacttgtccaatgacacagtctcttcagatcgcaagggatagactcttgttctcaaatccagtgctggaggctttcggcaacgccagaacccttagaaatgataattccagtaggtttgggaagtatatggatatccagttcgatttccagggtatcccagtggggggtcacattatttcttacttgatcgagaaaagtcgcgtggtctaccagaatgagggcgaacggaacttccatatcttctatcagctgctggccggaggtgaagaagagcgtctgagttacctggggctggaacgagatccgcagctgtataagtatttgagtcagggccactgtgccaaggaaagtagcatctcagataagaatgactggaaaaccgtcagtaacgcgttttctgtaatcgattttactgaagcggatctggaaaatctgtttggcatcatcgcctctgtattgcatctgggaaatatcggcttcgaagaagatgaccagggatgcgccaccattccagatacgcacgaaatcaagtggattgcgaagttactgggggtccatccatcagtgctcctggaggccctaacccacaggaaaatcgaagccaaaactgaggaggttatctgcccactgacattggagctcagcgtctacgcccgtgatgctatggccaaggccgtttatggaagaaccttcacctggcttgtcaacaagatcaactcctcacttgtgaataaggtcgggcagcggatcctcgacccattactgctgctcacatggaagactgtgatagggctgttggatatctatgggtttgaagtatttgataaaaatggatttgaacagttttgtatcaattactgtaatgaaaagcttcaacagctccttatcgaacggaccctcaaggctgaacaggccgaatacgagatggagggaattgaatgggagccaattaagtactttaataataaaataatatgtgacctggtggaagaacgccataagggcatcattagtatcctagacgaagaatgtataaggcctggcccagccactgacctttcctttctggaaaaactcgaggaaaaggtcggcaagcacgctcactttgaaactcgaaaactcgcaggtcctaaggggagaaagcgaatcggctggatggaatttagattgctgcactacgccggagaggtgacttactgtacaaagggcttcctggagaaaaacaacgacctgctgtacagacacctcaaggaagttctgtgtaagagtaaaaatattatcctcagggagtgttttctactggccgaactggagaatagacggaggccgccaaccgttggaacccagtttaaaaatagcctgtcttccttactcgaaacactgatttccaaagagccctcttacataagatgtatcaaacctaacgacagaaaagaaccttccaagtttgatgattttctgattaggcaccaaatcaagtatttgggcttaatggagcacttgagggtaaggcgtgctggctttgcttacaggcgcaagtacgagcattttctgcagcggtataaatcactatgccccgacacatggcctcactggcatggccctccggctgaaggtgtcgaacggctgataaagtatattggctataaacccgaagaatacaagctgggaaaaacaaaaattttcattcgcttccctagaaccctgtttgccactgaggacgcctttgagtttagcaagcaccaactggttgcacgtatccaggccacctacaagcggtgcctgggcagaagagaatatgtgaagaagcgccaggccgctatcaagctggaggcccactggcgcggagctctggcaagaaaagctattcaacgcagaaagtgggcagtgagaatcattcgaaagtttataaagggttttatttccaggaacaaaccactatgtcctgacaatgaggaatttattgtgtttgtgcggaagaattacatactaaacctcaggtaccatttgccaaaaaccgtcctggacaagtcctggctgcgccctcccggtatcctcgagaacgcgagcgatctgttacgcaaaatgtgtgtgcgtaacctagtccaaaagtactgcaggggaatcaccgctgaaaggaaggccatgatgcagcagaaagtggtcacttcggagatcttcagggggaggaaagacggatacaccgagagcttgaatcaaccatttgtgaactcccggatcgatgagggggacattaatccaaaagtcctgcagcttatatcacatgagaagatccagtacggggtgccagttatcaaatacgatcggaagggatttaaggcccgacaacgacagcttatcttgacccagaaggcggcttacgtggtcgagttagccaaaattaaacagaagattgagtactccgctttgaaaggggttagcacaagcaatttatcagatggcatcttggtgatccatgtgagcccggaagactccaaacagaagggcgacgctgttctgcagtgcggacatgtatttgaggctgtgaccaaactggttatgttggtaaaaaaagagaacatcgttaacgttgtgcaggggtcccttcagttcttcatcagccctggtaaagaagggacaatagtgtttgacaccggtttggaggagcaggtgtataagaataagaacggtcaattaactgtggtgtcagttaggagaaaatcttag

SEQ ID NO: 30214 - DNA, 1176 bp, Artificial Sequence
  Description of Artificial Sequence: Synthetic coding sequence
atgtgttcccaactgtggttcttaaccgataggcgtatccgcgaagactacccacaggtgcagattctccgagccctgaggcagcggtgctccgagcaggacgtgcggttcagggccgtgttaatggatcagatcgctgtaactatcgtgggtggccacctggggctgcaactgaaccagaaagctctcacaacattccccgatgtggtgctcgtgcgggtgcctacgccatccgtccagagcgacagtgatataactgtgcttcgacacctggagaaactaggctgcagacttgtgaatcggccacagagcatccttaactgcatcaacaaattctggacattccaagaactggccggtcatggggtgcccatgcccgatacctttagctacggcggtcatgaagacttttcaaagatgattgacgaagctgagccgctaggctatcctgtggtcgtgaaatcaacaaggggccatcgtggaaaggccgttttcctggctcgggataaacatcatctgtctgatatctgtcacctcatccggcatgacgtgccatatctatttcaaaagtatgttaaagaatctcacgggaaagacatacgggtggtagtggtggggggtcaagtgattggaagcatgctgagatgttcaacagacgggcgaatgcagtctaactgctccctagggggagttggagtgaagtgtccactgacggaacagggaaaacaattggcgatccaagtgtcaaatattctcggcatggatttttgtggcattgacctactcatcatggacgatggaagttttgtcgtgtgcgaagctaacgctaatgtcggatttctggccttcgatcaggcctgcaacctcgacgtggggggtatcatcgcggattatactatgtctttgcttccgaaccgtcagaccggcaagatggccgtcctgcccggactttcatctccccgtgaaaaaaacgaacccgatggctgtgccagcgcacaaggagtggccgagagcgtttacaccataaattcaggctcaacatcgtccgagtctgaacccgaactgggggagattcgagattcgtcggccagtaccatgggcgcacccccttctatgcttccagagcccggatataatattaataatagaattgctagcgaactgaaactgaagtag

SEQ ID NO: 30215 - DNA, 1065 bp, Artificial Sequence
  Description of Artificial Sequence: Synthetic coding sequence
atggacatggaccacattatgacatgggccactgacgttgctaaagggatgcattatctccacatggaagcccctgtgaaggtaattcacagggacttaaaaagtcgcaacgttgtgatcgccgcagacggcgtcctgaaaatctgcgacttcggagcttcaaggtttcacaatcacacaactcacatgagcttggttggaactttcccttggatggcccctgaggtgatccagtccttgcctgtctctgagacctgtgatacgtacagctacggtgttgtgttatgggagatgcttacccgagaggttccattcaagggcctggagggattgcaggtggcttggcttgtcgtcgagaaaaatgaacgattaacaatcccaagctcctgcccgagaagttttgcagagcttttgcatcaatgctgggaagcagacgccaagaagaggccaagcttcaagcagattatcagcatcctggagagcatgtcaaacgacactagcctgcccgacaagtgtaacagtttcttgcacaataaggccgagtggcgctgcgaaattgaggcaacacttgagcggcttaaaaaattagaacgcgatctgagctttaaagagcaggagcttaaggagagggaaaggcgcctgaagatgtgggagcagaagctaacagaacagtcaaatacgcctcttctcctgccattggctgccaggatgagcgaagagagttattttgagtcaaaaacagaagagtctaactccgccgagatgtcctgccaaataaccgccacatccaatggcgaaggccacggcatgaatccgagcctgcaggccatgatgctgatgggcttcggcgatattttctccatgaacaaagcgggagcagttatgcacagcggcatgcagattaacatgcaggctaagcagaactccagcaaaactaccagcaaacgtagggggaagaaagtgaacatggccctggggtttagcgatttcgatcttagcgagggagacgacgatgatgatgacgatggggaggaggaggacaacgacatggacaactctgagtag

SEQ ID NO: 30216 - DNA, 1707 bp, Artificial Sequence
  Description of Artificial Sequence: Synthetic coding sequence
atgttagagagaccccctgcgttggcgatgccaatgccaaccgaaggcactccacctccgctgtctggtacacccatacctgtgccggcatattttcgccacgccgaacctggcttcagcttgaagcgtcccagaggcctgtcccgctccctcccaccacctccaccagcgaaggggtccattcctatttctcgcttgttccctccacggacccccggatggcaccagctccagccccgacgggtcagtttccgaggagaggcttccgagacactgcaaagcccaggttacgacccaagccgccctgaaagcttttttcagcagagctttcagcgcctttctcggcttgggcacggaagttatggagaagtgtttaaagtccgctcaaaagaagatgggcgtctgtatgccgtgaagcgatctatgtctccatttcggggtcccaaggacagggccaggaagctggcagaagtgggcagtcacgagaaggtgggccagcacccatgctgcgtcaggctcgagcaggcctgggaagaaggtggcatcctttatttgcagaccgaactgtgtggacctagtctgcagcagcattgtgaggcttggggtgcctcactgccagaggcccaagtttgggggtatctgagggacaccctgttggccctggcccacctgcacagtcagggcctggtgcacctggacgttaagccagctaacatctttctcgggcctaggggccgatgtaaactgggagacttcgggttgctggttgaactgggtaccgccggtgcaggtgaagtgcaggagggggacccaagatacatggccccagagctcttgcaagggtcctatggtactgccgctgacgttttttcactcggacttaccatcctggaggtggcctgcaatatggagctccctcatgggggagaaggctggcaacaactgcggcagggctatcttccaccggaattcacagctgggctgagttcagagctgcgtagcgtgctggtcatgatgttggagccagaccccaagctgcgcgctacagccgaggccctgctggccctccctgtgctgaggcagcccagagcatggggggtcctgtggtgcatggcagctgaggctcttagccgcggatgggctctgtggcaggcactgttggctttgttgtgttggctgtggcacgggctggcgcaccctgcttcttggttacagcctctcggccctccagcgacacctcccggatccccaccttgttctctattgctggatagttccctgtcatccaattgggatgatgatagtctgggaccttctctcagtcccgaagcagttctggcccgaaccgtcgggagtacatctaccccacgcagccgttgtaccccaagagttctgactcctttgcggctcagccccgcagccgagccgtcggccccaggtctgggtcctgctgctgaggccccttgctgcgttgagcagcgaggatttctttccaggcatatcccgcgatctttcagtgcttttcaagccgcacctcctaagtctgcatgtaacgcccttcatttacacggacatacgcagccctctgctttcgtctggagcctgacatgctcttctcaccatggacgaacgttcgaggccaggacgaaagtggacccccttttcaaaatttgcggaggcttcttgacggtgtttgcagatttatag

SEQ ID NO: 30217 - DNA, 642 bp, Artificial Sequence
  Description of Artificial Sequence: Synthetic coding sequence
atggctgagaccgaggaaaggtctctggacaacttctttgcaaagcgggacaaaaagaagaagaaggagcggtcgaacagagccgcttcagctgccggagccgctgggtccgctggtggttccagtggcgctgcgggtgccgcagggggaggagcaggcgctgggacacggcctggcgatgggggtaccgcaagtgccggagctgcgggtccaggggctgcaacgaaggctgttactaaggacgaggatgagtggaaggaacttgagcaaaaggaggtcgattactctggcctgagagtgcaggccatgcaaatcagtagcgagaaagaagaggacgacaatgagaaacgccaggaccctggcgataattgggaagaaggcggaggtggaggaggaggaatggaaaagagtagtggcccttggaataaaactgccccagttcaagcccctccagctcctgtaattgtaactgagacccccgagcctgccatgactagtggcgtgtacaggccacccggtgcacgtcttacgaccactcggaagacaccacagggtcccccagaaatctacagcgatacccaattcccctccctgcagagcacggcgaaacacgtggaatcccggaacagatacttaaagtag

SEQ ID NO: 30218 - DNA, 4140 bp, Artificial Sequence
  Description of Artificial Sequence: Synthetic coding sequence
atggcctcaagcccaactaaaggtctaacaatgagcgtgcccgtggcacctaagaaaagctgttacactcagctccgcgataacaggaatgccgcaaggaacaacaacgagtctatcctcagtctcggcgacaccaatgcaaaccagataatgctcgaggtgtcctcttctcatgatgagtctaaaacctgtgatttgggagatgagattggcaatacaaacagctccgagcctgaaaaccggacacattttcacaaggagttccaccagctgcaaggcttcggcaaaggttctcaggccggatcagcttctttaaaagattttagattaagctctaccattcagcgcgaactgaatgaggagcatacggttgaaagagggaccgacagcttgcaaaccaccagatccattcaaggtccgagcctgagctcctggcgcaacgtgatgtccgaagcctctttggacgtgttggccaagcgtgacgccgaaattccaaggcacgtgcctaaagataagttggcaaaaacactggacaacgaggaactgagaaggcactccctggagcgggcatcctcctccgtggctgcagtcgggtctctcacaccgcaacatccccaacccctgtcattggactcgcgggaagcccgagggcagattccgggtgggggtgaaggccctcagaaaaccctccccgaccatgccgtcccagccgcattccctgccaccgattcaaccagcgagggaaaaagtgtgcggcatcctaaaccatcaaccagtgaatcaaagcagagcaccccgtcagaaacccaaaccgtgggggctcacgtgttgcaggtttgctctgagcacacatctcactcagcccacccagagcccgcattgaacctcacactcgcttctaaagagatacctagcaaactggaagcccagctcgggcagggcaaaggggaggccaaactggacttaaaatatgtgccaccaaggcgtgtggaacaagagggcaaagccgctcaggagggatacctgggctgtcataaagaagagaatttgtccgcactggaaggtcgagacccctgtggtgaggcccacccggaggcaacagatgccctcggacaccttctcaattcggatttgcatcacctaggagtgggaaggggaaattgtgaagaaaagcgcggagtaaaccccggtgaacaagatagcctccacacaactcctaagcaagggtctgctagcttgggcggagcggataatcagccaacgggaaagataagcccctgcgccggtgaaaagttgggcgaacgaacttctagttccttctcccccggtgactctcatgttgctttcatacctaataacttaactgattcgaagccccttgacgtcatcgaggaggagaggcggttagggtccgggaataaggatagcgtaatggtgcttgtgtttaatccttctgtgggcgagaacaagaccgaggtccctgaaccgctggacccccagagtggacgctctgaagccagagaaagcaaggaggtcactaccagtgtggcagagaatcggaatctcctcgaaaatgctgacaaaattgaatcaacaagtgcacgcgcagatagcgttttaaatatcccggcacccctccacccggagaccaccgtgaatatgacataccaaccgactaccccgagtagctcattccaagacgtgtctgtatttgggatggacgccggttccccccttgtggttccccctccaaccgacagtgctcgtctgcttaatacatcacctaaggtgcccgacaagaacacctgtccgtcaggaatccccaagccagtcttcacacattcaaaggacactccatccagtcaggagggaatggagaattaccaagtagaaaaaacagaggaacgtactgaaacaaagccgatcattatgccaaaacccaaacatgtcaggcctaagattatcacctacattaggagaaacccacaggcactggggcaggttgacgcttctctggtgccagtgggcctcccttatgcccctccaacctgcacaatgccccttccacacgaggagaaagccgctggcggtgatctgaagcccagtgccaatctgtatgagaaattcaaacccgaccttcagaagcctcgcgtgttttctagtgggctcatggtgagtggcatcaagcctcctggtcaccccttctctcaaatgtctgagaaattcctgcaggaagtcactgatcatcccggaaaagaggagttttgctctcccccatacgcccactacgaggttccccctacattctataggtccgctatgctgttgaagcctcaactaggtcttggagccatgagccggcttccaagtgccaagagccggatcctgattgcttcacagcgatccagcgctagcgctatccacccccctggcccaataactaccgccactagcctgtattctagcgatccttctgcagatctgaaaaaagcttccagctccaacgctgccaaatcaaatttaccgaaaagtggattgcgccctcctggctacagtcggctgcccgcagctaagctggccgctttcggcttcgtcagatccagtagcgtaagttccgtttcctctacacagagcggcgatagcgcccagcctgaacaggggagacctgccacacgtagtacattcggcaacgaagaacagcctgtcctcaaagcctccctcccctctaaggatacccccaagggcgctggtagagtcgcaccgccagcatccagttcggttacagcaccgagacgttcgttgctcccagccccaaaatcaacatccacaccagcagggaccaaaaaggacgctcagaaggatcaggatacaaataagcccgctgtgtcctccccaaagagggtcgccgcatcgacaaccaagttacattctccaggctacccaaaacaaagaaccgccgctgccagaaatggcttccccccaaagcccgacccccaggcccgtgaagctgaacgtcagttggttctgcgactaaaagaacgatgtgagcagcagactcggcagcttggggtcgctcaaggcgaactaaagcgtgctatttgcggcttcgatgcccttgccgtcgccacccaacacttcttcaggaagaatgaaagcgccctggtaaaagagaaagaactctctatcgagctggcgaacatacgtgacgaggtggctttccataccgcaaagtgcgaaaagcttcagaaagagaaagaagaacttgagagacggtttgaagacgaagtgaagcgccttggatggcaacagcaagctgagttacaagagctggaggagaggcttcagctgcagttcgaggccgagatggctaggctgcaggaggaacatggggatcaattactatcaatccgatgtcagcaccaggagcaagtcgaggacctcacagcctcacacgatgcagcgctgctagaaatggaaaacaaccacacagtagcaatcacaatactgcaggatgaccacgatcataaagtgcaagaactcatgtccacccatgaattggagaagaaggagctcgaggagaactttgaaaaattaaggctgagtttgcaagatcaggtcgataccctgacctttcaatcccagagtctgcgggatagagcacggcgattcgaagaagccctgaggaaaaacacggaggaacagttagagattgccctggcgccataccaacacctggaagaggacatgaagtcgttaaagcaagtgttagagatgaagaatcagcagatacacgaacaggaaaaaaaaatactggaattggagaaattggccgagaagaacatcatccttgaggagaagattcaggtgcttcagcagcagaatgaggatttgaaggcgagaatcgatcaaaataccgtggtgacgcgtcagcttagcgaggagaacgccaaccttcaggagtacgtcgaaaaggagacacaggagaaaaagcggttgagtcgcactaacgaagaactgttatggaagctccagacaggggaccctacctcgccaatcaagctatcacccacctcccccgtttacagaggaagctcctccgggccttccagccccgctagagtgtccactactcccaggtag

SEQ ID NO: 30219 - DNA, 1041 bp, Artificial Sequence
  Description of Artificial Sequence: Synthetic coding sequence
atgcagcacctgaaaagtaagaagcgcgaggaacgctggatgcgggcatcgaagagacaaagcgagaaggaaatggaggagctgcaccacaatatcgatgacttgctccaggaaaagaagagcctggaatgtgaggtggaggagctccaccgcaccgtccagaagcggcagcagcaaaaagatttcattgatgggaatgtggaatccctgatgacagagctcgaaattgagaagagccttaagcaccacgaagatattgtggacgagatagagtgtatcgaaaagaccctcttaaagaggcgaagcgagctccgggaagctgacagactgctggctgaggccgaaagcgagctgtcctgcaccaaagagaagacaaaaaatgctgtcgagaagttcaccgacgccaaaaggtcactgctccagaccgaatcagacgccgaggaacttgaacggagagcacaggagacggcagtaaaccttgtgaaagccgatcagcagttgagatcattacaggcggacgccaaggatctggagcagcacaagattaaacaggaggagattctcaaagagataaataagattgtggccgctaaggatagcgatttccagtgtctgagcaagaagaaggaaaaattaacggaggaattgcagaagttgcaaaaggatatcgagatggcagagagaaacgaagaccaccatctacaagtgcttaaagagtctgaagtgctattgcaagccaagagagctgaattggagaaactgaagagtcaagtgacttcacagcaacaggaaatggcggttcttgatagacagttgggacataagaaagaagaacttcacctgttgcagggaagtatggtacaggccaaggcagatctgcaggaggccttgaggttaggcgagactgaggtcactgaaaagtgtaatcatatacgggaggtgaagagtcttctggaggagctgtcttttcaaaagggcgaacttaacgtgcaaatcagcgagagaaaaacccaactcaccctgattaagcaagagatatag

SEQ ID NO: 30220 - DNA, 369 bp, Artificial Sequence
  Description of Artificial Sequence: Synthetic coding sequence
atggcgacaagcgcccctctaaggtccctagaagaggaggtcacatgctcaatttgcctggactatctccgggaccctgtgaccattgactgtggccatgtgttttgtcggtcgtgtactacagatgtacggccaatttctgggtctagaccggtttgccccttatgtaaaaagccattcaaaaaagagaatattagacctgtgtggcagctagcatccctggtggagaatattgaacgtctgaaggtagacaaagggagacaacctggggaggtgacccgtgaacagcaagatgcaaagctgtgtgagcggcatagggagaaactgcactattattgcgaagatgacggaaagttgctctgtgtctag

SEQ ID NO: 30221 - DNA, 291 bp, Artificial Sequence
  Description of Artificial Sequence: Synthetic coding sequence
atgagcatcagttccgacgaggtgaattttctggtctacagatatctacaggaaagtggtttttcccactcagcgttcacctttggaattgagtcacatatatctcaaagtaacatcaacggtgccctggtgcccccagcggcactcatctccatcatccagaagggactgcagtatgtggaagcggaggtgtccattaacgaagatggcaccctgttcgatggcagacctatcgagagcctaagtcttatcgacgctgtgatgcccgacgttgtgcagacacgccagtag

SEQ ID NO: 30222 - DNA, 2913 bp, Artificial Sequence
  Description of Artificial Sequence: Synthetic coding sequence
atgctccagcaggtgaatgggcataacccagggagtgatggccaggcacgcgaatatctgcgagaagatctgcaggagtttctcggtggcgaggttttgctgtacaagctggatgacttaacaagggttaacccggtgaccctcgaaactgtcctgagatgccttcaggctaggtatatggctgatactttttacactaacgccggttgcaccttagtagccctgaatccgtttaagcccgttccccaactgtactctcctgaacttatgcgagagtaccatgccgcaccccagccacagaaactgaagccgcacgtttttaccgtcggtgaacagacttacaggaatgtgaaatcactgatcgagcctgtcaaccagtccatcgtcgtttctggcgaatccggcgctggcaaaacctggacatctcggtgcttaatgaaattttacgctgttgttgctacttcccccgctagctgggaaagccacaaaatagctgagcggatagagcagcggatactcaactcaaacccggtgatggaagcgtttggtaacgcgtgcacactgcgcaataacaattcctccagattcggtaaattcatccagctgcaactgaacagggcgcagcagatgaccggagctgctgttcagacgtatctgcttgagaaaacccgggtggcctgccaggccagctccgaacgtaattttcatattttctatcagatctgtaaaggggcttcagaggatgagaggctccagtggcatcttcctgagggggcagccttctcttggctgcctaatcccgagcgttcactggaagaggactgcttcgaagtcacgcgggaggcgatgctccacctgggtatcgacactccgacccagaataatatcttcaaggtcctggcaggcttgctgcatttaggcaacatccagttcgcggcaagcgaggacgaggctcagccctgccagccaatggatgacgctaagtattccgtaagaaccgcggcaagtcttttagggcttccggaagatgttctccttgaaatggtgcagattcgcactattagggcgggaagacagcaacaggtgtttcgcaaaccatgtgcgagggcggaatgtgacaccaggcgcgactgtctagcaaaacttatctatgctcgtctgttcgattggctggtgtccgtgatcaacagctcaatctgcgccgacacggatagttggactactttcattggtctactggatgtatatggattcgaatctttccccgacaatagtctggagcaattgtgcatcaactatgcgaacgagaaactgcagcagcatttcgtggcccattatctaagagctcagcaggaagagtatgctgttgaagggctggagtggtccttcattaattaccaggacaatcaaccttgcctggatctaattgagggcagtcctatttccatctgttccttgataaatgaagagtgtagattgaatcggccatctagcgctgcccaactgcaaacaagaatcgaaactgcactcgctggaagtccatgtctgggtcacaacaagctctcccgagaaccctcgttcatagtcgtgcattatgcaggcccagtgagatatcatacagcaggattagtggagaaaaataaagaccctattccaccggaacttactagattgctgcagcaaagccaggacccccttttaatggggctcttccctacaaatcccaaagagaagacacaggaagagcccccaggtcagagtcgcgcacctgtgctcacggttgtctctaagttcaaagcttcactggagcagctgctgcaggtgctccatagcacaacacctcactacataagatgcataaaaccaaactctcaaggccaagcccaaacattcttacaggaagaggtgttgagccagctagaagcctgtggtctggttgaaactatccatatctccgccgcaggctttccaatcagggtgtctcataggaacttcgttgagagatacaagttgctgaggagactacacccctgtacttcaagtggccctgattccccataccccgcaaaaggtttgcctgaatggtgtccccacagcgaggaagcgacactggagcccctcatccaggacattctgcacaccttgccggtgcttactcaagcggcagctattactggcgacagcgccgaggccatgcctgctcccatgcactgtgggagaaccaaggtgtttatgacggatagcatgttggagctgctcgaatgtggtcgcgcaagggtactggaacagtgtgctcggtgtattcagggaggttggcggagacatagacaccgcgaacaggaacgacagtggcgcgctgtgatgctcatccaggccgcaattcgttcatggttaacacggaagcacattcagagactgcacgcagctgccaccgtgatcaaacgggcttggcagaagtggaggatccgcatggcatgtctggccgcaaaggagctggatggcgtcgaggagaaacactttagtcaagcgccatgctctctgtcaacgtccccactccagactaggctgctcgaggccataatacgactgtggccactaggtctggtgctggctaatacagccatgggggttggttccttccagcgcaagttagtggtctgggcatgcctccaacttcccagaggctctcccagctcttataccgtgcagacggcccaggaccaggctggcgtgacatctattcgcgcacttccccagggttcaatcaagtttcactgtagaaagtctccgctcaggtatgcagatatttgtcctgagccatccccttacagcatcaccggctttaaccagatacttctagaacgacacaggttaatacacgttactagctctgcctttactggcttgggttag

SEQ ID NO: 30223 - DNA, 3303 bp, Artificial Sequence
  Description of Artificial Sequence: Synthetic coding sequence
atgtcatattaccagcgccctttctcgccctctgcctacagcctacccgcatctctcaacagttccatcgttatgcagcatgggacaagcctggactctacggacacatatccacagcacgcccaatctctggacgggactacgtcctcctccatccccctgtacaggtcatccgaagaagagaagagggtgactgttatcaaagctccccactatccgggtatcgggcctgtcgacgaaagtggcatcccaacagcaatccgcacgacagtggacaggcccaaggactggtataagaccatgttcaagcagattcatatggtgcataaaccagacgatgacacggatatgtataacactccctacacatataacgctggtttgtataacccaccttattctgcacagagtcaccccgctgctaagacccaaacgtatcggccactgtcaaagtcacacagcgataacagtcctaatgcatttaaggatgcctcttctcctgttcctccaccgcacgtgccccctccggtgccaccactgaggccccgagaccgaagttcgacagaaaaacacgactgggatccgccagatagaaaggtagacacgcgtaagttcagatccgagcctcgctctatttttgaatacgaacccggaaagagttctatcctgcaacacgaaaggcccgcaagtctgtatcaatctagtatcgaccgctctctggaacggcctatgtccagtgcatccatggccagcgattttaggaagaggagaaagtctgaacccgctgtgggacccccaagagggctcggcgatcagagcgcatcacggacgagcccagggagagttgacctgcctgggtcatccacaacattaaccaaatcattcacctcgagttcaccctcctccccgagcagggccaaaggaggggatgactctaaaatctgcccctccctgtgctcttactctggcctgaacggcaaccctagttcagagttggactattgtagtacgtatcggcagcatctggatgtgcctagagattccccaagggcgataagcttcaaaaacggctggcagatggctcggcagaatgccgaaatatggtcctccacggaggagacagtctctcccaagattaagtcccggagctgtgatgatctcctaaacgatgactgtgacagcttcccggatcctaaggtcaaaagcgagtccatgggtagtctcttgtgtgaagaggattccaaggaatcctgtcccatggcttgggggtccccctatgttccagaagtacgctcaaacggtcggagccgtattcggcataggtcagcaagaaacgccccaggattcttgaagatgtataagaaaatgcaccgaatcaatcgtaaagatcttatgaattcagaagtgatatgtagtgtgaagagtcggatcctccagtacgaaagcgagcaacagcacaaagatctgctaagagcttggagtcaatgtagtactgaagaggtcccgagggatatggtacctacacgcatttctgagttcgagaagttaatccagaagagtaagtccatgcctaacctcggcgatgatatgctctctcccgtgactctagaaccacctcagaacggactctgcccgaaaaggcgattttcgattgaatacctgcttgaagaagaaaatcagtcaggaccacctgccagaggacgcaggggctgccaatccaatgcattagttcctatacacattgaggtcacttccgatgaacaacccagagcacatgtggagtttagtgatagcgatcaggatggggtggtgtccgaccatagcgactatattcacctggagggctcaagcttctgttctgagagtgactttgatcacttctctttcactagtagtgagtcattctacggatctagccatcaccaccatcaccaccaccaccaccatcaccggcacctcatatctagttgtaagggaagatgccctgccagctacacaaggtttactaccatgcttaagcatgaaagggccaggcacgaaaacaccgaagaacctaggcgccaggaaatggatccaggcctcagcaaactggcctttctggtgtcgcccgtgccattccggaggaaaaaaaatagtgctccaaaaaaacagacagaaaaggcaaagtgtaaggcgtcggtgttcgaggccttggactcagcgctaaaggatatttgtgaccagatcaaggctgagaagaagaggggctctctgccagataatagtatcttgcaccgacttattagcgagttgctgcccgatgtccccgagcgtaattcaagcctgagggcactcaggcgaagtccactgcaccagccgctccaccccttgccgcctgacggtgctatccactgccctccttaccaaaacgattgtggccgaatgcctcgctcagcttcctttcaggacgtggacaccgcaaattccagttgccaccaccaagatagaggtggcgcactccaagaccgagaaagcccgaggtcttatagcagcactctgacagatatgggcaggtcagccccacgggaaaggagaggtaccccagaaaaagagaagctgccagctaaagccgtctacgatttcaaggcgcaaacaagcaaggagttgtcatttaagaaaggggacacagtatacattctgcgtaaaatcgaccagaactggtatgaaggcgagcatcacggcagagtgggaatattcccaatcagctacgttgaaaagctgacaccgcctgaaaaggcccagcccgctcgacctccgcctcccgcacagccaggcgagatcggggaagctatagctaaatacaatttcaacgccgacacaaatgtggagctgtcacttcggaaaggcgacagggttatactgcttaaaagggttgaccagaactggtacgagggaaaaattcctggaaccaataggcaaggcattttccccgtcagttacgtcgaagtagtgaaaaagaacaccaagggggcagaggactacccggatcccccaatcccacatagctattcttctgatcggatacactcgctgtcttcgaacaaaccacagcgaccagtgttcacacacgaaaacatccagggtggaggagaacctttccaggccctctataattatactccacgcaatgaggatgagttagagttgagagaatctgatgtgattgacgtgatggagaaatgcgacgatggatggttcgtgggaaccagtcggcgaaccaaattctttggcacttttccaggaaattatgtgaagcgactctag

SEQ ID NO: 30224 - DNA, 390 bp, Artificial Sequence
  Description of Artificial Sequence: Synthetic coding sequence
atggccgagcttattcagaagaaactccaaggggaggtggaaaagtaccagcagctgcaaaaggacctcagcaaatctatgtctggaaggcaaaagctggaggcacagctgactgagaataacatcgtaaaagaggagctggctctgcttgatggaagcaacgtggtgtttaagctcctcggaccagtgctggtcaaacaggaactaggcgaagcccgtgctacagtcgggaagagactggattacatcacagcagagattaagcgttatgagagtcaactgcgcgatttagaaaggcagagcgagcaacagcgcgaaacacttgctcagctacagcaggaatttcagagggcccaggcagccaaagctggagcacctgggaaagcctag

SEQ ID NO: 30225 - DNA, 498 bp, Artificial Sequence
  Description of Artificial Sequence: Synthetic coding sequence
atgtcacttcacgggaagcggaaggaaatatacaaatacgaagccccttggaccgtctacgccatgaattggtctgtgcggccagacaaacgttttcggctggcactgggatctttcgtcgaggagtacaataataaggtccaactggtggggcttgacgaggaaagcagcgaatttatttgtagaaacaccttcgaccacccctaccctaccaccaaacttatgtggattcctgatactaaaggcgtctatcctgatctgctggctaccagcggggattatctgcgggtgtggagagtcggtgagaccgagacacgactggagtgcctgctaaacaacaataagaatagcgatttctgcgcacccctgacatcctttgattggaatgaggtagacccatatttgctgggcacaagcagtatcgataccacatgctgttttcagtggccagtctgtctgtctctcttatgcacccactgttaccagaagcttttgtag

SEQ ID NO: 30226 - DNA, 1044 bp, Artificial Sequence
  Description of Artificial Sequence: Synthetic coding sequence
atgtccttggcacagagtcctggaatctggggagaagaccctgtcaagttgacactggcccttaaaatgacaaggcaggatctgacacgaacccagatggaacttaacaacatgaaggcgaacttcggagacgtggtacctcgaagggattttgaaatgcaagaaaagacgaataaagatctgcaggagcagctggatacacttagagccagctatgaggaggtgcgcaaggaacacgagatcttaatgcagctccacatgagtacacttaaggagcgagatcagttcttctctgagctacaggaaatccaacgcacatcgacaccacggcctgactggaccaaatgcaaagacgtggtcgccggtgggccagagagatggcagatgctagcggagggtaaaaacagtgaccagctggtggacgtcctcctggaagagatcggcagcggcttgctccgggagaaggatttttttcccggactgggatacggagaagcaatcccagcattcctcagatttgatgggctagtggagaataagaaaccttcaaagaaagatgtggtgaatctgttgaaggacgcttggaaggaaagactggctgaagaacaaaaggaaacgttccccgatttttttttcaacttcctcgaacatcgctttggaccatctgatgctatggcgtgggcatatacaatctttgagaatatcaagatatttcacagcaacgaggtcatgtcacagttctatgccgtcctgatgggcaagaggtctgagaacgtgtatgtcacccaaaaggaaaccgttgctcagctgttgaaggagatgaccaatgcagatagccagaatgaagggctgctcacgatggaacaattcaataccgtgctgaaatctaccttccctctgaaaacagaagaacagatccaagaactgatggaagcaggcggatggcacccctcttcttcgaatgccgacttgcttaattatagatcactgtttatggaggacgaggagggccagtccgaaccctttgtacagaaactttggtag

SEQ ID NO: 30227 - DNA, 219 bp, Artificial Sequence
  Description of Artificial Sequence: Synthetic coding sequence
atgtggagcttgactgcctccgagggggagagtacaactgcccacttcttcctcggtgcaggtgacgaaggattagggactcggggaataggcatgcggccagaagaatctgatagcgagctgctggaagatgaagaggacgaggtgcctccggaaccgcagatcatagttggaatctgcgccatgaccaaaaagagcaagagcaagcccatgacatag

SEQ ID NO: 30228 - DNA, 1149 bp, Artificial Sequence
  Description of Artificial Sequence: Synthetic coding sequence
atgttaaggtggacagtgcatctggaaggaggaccaagaagagtgaatcatgctgcagtagcggtgggccaccgcgtttattcgtttgggggatattgttccggggaagattacgagacactcaggcagatcgacgttcacatcttcaatgccgtgtcactcaggtggacaaagctacctcctgtaaaatccgctatacgcggacaggcaccagttgtgccttacatgcgctatgggcactccacagtgctgattgatgacactgtactgctatgggggggaagaaacgatacagagggcgcatgcaacgtactgtacgccttcgacgtgaacacacacaagtggttcactcctcgagtgagcggcacagtgcctggcgcacgggacggtcattctgcctgtgtcctgggcaagatcatgtatatttttggaggctacgagcagcaagcagactgtttcagcaatgacatacacaaactggacacttcgacaatgacctggactctgatctgtacaaagggaagtcctgcgagatggcgagacttccattcagccaccatgctcggctcccacatgtatgtatttggaggtcgtgccgatcgctttgggcctttccactcaaacaatgagatctattgcaaccggattagagtgttcgacactcgcactgaggcttggttagattgccccccaacaccggtgttgcctgaggggcgtcggtcccattctgccttcgggtacaatggggagctgtatatctttgggggttataatgcacgactcaatcgacactttcatgacttgtggaaatttaatccagttagcttcacttggaagaagatcgagcctaaaggtaaagggccatgtcctcgcagaaggcaatgttgctgtattgtcggagacaaaatcgtgttattcggcggaacatctcctagccctgaggaggggctgggagatgaattcgatctgatcgaccatagtgacctgcatatactggatttctccccatcgctcaaaactctttgtaaacttgcggtgatacagtacaatctcgatcaatcttgcttaccccacgatattcgctgggagttgaacgcaatgactaccaatagcaacatctcgaggcctattgtgtctagccatgggtag

SEQ ID NO: 30229 - DNA, 1620 bp, Artificial Sequence
  Description of Artificial Sequence: Synthetic coding sequence
atggcaacgagtgcccctttgcggagtctcgaggaagaagtgacctgctctatatgtctggactaccttcgggaccccgtgacgatcgactgtgggcacgtgttctgtcggtcctgcacaacagacgtgaggccgatttccggcagtcgtcccgtgtgtcctctctgcaaaaagcctttcaagaaggagaatattcgtcctgtgtggcagctggcttctcttgtggagaacatagaaaggttaaaagttgacaaggggagacagcccggtgaagttactagggagcaacaggacgccaaactgtgcgagagacatcgggaaaaattgcactactactgtgaggacgacggcaaattgctttgtgtcatgtgtagggaatctcgcgagcatagacctcacactgcggttcttatggaaaaggccgcacagccacaccgggagaaaattctcaatcacctgtcaactttgagacgagacagggacaagatacagggcttccaggccaagggggaagccgatatcttggccgctttaaagaaactccaggaccagcgccagtacatagtagctgaattcgagcagggccaccaatttctccgcgaaagggaggaacatctcctggagcagctggctaaactagaacaggaattgaccgaagggagggaaaagttcaaatcaagaggagtcggtgagttggctcgcctggccctagtgatttccgaactcgaaggaaaggcccagcagccagccgcagagctgatgcaggacacccgcgactttctgaacaggtatccacggaaaaaattttgggtcggtaagccaatagcgcgagtggttaaaaagaaaactggcgagttcagcgataaactcctgagtctgcagagaggtctccgagagtttcagggtaagttgcttcgtgatctcgagtataagacagtgtcagttaccctggacccccaaagcgccagtggctacctccagctctccgaggattggaagtgcgtgacctacacatcattatataaaagcgcatatctacacccgcaacagtttgattgtgagccaggggtgctggggagcaaaggcttcacctggggcaaggtctactgggaggttgaggtggagagggagggatggtccgaggacgaagaagagggtgacgaggaggaggaaggcgaagaagaggaagaggaagaagaagcaggatacggcgatggatatgatgactgggaaaccgatgaagacgaagaatcactgggagatgaggaggaggaagaagaagaagaagaagaggaagtactagagtcctgtatggtgggtgtggcacgggattcagtgaagagaaagggcgatctgtcactgcgccctgaagatggggtctgggcccttagactgtcatcgagcgggatttgggccaacaccagtcctgaggctgaactcttcccagctcttagaccgaggcgggtgggtatagcgctagattacgaaggcggtaccgtgacctttaccaacgcggaaagtcaggagcttatttacaccttcactgctaccttcaccaggcggctggtaccctttctttggctaaaatggccaggcacgcgacttctactcagaccctag

SEQ ID NO: 30230 - DNA, 390 bp, Artificial Sequence
  Description of Artificial Sequence: Synthetic coding sequence
atggcagaactcatacagaaaaagttacagggtgaagtggaaaaatatcagcagctgcaaaaagacctctcaaaatcgatgagtggtcgtcagaagcttgaagctcagctaacagagaataacatcgtgaaggaagagttggctctgctcgatggatccaacgtggtgtttaagcttctgggtcccgtccttgttaagcaggaactgggagaggcccgtgcaaccgtaggtaagcggttagactatattaccgcggaaataaaacggtacgaaagtcagctgcgggatctggagcgtcagtcagagcaacaaagagagactcttgcccagttacagcaggagttccaacgggctcaagctgccaaggctggtgctccaggcaaagcttag

SEQ ID NO: 30231 - DNA, 1089 bp, Artificial Sequence
  Description of Artificial Sequence: Synthetic coding sequence
atgctcaaaaacaagggacatagctctaagaaagataatctggccgttaatgcagtggctctgcaggaccatatcctgcacgacttacagctgcgaaacttatcggtggcagaccactccaagactcaggtgcagaagaaggaaaacaagagcctgaaacgagacaccaaagcaatcatcgacacaggtcttaaaaagactacgcagtgcccaaagctggaagacagcgagaaggagtacgttttggatcctaagcccccaccccttacactggctcagaaactcgggctcattggcccaccacctccccctctcagtagcgacgagtgggaaaaagtcaaacagaggtctctactgcagggggattcagtgcaaccctgtcccatttgtaaagaggagtttgaattgaggccgcaggtgttgctgtcgtgctcacacgttttccacaaggcatgcctgcaggcgtttgagaaatttactaacaaaaagacttgtccactctgccggaaaaatcagtaccaaacgagagttattcacgacggcgctcggctattcaggattaagtgtgtaactagaatccaggcatactggagagggtgtgtggtacgtaagtggtatcgaaacctgaggaaaaccgtccccccaaccgacgcgaagctccggaagaagttcttcgagaagaagtttactgagattagccaccggattctgtgcagctacaacaccaacattgaagaactgttcgccgagatcgatcagtgcctggctatcaataggtctgtccttcagcagctggaagagaaatgcgggcatgaaataaccgaggaggagtgggagaaaattcaggtgcaggccctccggagggagacccatgaatgcagtatctgcctggctcccctttctgccgcagggggacagcgggttggcgcagggcgacggagtagagagatggccctgcttagttgctcccatgtgtttcaccatgcttgcttgctcgcgttggaagagttcagcgtcggggatcgtcctccttttcacgcctgtcccctgtgtcgaagctgctatcaaaagaaaattctcgaatgttag

SEQ ID NO: 30232 - DNA, 1266 bp, Artificial Sequence
  Description of Artificial Sequence: Synthetic coding sequence
atgagcgccctccggcgatcaggctatggcccttccgacggcccttcttatggacgatattacggcccaggaggaggggatgtgcccgtccaccctccgcctcctctgtaccctctcaggcccgagccccctcaacccccaatttcctggcgagttcgtggtggtggccctgccgagacaacctggttgggtgaaggtggaggaggcgacggttattacccatcagggggtgcttggcccgagcccggacgcgcagggggtagtcatcagtccctcaacagttacaccaatggagcatatggaccaacatatcctcccggaccaggcgctaatacagcaagctatagcggtgcctattatgcgcctggatatacccagacaagttacagcactgaagtgccctccacttatcgctcctctgggaattcccctacacccgtgtctcgatggatctacccacagcaggactgtcagaccgaggcccctccactgcgcggacaggtccccggatatcccccatcacagaatccaggcatgactcttccacattatccatacggcgacggcaaccggagcgtaccccagtcagggcctacagtccgcccacaggaagacgcatgggcgtcccctggtgcttacggcatggggggtcgttacccctggccatcaagcgcacctagcgccccacctggtaatttgtacatgaccgaaagcacaagcccatggcccagctcaggctcgcctcagtccccaccttcacctccagtccagcagccgaaggatagttcctatccatattcccagtctgaccaaagtatgaacagacacaacttcccctgtagcgttcaccagtacgaatcaagcggcactgtcaacaatgacgacagcgatctgctggattcccaggtgcagtattcagccgagcctcaactatacgggaacgcgacctccgatcacccaaacaaccaggatcagtcaagcagtctacccgaggaatgcgtaccctctgacgaatcaaccccaccatcaatcaaaaaaatcatccatgtcctcgagaaggttcagtacctcgaacaggaggtggaggaatttgtcggtaagaaaacagataaggcatattggctcctggaggagatgctgactaaagagcttctggaactggattctgtggagactgggggtcaggacagcgtcaggcaggcgagaaaagaagccgtctgtaaaattcaggccatcctggagaaactggagaaaaaaggattgtag

SEQ ID NO: 30233 - DNA, 321 bp, Artificial Sequence
  Description of Artificial Sequence: Synthetic coding sequence
tgaaacctccgggagggcgcagagcagaaggtggtgtttattacagggagagtccatcctggggagaccccaagtagtttcgtgtgccaaggcataatcgatttcctcgtttctcaacatcctatcgcctgcgtgctgcgtgaatatttagtgtttaagatcgcccctatgctcaaccctgacggtgtgtacctgggtaattacaggtgtttgagcctgatgcgaaacggttcacgcggtcgccctttcttccctagcagctccgctcgaatgctccgcaccagtccgataccagcccacccactcactggaacactttag

SEQ ID NO: 30234 - DNA, 684 bp, Artificial Sequence
  Description of Artificial Sequence: Synthetic coding sequence
taactcatttttgcttgtttggttccaggctttcctgcggtcatgagctcccgaggcccttgtactttagaaactctgatcaacccatcaccctcagtagccgatgtgaaaatttatccagaggaaatcactccacttttacccgctatttctggcgaaaagattgctgaagatcagacttgcttctttctgcaaatattgctcaagtatatggtaatacaagctgccagcttagagtggaaaaacaaagaaaatcaggatacgggattcaaattcctgttcacactgtttcgcaaatactaccttccacacctgtttccatcgtttactaaactgacaaacatttataagcctgtgcttgacattccccaccttcgcccaaaacccgtttatattactactacaagggataatgagaacatttactcaactaaaattccatatatggccgctcgggtcgtttttataaagtggattgtgacttttttcctggagaagaaataccttaccgccacccagaacactaaaaacggtgtggacgtcctgcccaagattatccagaccgtaggcggtggagccgtgcaggaaagagcgcctgaacttgatgggggtggtccaacagagcaggacaagtcccactcgaatagcagcaccttatcagatcgtagactctcaaactcatag

SEQ ID NO: 30235 - DNA, 573 bp, Artificial Sequence
  Description of Artificial Sequence: Synthetic coding sequence
atggaaccccctatggaaccaagtgggggtgagcaggaaccgggagccgtgcgctttttggatctcccatgggaggatgtacttcttccccatgtcctgaatagagtgccactgcgtcagctgttgcggttgcagcgcgtctcaagagcgtttcgaagtctggtgcagctgcatctggcagggctgagaaggttcgatgcagctcaagtggggccacagattcccagggccgctctggcgagactcctgcgagatgcagaaggtcttcaggaactggcactggcaccgtgtcatgaatggctgtccgacgaagatttagtccccgtcttagccagaaatccgcaactgcggagtgtcgctctcgggggttgcggacagttatcccgacgggctctgggagcactcgccgaaggttgtccaagactacagcggctctcgctggcgcactgcgattgggtagacggcctggcgcttcggggtctggccgacagatgccctgctctggaggagctggatctcaccgcatgtcgccagctgaaggatgaggctatcgtctacttagcacaacggtag

SEQ ID NO: 30236 - DNA, 270 bp, Artificial Sequence
  Description of Artificial Sequence: Synthetic coding sequence
atgtcggagcagggcgatctaaatcaggcaatcgccgaagagggaggtactgaacaagagaccgcaactccggaaaacggcattgttaaatccgagtctctggatgaggaggaaaagctagagctgcagagaaggttggaagcccagaaccaggagcgtagaaagagtaagtctggggctggcaaggggaagctaactagatcccttgcagtgtgcgaagaaagttccgccaggcccggtggcgagtccttacaggaccaaactctctag

SEQ ID NO: 30237 - DNA, 381 bp, Artificial Sequence
  Description of Artificial Sequence: Synthetic coding sequence
atgaccacccgtagtgtgctggacgtcgaaaccttcgtggccgatatacttaagggtgaaaatttgtccaaaaaagcaaaagaaaagagggagagcctcatcaagaagatcaaagatgtgaaaagcatctacctccaggaatttcaggataagggcgatgcagaggatggcgaggaatatgatgacccgtttgcaggtccacctgatacaataagcctagcttcagaacggtatgataaagacgacgaggcaccttccgacggtgctcagtttccgccaatcgccgcacaggatttaccctttgtgctgaaggctggatatctcgaaaagcgaagaaaagatcactcattcttgggcttcgagtggcaaaagcgatggtag

SEQ ID NO: 30238 - DNA, 678 bp, Artificial Sequence
  Description of Artificial Sequence: Synthetic coding sequence
atgctgtcagctgtagccagagggtaccagggatggtttcacccctgcgctagactgtctgtgcggatgtccagcacgggaattgaccgaaagggagtgttggccaatagagtggcggtggtcactggcagcaccagcggcattgggtttgccatcgcacgcagactcgcgcgagacggcgcacacgtcgttatatcatcaagaaaacagcaaaatgtggatagggccatggctaaactccagggtgagggactgagtgtggctggcatcgtgtgccatgtcggcaaggccgaggatcgggaacaactggtggccaaggccttagagcattgcgggggagtagatttcctggtatgtagtgcgggagtcaatcccctcgtgggatcaactctgggtacctccgagcaaatttgggataagattttatcagtcaacgtgaaatcaccggcactgctgctatcacagctgctgccttatatggagaatcgaagaggcgctgtgatcctggtcagttccatagcagcttacaatcccgtggtggctctcggggtatacaatgtcagcaagaccgctctcttgggcctcactcggacacttgcactggagctggcgccaaaagacatcagagtgaactgtgtggtccccggtatcatcaagacggatttcagcaaagtgtag

SEQ ID NO: 30239 - DNA, 1080 bp, Artificial Sequence
  Description of Artificial Sequence: Synthetic coding sequence
taagctactgccatgacctccgcgtggctcgctcagggaactggcgagggcgtgaatgacgtccgcaagggggcttgcgcctcccacgtgtccacgatggctagttttcttaagggggctcacgttaccatcaatgcgagagccgaggaagatgtggagcctgaatgtatcatggaaaaagtcgccaaggcctcaggcgcaaactattctttccacaaagaatctggcaggttccaggacgttgggccacaggctccggtcggctctgtctaccaaaagacaaatgccgtctcggagatcaaacgtgtaggcaaggacagtttctgggctaaggccgagaaagaggaagaaaatcggaggctggaagaaaagagacgggctgaggaggcacagaggcagctcgaacaggaacgcagggagcgggagttacgcgaagcggctcgacgggaacagcgatatcaggaacaggggggagaagcctcaccacagcgtacgtgggagcagcaacaggaggtcgtttcacgcaatagaaatgagcaggagtctgccgtgcacccaagagagatctttaagcaaaaagaacgagcgatgtccacaacgtcaatttccagtccccagcctggcaagctccgctcgcctttcttgcagaaacagctgactcagcctgagacccatttcggccgagagccagcggctgctatttccagacctcgggcagatctccccgcagaggagcctgcaccctctacaccgccatgtttggtgcaagcagaggaagaggccgtgtacgaagaaccacccgaacaggaaaccttttacgaacagccaccgcttgtgcagcagcaaggagcgggaagcgaacacatcgaccaccatattcagggacaaggcctctcaggacagggactatgcgctcgcgcactgtatgactaccaggccgctgacgacacagaaatcagcttcgatcctgagaacctgatcacaggcattgaggtgatcgacgagggctggtggcgtgggtatggccctgatggccacttcggcatgttcccagccaactacgtggagcttatcgaatag

SEQ ID NO: 30240 - DNA, 483 bp, Artificial Sequence
  Description of Artificial Sequence: Synthetic coding sequence
atggaagccgaacgccctcaggaggaagaagacggggaacagggaccccctcaggacgaggaggggtggccaccgcctaactcgacaacaaggccgtggcgcagtgccccacccagccctccccctcccggtacgaggcatactgcactggggccaaggtccgcgtccttactgtccctccagacagaactactattggatcttgtcgccgaagcccagtcccgacggctggaggagcagagagcgacgttttacacccctcagaacccctccagtttggcccctgctcccctaaggcccttggaggatcgggagcagctgtactcgaccatactgtcacaccagtgccagaggatggaggcccagcggtccgaaccgcctctgccgcctggtggtcaagagctcctggagctccttctcagggtgcagggcggaggcagaatggaggagcagaggagcagaccgcctactcacacgtgctag

SEQ ID NO: 30241 - DNA, 2616 bp, Artificial Sequence
  Description of Artificial Sequence: Synthetic coding sequence
atgggcgattccgatgacgaatacgataggcgcaggagagacaaattccgtcgagaacggtccgactatgacaggtctagagaacgggacgagcgacgaaggggtgatgattggaatgatagagaatgggataggggcagggaacgccgtagtagaggtgagtatagagactacgacagaaatagacgggagcgcttttcaccaccgaggcacgaactgagtcctccccagaagcggatgaggagagattgggatgaacactcctccgacccttatcattctggatacgagatgccctatgccggaggtggtggaggccctacttacggtcccccacagccttggggtcacccagacgttcatatcatgcagcaccacgttcttcctatccaggcacgattggggagtatcgccgaaatcgacctcggagtcccaccacccgttatgaaaactttcaaggagttcctgttaagtctcgatgactcggtcgatgagacagaggcggtgaagagatacaacgattacaagctggatttccgaaggcaacagatgcaggactttttcctggcccataaagacgaggaatggttccgatcaaaataccatccagatgaggttgggaagaggcgccaggaggccagaggcgctctgcaaaaccgactccgagtctttctatctctcatggaaaccggctggtttgataacctgttgcttgatatcgacaaggccgatgctattgtcaagatgctggacgccgcagtcataaagatggaaggagggacggagaacgaccttaggatcttggaacaggaagaggaagaggagcaggccggaaagccaggggagccctctaagaaggaggagggccgtgctggggcaggattgggtgatggggaacgcaagacaaacgataaggatgagaagaaggaggatgggaagcaggccgagaatgacagctccaatgacgacaagactaaaaaatctgaaggggatggcgataaggaggaaaagaaggaggacagcgaaaaagaagctaagaagagctcgaagaaacgcaaccgcaaacattccggcgacgactccttcgatgaaggctctgtttctgaatcagaatcggagagtgagtcaggtcaggcagaggaagaaaaggaagaggcagaggcgttaaaggaaaaagagaagcccaaggaggaagagtgggaaaagccaaaagatgccgcagggttggaatgtaaaccacggccattacacaagacttgtagcctatttatgcgaaacatcgcaccaaatatctcaagggcagaaataattagtctatgtaagcgctatcccggattcatgagagtggcactgtccgagccgcagcccgaacgaagattctttaggcgaggatgggttacattcgataggtctgtcaatatcaaagaaatttgttggaacctccagaacattaggcttcgagagtgtgaactaagtcccggtgtcaaccgcgacctcacacgacgggtgcggaacatcaatggtataactcaacataaacagatagtgaggaacgacatcaagctggctgcaaagctcattcatactctcgacgatcgcactcagttgtgggcaagcgaaccgggtacacccccattaccaacctctctcccatcacaaaacccaatcctaaagaatatcactgattacctgattgaagaagtctccgctgaggaagaggagcttctgggctctagtggcggagctcctcctgaagaaccacccaaggaaggcaatccagccgagataaatgtggaaagggacgaaaagctgataaaggttttagacaagctgttgctatatctacgcatcgtccactccctggattattacaacacatgcgaataccccaacgaggacgagatgcctaacagatgcggcatcattcatgtgaggggcccaatgcccccaaataggatctctcacggagaagtcctggaatggcagaaaaccttcgaggaaaagttaactcccctgctgagcgtgagagaatcattgagtgaggaggaggcacagaaaatgggcaggaaagaccccgaacaggaggtcgaaaagtttgtaacaagcaacacacaagagctgggtaaggacaaatggctgtgccctttatccggtaagaagttcaagggaccagagtttgtgcgcaagcacatctttaataagcacgccgaaaaaattgaggaggtcaagaaggaagtcgctttctttaacaatttcctaacagacgcaaagagaccagcattacccgaaatcaagccggctcagccaccgggtccagcgcaatcattaacgcctggattgccctacccgcatcagacaccacaagggctgatgccctatggacagcccaggcctccaatccttggctacggagccggtgccgttaggcctgccgttcccaccggagggcctccatacccacatgctccctatggggctggcagaggcaactatgacgcttttagaggacaaggcggatacccgggaaaacctaggaacaggatggttcggggtgaccccagggccatcgtcgaatacagagacctcgacgccccagacgatgtcgactttttctag

SEQ ID NO: 30242 - DNA, 2025 bp, Artificial Sequence
  Description of Artificial Sequence: Synthetic coding sequence
atgcagacgtccagctcacgcagcgtgcacctatcggagtggcagaagaattattttgctattacctcagggatctgtaccggcccaaaggcagatgcctaccgcgcacaaatacttcggattcagtacgcctgggccaacagcgagatcagccaggtctgtgcaaccaaactttttaagaaatacgcggaaaaatactcggccataatcgactctgacaatgtggagtcaggattgaacaattacgcggagaatatcttgactttagcaggttcgcaacagactgacagtgataaatggcagagtggtctgagcatcaataacgtcttcaaaatgagtagcgtgcagaaaatgatgcaggcaggcaaaaagttcaaagactcgctactggagccggctctcgcaagcgtcgttatccacaaggaggccaccgtttttgatctgccaaaattttctgtatgcggctcatcacaagaatccgatagtctcccaaatagcgctcatgacagggaccggacacaggattttcccgagtccaaccgactcaaactcctgcaaaatgcccaaccccctatggtgaccaacacagccaggacatgccctacgtttagcgctcctgtgggcgagtccgctaccgcaaaatttcacgtaacccctttgttcgggaacgttaagaaggagaatcactctagcgctaaggagaatatcgggctcaatgtgttcttatccaatcagagctgcttcccagccgcatgtgaaaacccacagcggaagtccttttatggcagcggaaccatcgacgctctttccaacccaatcctgaataaagcgtgttccaaaaccgaggataacggccctaaagaggactcgagtctgcctacctttaagacagcaaaagagcagttatgggtggatcagcagaaaaaataccatcaaccgcagagggccagtggcagttcttacggcggagtgaagaaaagcttgggtgcttctcggtcacggggtattcttggtaagttcgtccctccaatccctaaacaggacggcggagagcaaaacgggggtatgcagtgcaaaccctatggagcagggcctaccgaacctgcgcatcccgtggatgagcgtctgaaaaacttggaacccaagatgattgagctaattatgaatgagatcatggaccacgggcctcctgtgaattgggaggacatagccggtgtggagtttgctaaggccacaataaaggaaatcgtcgtatggcctatgctgcgccctgatatatttaccgggctgagggggccacctaaagggatcttactcttcggtcctcctggtaccggaaaaacgctaataggcaaatgtatcgcctcacagtccggcgctacttttttctcgatcagcgcctctagcttaacctcaaaatgggtcggcgaaggcgaaaagatggtgagagcgctgtttgccgtagctaggtgccagcagcccgctgtcatttttatcgacgagatcgatagccttctgtcacagcgaggagacggagagcacgagtccagccgaaggatcaagacggagtttcttgtgcagttggacggcgctaccacttctagtgaagatcgcatcctggttgtcggggcaaccaatcgaccacaggaaatcgacgaggcagcgaggcggagactcgtgaagaggctgtacatcccactgcccgaggcatctgccaggaaacaaatcgtgatcaaccttatgtccaaagagcagtgttgtctctcagaggaggagatcgagcagattgtccagcagtctgatgcttttagcggtgcagacatgacgcagctgtgcagagaggcatcactggggccaatccggagcttacaaaccgcagatatcgccacaatcacacctgatcaagtgcgccctatcgcatacatcgatttcgagaatgccttccgcaccgtgcgcccatcagtctcccctaaagacttggaactgtatgagaactggaataaaacatttggctgcggtaagtag

SEQ ID NO: 30243 - DNA, 1467 bp, Artificial Sequence
  Description of Artificial Sequence: Synthetic coding sequence
atgtccgatgaggtgttcagtactaccctggcgtacacaaagtcaccaaaggtgacaaaacgtaccaccttccaggacgagctgatacgggcaataaccgcacgcagcgctcgccagaggtcgtcagaatacagcgatgactttgattcggacgaaatcgtctctttgggtgacttttcagacacatccgctgacgagaattccgtcaataagaagatgaacgactttcatattagtgacgacgaagagaagaaccctagtaagctgctgttcctgaagacaaacaagtctaacggtaacatcactaaagacgagccggtgtgtgccatcaaaaacgaggaggaaatggcccctgatgggtgtgaggatatcgtcgtaaaaagtttctccgagtctcagaacaaagacgaggagtttgagaaagacaagatcaaaatgaaaccgaagcctagaatcttaagtatcaagtctacctcaagcgagaacaattctttggataccgacgatcatttcaaaccttcaccacgtccaagatccatgctgaagaagaagagccatatggaagaaaaggatggcctggaggataaggagactgcactgtccgaggaactagaattacattctgcaccatctagcttaccgacccctaatggcatccagctcgaagcagaaaagaaggcattctcagaaaatctggacccggaggatagttgtctaacatccctggcttcctccagtttgaagcagatccttggggattctttctctcccggaagcgaggggaatgcctcaggtaaagatccaaacgaagagatcacggaaaatcacaatagtctgaagtcagacgaaaataaggaaaactctttctccgccgaccacgtcacaacagcggttgagaagagtaaggaaagtcaggtcacggctgatgacctggaggaggagaaggctaaagccgaactcatcatggacgacgacagaaccgtcgacccgctgctaagcaagtcacaatctatacttatctcaacatctgccacagcctcgtccaagaaaactattgaggaccgaaatataaaaaacaagaagagtacgaacaacagggcatcgagcgcttccgctaggctcatgacttcggagttcctcaagaaaagttcttctaagaggcgcaccccatcaacaactacaagcagtcactacctcggaaccctcaaggttttggaccagaagccttctcaaaagcagtccatcgagcctgatcgcgcagacaatattcgggctgctgtttaccaggaatggttggagaagaagaacgtttatttacacgagatgcacaggataaagcggatcgaatctgagaacttgaggatccagaatgagcagaagaaggctgctaagcgggaagaggccttagcgtccttcgaggcctggaaggccatgaaagagaaggaagccaagaagattgcagcctag

SEQ ID NO: 30244 - DNA, 564 bp, Artificial Sequence
  Description of Artificial Sequence: Synthetic coding sequence
atggtgcgcgagccaggacctcgtccaggcacccctggttgtagtgccagtgggcagtggaccgccacgttgaggccctatctgtccgccgtccgggctactctgcaagccgctttatgcctagaaaattttagctctcaagtcgtcgagagacacaacaaaccggaggtagaggtcaggtcctctaaagagctgctgctgcaaccagttacaatctcacgcaatgagaaagagaaggtgctgatagagggttctattaattccgtgagggtgagcattgcggtcaaacaggccgacgaaatcgaaaaaatcctgtgtcacaagtttatgcgcttcatgatgatgcgggctgaaaattttttcatccttcggaggaaaccagtagagggctatgatatcagcttcctgattacaaactttcacactgaacagatgtataagcacaaattagtcgacttcgtcattcacttcatggaggagattgacaaagagatttccgagatgaaactctcggtcaacgccagagctagaatcgtcgcagaggagttcctgaaaaacttctag

SEQ ID NO: 30245 - DNA, 1068 bp, Artificial Sequence
  Description of Artificial Sequence: Synthetic coding sequence
tgatccttagcctcatccctgcgcaataaggagggaacgcttggaagtaaggtgggttacctggacgtggaggccagaggcccaggcgagggaaggggcggtggcggagagtccccaccactccagcctcccccaccggcaccagtcctcttgtacgatcagggtggtggacggaggcgcagaggagaagcagaggctgaggctgaggagtgggaagccgagtccgtgctgggaaccctgctgcagaagctaagagaagaggggtatctcgcgtattacctacagggtggattcagtcggttccaggctgaatgcccacatctctgcgaaacttcgcttgctgggagggccggaagctcaatggcacctgtgccaggtcccgtgcccgttgtggggctgggtagtctgtgtctgggcagtgattgcagtgacgcggaatccgaggctgatcgggattccatgtcttgtggattagattccgagggcgcaaccccacctcccgtgggcctgcgcgcatctttccctgttcagatcctgccgaatctctatctgggtagcgccagagacagcgctaatctcgaaagccttgctaagttgggcatccgctatatcctaaacgtgacacctaatctcccgaatttcttcgagaagaatggggattttcattataaacagatccctatatctgaccattggagccagaatttgtcgcgctttttccctgaggcaatagagttcattgacgaggctctgagccagaattgcggtgtgctagtccactgcctggccggagtctcaagaagcgtgacagtgaccgtggcctacctcatgcaaaagctgcacctgtcactgaacgatgcttacgacctggtgaagagaaagaagtcaaacatttcaccaaacttcaatttcatggggcaactgttggattttgaacgttcattgcgactggaggaaaggcatagccaggagcagggaagcggaggtcaggcatccgcagctagcaacccaccaagcttttttactacccccacatctgacggcgcattcgagcttgcccctacctag

SEQ ID NO: 30246 - DNA, 51 bp, Artificial Sequence
  Description of Artificial Sequence: Synthetic coding sequence
atgtgtactagcgaaacgttccaggccctcgatacattcgaagctcgctag

SEQ ID NO: 30247 - DNA, 1620 bp, Artificial Sequence
  Description of Artificial Sequence: Synthetic coding sequence
atggcgacaagcgcacctctgcggagtttggaggaagaggtgacctgctcaatctgtttagactatctacgcgacccagtgaccattgattgcggccacgtgttctgtcgatcgtgcacaaccgatgttagacccatctccgggtcaaggcccgtttgtcccttgtgcaagaaaccttttaagaaggaaaatataaggccagtttggcaactggcaagcctggtggagaatattgaacggctcaaggtggataaagggaggcaaccaggcgaagtgacaagggagcagcaggacgcaaaactgtgtgaacggcatagggaaaagttgcattactattgtgaggatgatggcaagctgctgtgtgtcatgtgcagagagtcccgcgagcaccgccctcacaccgccgtgctcatggagaaagctgctcaacctcacagggaaaaaatcctgaaccatcttagtaccttgagacgcgaccgggataaaatccaaggcttccaggctaagggagaggccgatattcttgccgcacttaagaagctgcaagatcagcggcaatatatcgtggcagaattcgagcaaggccaccagttccttagggaaagagaggaacacctgctggagcagctggcaaaactcgagcaggaacttacagaaggaagggagaaatttaagtcccggggtgttggtgagcttgcaagacttgcgctggtgatttccgaacttgagggaaaggcccagcagccagctgcagaactgatgcaggatacgcgtgattttttgaataggtacccgaggaagaagttctgggttgggaagccgatcgcacgtgtagtcaagaagaagactggagagttcagtgataagttactcagcttgcagcgaggccttcgcgagttccaaggaaagcttcttcgtgacctagaatataagacggtgagcgtgacattagacccccaatcagcctccggatacctgcaactttctgaggactggaagtgcgttacctatactagcctgtacaaaagcgcatacctccatccacagcagtttgattgcgaacctggcgtactggggtctaaaggttttacatggggcaaggtctattgggaagtcgaggtggagagggaaggatggtccgaggatgaggaagaaggtgatgaagaagaggagggcgaggaagaagaagaagaagaagaggctggctatggcgacggctatgacgactgggaaaccgatgaggatgaggaaagcttgggggacgaggaggaagaggaggaagaggaagaagaggaggtcctggagtcctgtatggtaggggtagcacgggattccgtaaaacgcaaaggggacctgtctctcaggccggaagacggtgtctgggcgctgagactgtccagtagtgggatatgggctaacacgagtcctgaagctgaactctttcccgctcttagaccacgaagggtgggaatcgctctggattatgagggcggtacggttaccttcaccaatgctgaatcccaggagctcatctatacctttactgccacatttacacgccgtcttgtgcccttcctctggctcaagtggcctggtacccgcctgttgctccggccatag

SEQ ID NO: 30248 - DNA, 474 bp, Artificial Sequence
  Description of Artificial Sequence: Synthetic coding sequence
atggcaacaagcgcaccactgcgctcgctcgaggaagaggtgacatgtagcatctgtctcgattatcttcgtgaccccgtcaccattgattgcggccatgtcttctgccgcagttgtacgactgatgtcagacccattagcggaagccgacctgtgtgccccctgtgcaagaaacctttcaagaaagaaaatattcggccagtgtggcagctggcctctctggttgagaacatcgaaaggttaaaggtcgacaaggggagacagccaggcgaagtgactcgggagcaacaggatgctaagctgtgtgagaggcacagagaaaagctgcactactattgtgaggatgacgggaaactgttatgtgtgatgtgcagagagtccagggagcatcgacctcacaccgctgtgctcatggagaaagcagctcaaccacacagagagaaaatcctgaatcacctgtccacgctacgttag

SEQ ID NO: 30249 - DNA, 2553 bp, Artificial Sequence
  Description of Artificial Sequence: Synthetic coding sequence
atggagcccgaaaggaaggggttatccctggcgagttcatctgatggagatggaagagaagagaacaagctgaaacaggggataagccaggatctcgcttcatcttcccgtctggatcgctacaaaatagctaggcagttaactgaaaaggctatcaaggaaaagaaaattttctccatctacggccattaccctgtcgtgcgcgcagccctgcgtaggaaaggctgggtggagaaaaagttccacttcctgcctaaagtgatccctgacgttgaggacgaaggcgctcgagtgaacgatgatacatgcgctaaagtaaaagaaaaccaagaaatggctctcgagaagacagacaacatccacgacgtgatgagcagactagtaaaaaacgagatgccatatctactgtggactatcaagcgcgatataattgactaccacagtctgacatacgaccaaatgctgaaccattacgctaaaaccgcctcttttaccacgaaaattggattgtgtgttaacatgaggtccctgccctggtatgtcccagctaatcccgatagcttcttccctagatgttactcactgtgtaccgaatctgagcagcaggaattcctggaggactttcgcagaacaatggcatcctcaattctgaaatgggtagtgagccatcagagctgctcgcgatcctctagatcaaaaccaagggatcagcgtgaagaggccggatcctcggacctctccagcaggcaagacgctgagaatgcggaggcaaaattgaggggcttgcccggacagctggtggacatagcgtgcaaggtgtgtcaggcctatctgggacagctggaacacgaggacattgacacctcagccgacgcagtggaagatctgacagaagccgaatgggaggacttaacccaacaatactactcccttgtccatggagacgcgtttatttctaacagtaggaactatttttctcaatgtcaagctctgctgaaccggatcacctctgtcaatccccaaacagatattgatggcctcaggaacatatggatcatcaagcccgctgccaaatctcgtggcagagacatcgtttgtatggaccgcgttgaagaaatccttgagctggcagcggctgatcaccctctcagccgagataataaatgggtcgtccagaagtacatcgaaaccccactgttaatatgtgacaccaaatttgatataagacagtggtttcttgtcaccgattggaaccccctgaccatttggttctataaggagagttacctgcggttttctacccaacgtttctctctcgacaagctggactcagcaatccatctttgcaataatgccgtacagaaatatctcaaaaatgatgtcggacgctccccactcctgccagcacacaacatgtggaccagcacaaggttccaagagtatctccagagacaggggagaggtgccgtgtggggcagcgtaatctacccttccatgaaaaaggcaatcgcacacgcaatgaaggtagcccaagaccacgtcgagccaaggaaaaattctttcgaactgtatggcgctgacttcgtgctgggcagggattttaggccttggttgattgaaatcaattcatcacctacaatgcacccaagtaccccagtcactgcccaactttgtgctcaggtacaagaggacaccatcaaagtggccgtggaccggtcctgcgatatcgggaactttgagctattgtggagacaacctgttgtggagccacctcctttttcaggtagcgacctctgtgtggcaggcgtctctgtccgccgagcccgtcgacaggtgttgcccgtctgtaatctgaaagcatccgcatccctgttggatgcccagcctctgaaagcgaggggcccaagcgccatgcctgaccctgcgcaggggcctccaagccccgcactgcaacgagacctggggctgaaagaagagaagggcctacccctcgcacttctggcacctcttcggggagccgcagagagcggaggagcggcacagcccaccagaacaaaagctgcgggaaaagtagaattgccagcctgtccttgtaggcacgtcgactcccaggcccctaacaccggggtacccgtggcacaacctgcaaaatcatgggatccaaaccaacttaacgcacatccactggaacccgtgcttaggggcctaaagacagcggaaggcgctctgcgaccacccccaggaggaaaaggagaggggactgtctgcagtcgccttcctcaccatggccatcatgtggctgcctgtcagactaccgggactacctgggacggcggtccgggagtatgcttcttgcgccagctgctggcatcggaactgccaatgggccctggcctacctagggaccctcgcgcacccccatgtctagtgtgtaggggcctgcttccccctgccggaccttgcaagcggtgccgatccttttgcgccgcagtgctccagggcgcatcattcgttcgtctagggggacgatcttgtagcccgagaacaccttag

SEQ ID NO: 30250 - DNA, 2739 bp, Artificial Sequence
  Description of Artificial Sequence: Synthetic coding sequence
atgaaaagaggcattaggcgggacccttttcggaaacgcaagctggggggacgggcaaaaaaagttagggagcccactgctgtgaacagcttctaccgcgaggcctcactcccctcagtgtgggcctcactcagacgcagagaaatggtgaggtcaggcgctcgccctgggcaggttttaagtagcggccgtcatactggaccagccaagctgaccaatggcaagaaggcaacctatctacggaaaatccctcgtttcaatgccgatagcggctactccatccatagcgatagcgagagccaggcagaaaccgtgcacggcctggacggatgtgcgagtttattgcgggacatccttagaaatgaggattcagcttctagcgataacaagaagcagatccctaatgaagcttcggcccgtagcgagcgagatacgtctgacctggaacagaattggtccttacaggatcattaccggatgtactccccaataatttaccaagctctttgtgagcatgtgcagactcagatgagcctcatgaacgacctcaccagtaaaaacattccaaatgggatccccgcagtgccatgccatgctcccagccatagtgaatcccaggctactccacattcaagttatggcctgtgtaccagcacgcccgtgtggtcgctacagcgcccaccatgccccccaaaggttcattccgaagtgcagaccgatgggaattcacagttcgcctcccagggaaaaacagtgagtgctacttgtaccgacgtgctgaggaactccttcaacacaagtcccggagtaccctgtagcctacctaagacagacattagcgccatccctaccttgcagcaactgggactggtgaatggtattctcccacagcaaggtattcacaaggagactgatttgctgaagtgcatccagacttatctctccctttttagatctcacggtaaggagacgcacctggatagtcagacacaccgctcccctacacagtctcagccggcttttctagctacgaacgaggagaagtgtgccagggagcagattagagaggccactagcgagagaaaggatctgaacattcacgtgagggacacaaaaaccgtgaaagacgtccaaaaggccaaaaatgtgaacaagaccgccgaaaaagtccgaattataaagtatcttctgggcgagttgaaggctctggtggcagaacaggaggactcagaaatccaacgccttataacagaaatggaagcctgcatctccgtgctgccgactgtttccggcaataccgatattcaggtggagatagcccttgctatgcagcccttaagaagcgagaatgctcaactccgccgacaactcagaatccttaatcagcagctgcgtgaacagcagaagacccaaaagcccagcggggctgtagattgcaatctagagctcttctcattgcagtcgttgaacatgtccttacagaaccagctcgaagaaagtcttaagtctcaagaactgctgcagtctaagaacgaagagctgctgaaggtgattgagaaccagaaagacgaaaataagaagttctcttccattttcaaggataaggaccagacaattctggaaaataagcagcagtatgatattgaaatcactagaatcaaaatagagttggaggaagcgctggtgaacgtaaaatcttcacaattcaagctcgaaaccgcagaaaaagagaaccagattctggggataaccctaaggcaacgcgatgccgaggtaacccgtcttagagagttaacccgcaccctccagacaagcatggctaagctcttatccgacctatctgttgacagcgccagatgtaaaccagggaataatctgactaaaagcctgctgaacatccacgataaacagctccaacacgatcctgccccagcgcatacctccatcatgtcttacctgaacaaactcgagacgaattattcctttacacacagtgagcccctctccacaatcaagaatgaagagactatagagccagataagacatacgaaaatgtgttgtcttctcgcggaccacagaactcgaatacacgcggaatggaggaagccagcgccccaggcatcatttccgccctctctaaacaggacagcgatgaagggtccgaaacgatggcccttattgaagacgagcacaatctggataacactatttacatcccgtttgctcgcagcacccccgagaaaaagtctcctctctccaagcgattatctccacaaccccaaatccgcgcagccacaacccagctcgtctccaactctggtcttgcagtctccggcaaggagaataaactttgcacccccgtgatctgctcaagcagtacaaaagaggctgaagatgcacctgagaaactgagcagagctagtgacatgaaagacacgcagctgctgaagaagatcaaggaagcaataggtaaaatccccgctgctactaaagaacctgaagagcagacagcttgccatgggccttcgggctgcctatctaactcgcttcaagttaagggcaataccgtgtgcgacggctccgtgtttacctcagaccttatgtccgactggtcgatctccagctttagtacctttacctctagggatgagcaggactttagaaatggactggccgctttagacgctaatattgctcggttgcagaagagcttgaggacaggattgcttgagaagtag

SEQ ID NO: 30251 - DNA, 528 bp, Artificial Sequence
  Description of Artificial Sequence: Synthetic coding sequence
atggaattgaccatctttatattgcggctggccatttacatcctcactttcccactgtacctccttaactttctaggattgtggtcatggatctgcaagaagtggtttccctattttttagttagatttactgtgatctacaatgaacagatggctagcaagaaacgggagctcttctcaaacctgcaggagtttgcaggtccatctggtaaacttagcctcttggaagtgggttgtggaaccggtgccaattttaaattttatcccccaggttgtcgcgttctgagacccggaggggctttttatttcatggagcatgtggccgctgagtgctccacctggaattacttttggcagcaggttctggaccccgcatggcatctcctatttgacggctgtaacctaacgcgcgaaagttggaaagccctcgagcgggcatctttcagcaaacttaagctacagcacattcaagccccactgtcctgggagttggtccggcctcacatttacggatatgccgtcaagtag

SEQ ID NO: 30252 - DNA, 1392 bp, Artificial Sequence
  Description of Artificial Sequence: Synthetic coding sequence
atgtctgggggaacgccgtatatcggatctaaaatatctttaatcagtaaagctgaaatcagatatgaagggatcctctacacaatcgacaccgaaaatagcaccgtggctctagccaaagtgcgatccttcggtacggaggatcgacccacggaccgcccaatcccccctcgagatgaggtgtttgagtacatcatcttccgcggatccgacattaaggacctgactgtgtgtgagcctcctaagcctcagtgctcactgccccaagacccagcgatcgtccagtcttcccttgggtccagcacttcctcgttccagtctatgggctcctacggtcccttcggccgaatgcctacttactcccagttctctccctcctcactagtcggccagcagtttggcgctgtcggagtggctggaagtagcctgacctcttttggtaccgagacctcgaatagcggtacactacctcaatcgagtgctgtgggtagtgcattcacacaggacactcgctctctgaagacgcagctgtcccaggggaggtcgagcccgcagctcgatcccttgcggaagtccccaacgatggagcaagcagtgcagactgccagtgcacatctccccgcacccgctgccgtgggtcgaagaagcccagtctctactcggccactgccttcagccagtcagaaggcaggcgaaaaccaggaacacagaagagcagaggtgcataaagtttcccgaccggagaatgagcagcttaggaatgacaacaaacgccaggttgcccctggagcaccatctgcccctcgacgaggcagaggcggtcaccggggagggagaggcaggtttgggattcgtcgagatgggcctatgaagttcgaaaaggattttgattttgaatccgccaacgcgcaatttaacaaggaggaaatagatcgcgagtttcacaacaagcttaagctgaaggaggacaagctggagaagcaggagaaacccgtaaacggcgaagacaagggcgatagtggagtcgatacacagaacagcgagggaaacgccgatgaagaagatcctcttggccctaattgctattacgacaagacaaagtcatttttcgataatatttcttgtgacgacaatagggagcgaaggccaacatgggccgaagagaggcgactgaacgcggaaaccttcggcattcccctgcgtcctaatagagggaggggcggttaccggggaagaggaggccttggtttccgcggtgggagaggaagaggaggaggtcggggaggaacgttcaccgccccacggggtttccgcggtggcttccggggtggcagagggggacgcgaatttgcggatttcgagtaccgcaaaaccaccgccttcgggccttag

SEQ ID NO: 30253 - DNA, 2790 bp, Artificial Sequence
  Description of Artificial Sequence: Synthetic coding sequence
atggcggaagtcgaagcagtgcagcttaaggaggaggggaatcgtcacttccagctccaagattacaaggctgcgaccaatagttatagtcaagctttgaagctgactaaagacaaggccctccttgcaacgctgtatcgaaaccgcgctgcctgtggcctgaaaacggaaagttatgtgcaagctgcaagcgatgccagtagagcaatcgatatcaacagctccgatatcaaggccctgtataggaggtgccaagcccttgaacacctgggcaaactggaccaagctttcaaggacgtccagcggtgtgccaccctcgagccacgcaatcagaattttcaagaaatgcttagaaggctcaataccagtatccaggaaaagctaagggtgcagttttcaacagacagccgagtgcagaagatgtttgaaatactattggatgagaactcagaagcggacaagcgcgaaaaggcggctaacaacctcatcgtgttgggcagagaggaagccggagcagagaaaatttttcagaacaatggcgtggcgctcttactgcaacttctggacacaaaaaagcccgaacttgtcttagcggctgtgcggaccctgtctggcatgtgttcaggacatcaggcacgggcaaccgtgatcctgcacgctgtcagaattgaccggatctgttctcttatggcagtggagaacgaggagatgtcattggccgtttgcaacttactccaagccattatagacagcctatctggggaagataaacgcgagcacaggggcaaggaagaagccctcgttcttgacacaaaaaaagatctcaaacagattacatctcatttgctcgacatgctggtaagcaagaaggtgtcgggacagggtcgcgatcaggccttaaatttactgaacaagaatgtacccagaaaggatctggcgattcatgataattctcgtaccatctacgtcgttgataatggcctgcggaagatacttaaagtggttggacaagtccctgatctgccctcctgccttcctctgactgacaacacgaggatgctggccagcattttaatcaataagttgtacgacgacctgaggtgcgatccggaacgggatcacttcagaaagatatgtgaagagtacatcaccggaaagttcgatccacaggacatggacaaaaacctcaacgctattcagacagtgagtggcatccttcaaggcccatttgacctgggcaaccagttactgggactgaaaggagtgatggaaatgatggtagccctgtgcggaagcgagagagagactgaccagctagttgccgttgaggccctgattcacgctagcaccaagttgtccagagccaccttcattattactaatggggtctcgctgttgaaacagatttataagacaacaaagaacgagaaaatcaagatacggacgttggtgggcttatgcaaactgggtagcgcgggtgggactgactacggacttagacagttcgcagaaggcagcaccgaaaaactggcaaagcaatgtaggaagtggctgtgcaacatgtctatcgacacaagaaccagacgctgggctgtcgagggtctagcctatctgactcttgatgccgacgttaaggatgactttgtgcaggatgtgcccgctctgcaagccatgtttgagttagctaaaacaagtgacaaaacaatcctgtattccgtggcaaccactctggttaactgcaccaattcctacgacgtgaaggaggtgattcctgaactggtacaacttgctaaatttagcaagcagcatgtgccggaggagcatccaaaggacaaaaaggacttcatcgatatgcgggtgaaacgactgctgaaggctggcgttatcagcgctcttgcctgcatggttaaagccgacagcgccatcttaaccgaccagacgaaggagttgttggccagagtgtttctggccctgtgtgataatccaaaggatagaggaactatcgtggcacaggggggaggcaaggccctgatcccgctggcactggaggggaccgatgttggcaaagtcaaagcagcccacgctctggcgaagattgctgcagtgtctaaccctgatatcgcattcccgggagaacgtgtgtacgaggtcgtgcgcccactcgtccgtttacttgatactcagcgtgatgggctgcagaactatgaggccctgctcggcctgactaatctctcgggcagatccgacaaactgaggcaaaaaatcttcaaggaacgcgcattaccagatatcgagaactacatgttcgaaaatcacgaccagcttcggcaagccgctacggaatgtatgtgcaacatggtgctgcataaagaggtccaagagcgcttcctggccgacggtaacgaccgtctgaagcttgttgtgctactgtgcggagaggacgacgacaaagtgcagaacgccgctgctggagccctggcaatgctgacagcggctcataagaaactgtgtctgaagatgacccaagtcacaacgcaatggcttgagatccttcagcgtttgtgcctgcatgaccagctaagtgtgcagcatcgaggactcgtcatagcctacaacctactcgcagccgatgctgagctcgcaaagaagcttgtggagtcagaacttctggagattttgaccgttgtgggtaaacaggagcctgacgagaaaaaggctgaagtagttcaaaccgccagagagtgccttatcaagtgcatggactacggatttatcaagcccgtgagctag

SEQ ID NO: 30254 - DNA, 246 bp, Artificial Sequence
  Description of Artificial Sequence: Synthetic coding sequence
atgagtcactacggttcctattacggcggactcggctattcatgcggaggatttgggggattgggttatggctacggatgtggttgcgggagtttttgcaggagaggctctgggtgcggctatggtggttatggctacggttccggctttggtggctatggttatgggtcaggattcggaggttatgggtatggttgctgtcgaccttcctataatggaggatatggcttctccggcttctattag

SEQ ID NO: 30255 - DNA, 150 bp, Artificial Sequence
  Description of Artificial Sequence: Synthetic coding sequence
atggaggtcccgaggttggatcatgcactgaactccccgacatccccatgtgaagaagtcattaagaatctctcacttgaggcaatccaactgtgtgaccgcgatgtcgttttcgaggaactgactagcaagcagactcgcaaaggctag

SEQ ID NO: 30256 - DNA, 498 bp, Artificial Sequence
  Description of Artificial Sequence: Synthetic coding sequence
atgagccggtatctgcgcccacccaacactagcctgttcgtcaggaacgtggcggacgatacacgcagcgaagatctcaggcgggagtttggacgctacggacccatagttgacgtatacgtgcctctggatttttacacccggcgacctcggggtttcgcatatgttcaattcgaagatgttcgtgatgccgaggatgctttgcataatttggatcgcaaatggatatgcggtcggcagattgagattcaattcgctcagggggatcgaaagacgccgaatcagatgaaggccaaggaaggcagaaacgtctattcttcctctcgctacgacgattacgataggtataggagaagcaggagtagatcttatgagcgccgtcgcagtcgctctagatcctttgactacaactacagacgctcgtatagccccaggaagccgaactgttcgtggaacacccagtattcaagcgcatattacacaagtaggaagatctag

SEQ ID NO: 30257 - DNA, 1803 bp, Artificial Sequence
  Description of Artificial Sequence: Synthetic coding sequence
atggcatctaatcacaaatcctctgcagcccgtcctgtatctcgtggtggagtcggactgaccgggcgaccaccctccggtatccgacccctctccgggaatatcagagtggctacggctatgcctccaggcacggcacgcccagggagccgcggatgcccgataggcactgggggagtgctatccagccagatcaaggtggctcataggccagtgacccaacaggggctgaccggaatgaaaacaggcaccaagggccctcaaagacagattcttgacaagtcttactatctcgggcttctgcgttccaagatttctgaactcaccactgaggtgaataagttacaaaagggcatcgagatgtataaccaagagaactccgtctacctgtcttacgagaaacgggcagagacactcgcagtagaaatcaaggagttgcaaggccagctggccgattataatatgctggtagacaagcttaatactaataccgaaatggaggaagtgatgaatgactataatatgctcaaggcccaaaatgaccgcgagacccagtccctggacgttatcttcacagaacgccaagccaaggaaaaacagatcagatcagtagaggaagagatcgagcaggaaaaacaggcaacggatgacattattaaaaatatgtcatttgaaaatcaggtgaagtacctcgaaatgaagaccacaaatgagaagctcctgcaagagttagatacgctgcagcagcagctggattcacagaatatgaagaaagagagtctagaggccgagatcgctcactcgcaggtcaaacaggaagctgtacttctgcacgagaaactctacgaactggagtctcacagagaccaaatgattgctgaggataagtccatcggctcacccatggaggaaagggagaagctgttgaagcagataaaggatgacaatcaagagatcgcctccatggaacgacagttgactgacaccaaagagaaaataaatcagttcatcgaggagataagacagttagacatggaccttgaagaacaccagggcgagatgaatcagaaatacaaggagttgaaaaagcgcgaagaacatatggataccttcattgagacttttgaagagaccaagaatcaagaactgaaaagaaaagctcagattgaggccaacattgtcgctttactggagcactgttccagaaatatcaacagaattgagcagatctcaagtataaccaaccaagaactgaagatgatgcaagacgatctgaatttcaagtccacagaagtgcaaaaatcccagtccactgcacagaacctcactagcgatatacaaagacttcagcttgatctgcaaaaaatggagctgctggaaagcaaaatgacagaggaacagcacagcctgaagtcgaaaataaaacaaatgacaacggatctggagatatataatgatctgccggcactgaagagttctggagaggaaaaaatcaaaaaactacaccaggaaagaatgatcctttctacgcacagaaatgctttcaaaaaaataatggagaagcaaaacatcgagtatgaggcgctaaagacccagcttcaagagaatgagacacattcacaattgacaaacctcgaaaggaagtggcagcacctagagcagaataatttcgccatgaaggaattcattgcgacgaaatctcaggagagcgactatcaacccattaaaaagaacgtgacaaaacagatcgcagaatataataagacaatcgtggacgctttacacagcacatcggggaattag

SEQ ID NO: 30258 - DNA, 465 bp, Artificial Sequence
  Description of Artificial Sequence: Synthetic coding sequence
atggtctccagcgcacagatgggctttaacttgcaagctctgctggaacagctgagtcaggatgagcttagcaaattcaaatacctgatcaccactttctctctggcacacgagctgcaaaagattccccacaaggaggttgataaggctgacggtaagcaactggtggaaatcctgacgacacactgtgattcttattgggtagagatggccagtctgcaagtctttgagaaaatgcatcgaatggacctcagtgaacgcgcaaaagacgaggttcgggaggccgcactgaaatctttcaataagcgcaaaccccttagcttgggaattaccagaaaagaacgaccaccactcgacgtggatgagatgctggagaggttcaagacggaagcccaagctttcactgaaacgaagggcaacgtgatatgtcttggaaaagaggttttcaaaggcaaaaaaccttag

SEQ ID NO: 30259 - DNA, 474 bp, Artificial Sequence
  Description of Artificial Sequence: Synthetic coding sequence
atggccacctcagctcctctgcggagcctggaagaagaagttacgtgttcaatttgtctggactatctgagagatcccgttaccatcgactgcgggcacgtattttgccgatcatgcactacagatgttcgaccaatcagcggaagcagaccagtgtgccccttatgtaagaagccattcaagaaagagaacatccgtccagtgtggcagttggctagcctggttgaaaacatcgagcgcctgaaagtagacaaggggaggcagccaggagaggtgacacgcgagcagcaggatgctaagctctgcgaaagacatcgagaaaaactgcactactactgcgaggacgacggcaaattactttgtgtcatgtgtagagagtcgagagaacatagaccgcatactgccgtcctaatggagaaagcagcccagccccaccgggaaaagatcttaaatcatctgtcaacattgagatag

SEQ ID NO: 30260 - DNA, 348 bp, Artificial Sequence
  Description of Artificial Sequence: Synthetic coding sequence
atgcctcacttgccgctcgcatccttccgccctcccttctgggggcttcgacacagtcggggattgcccaggtttcatagtgtttccactcagtctgaaccgcacggctcccctatctctagaaggaatcgtgaggccaaacagaagcgattaagagagaagcaggccactctggaggccgagatcgccggagagtccaaatcccccgctgagagtattaaggcctggcgccctaaggagttggttctctacgaaataccaactaagcctggcgaaaagaaggacgtttccggcccactgccgccagcttattcgcccagatatgtcgaagccgcatggtatccctag

SEQ ID NO: 30261 - DNA, 432 bp, Artificial Sequence
  Description of Artificial Sequence: Synthetic coding sequence
gtgagggagctggaggcagagttagacgctgaacaaaagaagcacgctgaggctttaaaaggggtgcgcaagcacgaacgccgagtgaaagaactggcgtaccaggttggcgatagagtctctctggggagcggtcccggtgcgggacccgctcaggcgtcacccgaaagccccctgccggctcaggcggaggaggaccgcaagaaccttgctagaatgcaggacctggttgataagcttcagagcaaggtcaagtcatataaaagacagtttgaggaggccgagcagcaggccaataccaatttagcaaaataccggaaagcccaacacgagcttgacgatgcagaagagcgcgcagacatggctgagacccaagccaacaaattgcgggctcgcacacgggatgcactcggaccaaagcataaggagtag

SEQ ID NO: 30262 - DNA, 828 bp, Artificial Sequence
  Description of Artificial Sequence: Synthetic coding sequence
atgagtaccataggcagctttgaagggttccaggcagtgagtcttaaacaagagggagacgaccagccttcagagacagaccatctcagcatggaagaagaggacccaatgccgaggcagatctccaggcaaagctcagtcaccgaatccacattatacccaaacccttatcaccaaccctatataagtaggaagtatttcgccacccggccaggagcaattgaaactgcaatggaggatctgaaaggacacgttgcagagaccagtggcgagaccatccaaggattttggctcctgaccaaaatcgatcattggaacaacgagaaggaaaggatcttactggtgaccgacaaaacactgttaatttgcaagtatgattttatcatgttgagctgcgtgcagctgcagaggatccctctgagcgcggtgtaccggatctgcctgggaaagtttacgttccccggaatgtctctggacaaaaggcaaggggaggggcttcgcatttattgggggtccccagaagaacagtccttgctgagcaggtggaatccatggtcaaccgaagtgccctacgcaacctttacagaacaccctatgaagtacacaagcgaaaagttcctcgaaatctgtaagctgtccggttttatgtctaaattagtgcccgcaatccagaatgcccataaaaacagcactggttccggaaggggcaagaagctgatggtcctgaccgagccgatactaatagaaacctacaccgggttaatgtcattcatcggtaatagaaacaagcttggatatagcctagctcggggatctattggcttctag

SEQ ID NO: 30263 - DNA, 339 bp, Artificial Sequence
  Description of Artificial Sequence: Synthetic coding sequence
tgatgcgctagaactgcaggcggatgcctgggatgcttgagcggtcagtgttgttgccgcctgtgtccgctaaccctccccgctactcgttccctttgtcctggcagagtcgtttgggccagacgcagatggtggccttcttggctcgcctggagatgcttatggtgtacaacccgaccccctgcttgtatggagaatactgatgcattcctgttcctgttttccttcacggaccgggcatcgtttgaagacctccctggtcaactagcacgcatcgctggggaggctccaggtgtggtgcggatggtcatcggaagcaagtttgaccagtatatgtag

SEQ ID NO: 30264 - DNA, 3330 bp, Artificial Sequence
  Description of Artificial Sequence: Synthetic coding sequence
atgggaacgggagattttatatgcattagcatgacaggtggagctccttggggctttcgcctccaaggtggcaaggagcagaagcagccattgcaagttgcaaaaataaggaatcagagcaaagcgtccgggagcggactctgcgagggagacgaggtggttagcataaatgggaatccatgcgcagatcttacatatccagaagtcataaagttaatggagtcaattaccgactccctgcagatgctgatcaaaagacctagctcaggaatctcagaggcgctcatctccgagaacgagaataagaacctcgagcacttaacccatggaggctacgtcgagtccactaccctccaaatccgacccgcaacgaagacccagtgtactgagtttttcctcgcacccgttaagacggaagtgcctttggccgaaaaccagcggtctgggccagactgcgctggatccctcaaagaagaaaccggaccatcctaccaaagagctcctcaaatgcccgacagccagcggggtagggttgccgaagaactcatcctgagggaaaaagtcgaggccgtccagccaggacctgtagtcgagctccaactttccctgagccaggagcgccacaagggcgcttcaggtccactggtggcactgccaggagcggaaaagtctaaatctccagacccggaccctaacctgtcacacgatcgcatcgtgcacatcaattcaatccccaccaacgaaaaagctgatccatttcttcgtagctccaagataattcagatctcaagcgggcgtgagctgcgcgttattcaggagagcgaagcaggcgacgcagggctgcctcgggtcgaggttattctggattgttctgaccgccagaagacggagggctgccgactgcaggctgggaaagaatgcgtggattcgcctgtggaaggcggtcaatcggaagctcccccttctctggtcagtttcgcagtttcaagcgaagggacagaacagggtgaagacccccgttctgaaaaagatcactcccgaccgcacaagcaccgagccagacatgccaggctacgacgatccgagtccttaagtgaaaagcaggtgaaggaagcaaaatccaagtgtaaatccatcgcactgctgctgaccgatgcaccgaaccccaatagcaagggcgtgctcatgtttaagaaaagaagacgccgagctaggaagtatacgctagtgtcgtacggcacgggggaattggaacgggaagcagatgaggaagaagagggggataaggaagacacatgcgaagtggccttccttggtgcatctgagtccgaggtcgatgaggaactgctttcggacgtggacgacaatacgcaggtcgtgaattttgactgggattcagggctggtcgacattgaaaagaagctgaatagaggcgacaagatggagatgctacctgacactacaggcaagggcgcattgatgttcgcaaagaggcgtgagcgtatggaccaaatcactgcccagaaagaagaagataaagtcggtggtacaccaagccgtgagcaggatgcagcgcagaccgacggtctgagaactaccaccagctatcaaagaaaagaagaagagtccgtgcggacacagagttcagtctcaaagtcctacatcgaggtttcccatgggctcgggcacgtcccccagcagaatggattttccgggacaagtgagactgcgaacattcagaggatggtaccaatgaaccgcactgcaaaaccttttcctggatccgtgaatcagccggctacacctttcagtcccacgcgaaatatgacttcccccatagcagatttccccgctccacccccatacagcgccgtgacccctccaccggatgctttcagcagaggcgtgtccagcccgattgctggccctgctcagcctccaccctggccccagcctgcaccatggtcgcagccagccttttatgacagctctgaaagaatcgcgagcagagatgaaaggattagcgtcccggcaaaaagaactggcatactgcaggaggccaagagaaggagcaccactaaacctatgtttactttcaaagaaccaaaagtttcccctaatccagagcttctctccttgctacagaactccgagggaaagagagggacaggcgcagggggagactcaggcccagaggaggattacctctcactgggtgccgaggcctgcaatttcatgcagtcctcaagcgccaagcaaaagacgcctcctcccgtagcacccaagccagccgtcaagagctcatcttcccagcctgttacacccgtctctcctgtttggagtcctggtgtggcacccacacagcctccagccttcccaacctctaatccttccaaggggacggttgtatctagcatcaaaatcgcccaacccagctatccgccagctcggcctgcatcaacactgaacgtggccggtccattcaagggccctcaggccgcagtggctagccaaaactacacgcctaagccaactgtgagtaccccaactgtgaacgccgtccagccgggagccgtcggccctagcaacgaacttcctggcatgagtggtcgcggagcgcagctattcgcaaagcggcagtcccgtatggaaaagtatgtggttgacagcgacactgtgcaagctcacgcggctagagcccagagtcctacccctagccttcctgcaagctggaaatattcctccaatgttcgtgcgccaccaccagtggcttacaaccccatccacagtcctagttacccattggctgccctgaaatctcagccctctgcggctcaaccctccaagatgggtaaaaaaaaaggcaagaaaccgttaaacgctctggacgtgatgaaacatcagccctatcagctcaatgcatccctcttcacattccagcccccagacgctaaagacggtctgcctcagaagtcaagcgtgaaggtcaatagcgcactggccatgaagcaggcgctgccaccccgtcccgttaatgccgcttcaccaacaaatgtgcaggcttcctctgtttattctgtcccagcatataccagccccccaagcttctttgctgaagccagctcccctgtttccgcctctccagtgcccgtcggcatacctacatctccaaaacaggaaagcgcttcatctagctacttcgtagcgccacggcctaagtttagtgcgaagaaatctggggtgacaatccaggtgaagtgcaagtctggcatccacagccaggacataattcggacctatttccctgcatacctgtcaagttctacctag

SEQ ID NO: 30265 - DNA, 1554 bp, Artificial Sequence
  Description of Artificial Sequence: Synthetic coding sequence
atggagacggacctgaactcccaggaccgcaaggaccttgacaaatttataaaatttttcgcactcaaaaccgtgcaggtgatcgtacaagcacggctgggcgaaaaaatttgcacccgctcctcttcatcgcccactggcagcgactggttcaacctggccatcaaggatatcccggaggttactcatgaggccaagaaagctctggccggtcagctccctgcggtcgggaggtccatgtgtgtagaaatctccctgaagacctcagagggagatagtatggaactcgagatttggtgtctggaaatgaacgaaaagtgcgacaaggaaattaaggtatcatacacagtgtataaccggctcagcctcctgctaaaaagccttttggccatcaccagagtgacgcccgcataccgcctttcacggaagcagggacatgagtacgtaatcctctataggatctactttggggaagtgcaattgtctgggctgggcgaaggcttccagacagtgcgagtggggacagtcgggacgcccgtgggaacaatcaccctcagctgtgcctacaggattaaccttgcgtttatgtcaacaagacagtttgaacgcacgccgccaatcatggggattatcatcgatcatttcgtggatagaccttacccttcctcctctccaatgcacccttgcaattatcgaacggctggagaggatacaggtgtaatctatcctagtgtggaggattcgcaggaggtgtgcaccactagtttttcaaccagccccccaagccagctctcttcgtccaggctcagttaccagcctgcagccctcggagtaggtagtgcagacctggcttaccccgtggtttttgccgctggcttaaacgccacgcaccctcaccagcttatggtgccaggcaaagaaggcggagttcctctagcccctaaccagcccgtgcacggcacacaggccgatcaggagaggctggctacgtgcacaccgagcgatcgtactcactgcgctgcaaccccctcctctagtgaagacactgagacagtctccaatagctctgaaggtcgcgcaagtccacacgatgtcttggaaacaatattcgtgcgcaaggttggggcttttgtgaacaagcctatcaaccaggtcactttgacatctctcgatataccttttgctatgttcgccccaaagaacctcgagctcgaggatacggaccccatggttaatcctcctgattctcctgagactgagagccctctgcagggaagtctccattccgatggatcttcaggcggaagtagtgggaacacccatgacgattttgttatgattgacttcaagcctgccttctcaaaggacgatatcctgcccatggatctcggaactttttatagggagtttcagaacccccctcaactttcttcactgtctattgatatcggggcacagtctatggccgaggacctggattcccttccggagaagctcgctgtgcatgaaaagaacgtgagggaatttgacgcatttgttgagactctgcagtag

SEQ ID NO: 30266 - DNA, 348 bp, Artificial Sequence
  Description of Artificial Sequence: Synthetic coding sequence
atgccacatctccctctggcctcattcaggcccccattctggggactgcggcatagtagaggcctcccacgattccatagcgtcagcacacagtccgaaccccatggctcaccgatctctaggagaaacagggaggcgaagcagaagcgtctaagagagaagcaggccacattagaggcggagattgccggtgagagcaagtccccggcagagagcattaaggcatggagaccaaaggagctggtgttatatgagattcccaccaagccaggcgaaaagaaagacgtctctggacctctaccacccgcatactctcccaggtacgttgaggctgcttggtatccctag

SEQ ID NO: 30267 - DNA, 1014 bp, Artificial Sequence
  Description of Artificial Sequence: Synthetic coding sequence
atggagttgaagaccctgtgggagaataagctcatgcagtcccgtgcagtagacggcttccactctgaggaacagcagctgttactccaggtccagcagcagcaccaaccccagcagcagcagcatcaccatcatcaccatcaccagcaggcccagccgcaacaaaccgtgcctcagcaagcccagacacagcaggtgcttataccagcttcgcagcaggccacggcgcctcaggtaattgtgccagacagtaagctcatccagcacatgaacgctagtaacatgagcgccgcagctaccgccgctactctagccctgccagctggagtgaccccggtccaacaaattctgacaaactcaggtcaactcctacaggttgtgagagctgcaaatggggctcaatatatttttcagccacagcagagtgtggttctgcagcagcaggtgatacctcagatgcagcccggaggagtgcaggcccctgtgatccaacaggtcttagcaccactgccaggcggaatctccccacagaccggggtcattattcagccccaacagatattgtttaccggaaataaaacccaggtcattcccactacagtggccgctcccacacccgcacaggcgcagattacagcaaccgggcagcagcagccccaggcccaacctgcccagactcaggcacccctggtcctgcaggtagacgggacaggagacacttccagcgaggaggacgaggacgaggaggaggactatgatgacgatgaagaggaggacaaggaaaaggacggggctgaagacgggcaggtggaggaggaacccttgaactccgaggacgatgtctctgacgaggaggggcaagagctgtttgacaccgaaaatgtggtggtgtgccagtatgataagattcaccggtccaaaaacaagtggaaatttcatctcaaggacgggattatgaatctgaatggccgtgattacatattttccaaagccattggagacgctgaatggtag

SEQ ID NO: 30268 - DNA, 3012 bp, Artificial Sequence
  Description of Artificial Sequence: Synthetic coding sequence
atgtcacagtggactccagagtataacgagctctacacattgaaggtcgatatgaagtccgagattccatccgacgcccctaaaactcaggaatcactgaagggcattctcctccatcctgagccgattggcgctgccaagtccttcccagcaggggttgaaatgataaattcaaaagttggcaatgaattctcccacctctgcgatgactctcagaaacaagagaaagagatgaatggcaatcagcaggagcaggaaaagtctttggtggtgagaaagaaacgcaagtcgcaacaggccggaccaagctatgtgcagaactgtgtgaaagaaaatcaaggcatcttgggtctccgacagcacttgggcaccccgtctgatgaggataacgactcctctttcagtgactgccttagctctccatctagttccctccattttggagattctgataccgtcacatccgatgaggataaagaagtgagcgtgagacatagtcagactatactgaatgccaaatcacgatcacactccgcacgcagccacaagtggccgcgaacagagactgaatcggtgtctgggcttctgatgaagcgaccatgcctacacggcagcagcctgagacgcctgccatgcagaaagaggttcgtaaagaataactctagtcagcgcacccaaaaacagaaagagcgaattctaatgcagcgcaaaaaacgagaagtcctggccagaagaaaatatgccctgttgcccagttcttccagctcctctgagaatgacttgtcttctgaatcgagtagctcctcatctacggagggcgaagaagatctcttcgttagcgcttccgaaaatcatcagaataatcccgctgttccatccggcagcatcgatgaggacgtggtggtcattgaggccagcagtacaccgcaggtgaccgcaaatgaagagattaacgtgacttccacagattctgaggtggaaatagtgactgtaggagaatcttatagatcaagatctactctgggacacagtcggagccattggagccagggtagctccagtcatgcatcgcgcccacaagagccgaggaatagaagcaggatcagtacagtgatccagcccttaaggcaaaacgcggctgaggtcgtagacctcaccgtggatgaggacgaaccaactgtggtgcccactactagtgcccgaatggaatctcaggccactagcgctagtatcaacaacagtaatcccagcactagtgagcaggccagcgacacagccagcgcagttacctcatcccagcctagtaccgtgtccgaaacatccgctacattgacgtcaaacagcaccactggaaccagcatcggagacgattcaagacgtacaacctcttctgccgtgacagaaaccggacccccagccatgccgcgattgccatcatgttgtccgcagcactctccctgcggagggtcctcacaaaaccatcatgcgttaggacacccgcacacaagttgcttccaacagcacggtcaccactttcaacaccatcatcaccaccaccatacccctcacccagctgtgccagtgtcgccttccttctccgaccccgcatgccctgtcgagaggccccctcaggtccaggccccatgcggggcaaactcttcttcaggaactagctaccacgaacagcaagctctacccgtagatctgagtaattcgggtattaggtcccacggttctggatcgttccatggcgcatctgccttcgacccatgctgccccgtgtcaagttcgcgggctgctatcttcggacaccaggcagctgcagccgcaccctcgcagcccctgagtagcatcgacgggtatggctcatccatggtagctcagcctcagccccaacccccacctcagccctccctgtctagttgtcggcattatatgcccccaccttacgccagcctgaccagacccctgcaccaccaggcctccgcgtgcccccattcccatggcaatcctccccctcagacccaacccccacctcaagtcgactacgttataccgcaccctgtgcacgcgttccactctcagataagtagtcacgccacaagtcaccctgtggcccctccaccccctactcatctggcctcaactgctgcaccaattcctcagcatctcccacccacccaccaacccatttctcaccatattcctgctactgctccgccagctcaacggttgcatcctcacgaagtcatgcagagaatggaggtccagagaaggcgaatgatgcagcacccaaccgggctgttcgtgttctgcgtgagccgcagggcgcatgaacggcctccaccgcaccctcacaggatgcaccccaattacggacatggtcaccatattcacgtcccacaaaccatgtcctcccaccctagacaggccccagagaggtcagcctgggagctggggattgaggccggtgtaactgccgctacctacacccctggcgcactccacccccatctcgcccactaccacgctccgccacggttgcaccatctgcagctcggcgctctgcctctcatggtgccagatatggccggatatccacacatcagatacataagctccggactggatgggacgtccttcagagggccttttcggggtaactttgaggagttaattcacctggaagagcgcctgggaaacgtcaatagaggagccagtcaggggaccatcgagaggtgtacgtatccacacaaatacaagaaagtcaccactgattggttcagccagcgaaaactgcattgtaaacaggatggggaggaggggactgaggaggacacagaagagaaatgtacaatttgtctgtccatccttgaggagggtgaagacgtccgcaggttgccttgtatgcacctattccatcaggtttgtgtggaccagtggctgatcacaaataaaaagtgcccaatttgtagagtggacattgaagctcagctgccctcagaatcttag

SEQ ID NO: 30269 - DNA, 3309 bp, Artificial Sequence
  Description of Artificial Sequence: Synthetic coding sequence
atggctgaaaaggaggccagacgtaagtttaagcaaatcgttaccgcagtttacttctgtcattgtagaaatattgttcatcgggatttaaaagcggagaatttacttcttgacgccaatcttaatatcaaaattgccgacttcgggttctcgaacttgttcacaccaggacagttattgaaaacttggtgtggctcccctccgtatgccgcacctgagttgtttgagggaaaagagtacgacgggccaaaggttgacatctggtcgttaggggtggtgctctacgtgctggtgtgtggagctcttccgttcgatgggtccaccctccagaacctgagagctcgcgtgctgtccgggaagtttcgcataccgttcttcatgtctactgagtgcgagcatctgatcaggcacatgcttgtcctggaccccaataaacggctgagtatggaacagatctgcaagcacaagtggatgaagctcggagatgctgaccctaacttcgaccgtctgattgctgagtgccagcagctcaaagaggaacggcaggtggaccctttgaacgaagacgttcttctggccatggaagatatgggtctggataaggagcagaccttgcagtcacttcgaagtgacgcctatgaccattactccgccatctacagcctgctctgtgacagacacaaaaggcacaagaccctcaggctaggagcccttccatccatgccacgggctctggcttttcaggctcccgttaacatccaagcagaacaggcgggtacagcaatgaacattagtgtccctcaggtgcagttaataaaccctgaaaaccagattgttgagcctgacggtacgctgaacctggacagcgacgaaggcgaggagccatccccagaggctcttgttcgctacctctccatgcgacgccatacagtgggagtggccgacccacggactgaggtgatggaagatctgcagaaacttctgcccggtttcccaggtgtcaaccctcaggccccttttctgcaggtagcacccaatgtgaacttcatgcataacctgctgcccatgcagaacctgcaaccaacggggcagttagagtataaggaacagtcattactccagcctccaactctgcaattactcaatggcatgggccctctgggccgacgggcatccgatgggggagccaacatccagctgcatgctcaacagctcctgaagaggccgcgaggtccgtcgccactcgtgaccatgacacccgctgtgccagccgtgactccagtggacgaggaatctagcgacggggagccagaccaggaagctgtccagtcatctacatataaggattccaacaccctgcatctgcccacagagagattttctcccgtacgccgttttagcgacggcgcagccagtattcaggcttttaaagcacacctggaaaagatgggcaacaattcatccattaagcagctgcagcaagagtgtgagcaactgcagaaaatgtacggagggcagattgacgaaagaacactagaaaagacccagcagcagcacatgttgtatcaacaggagcaacatcaccagattcttcaacagcaaattcaggactcaatctgcccaccacagccgtcacctcccctacaggctgcttgcgaaaaccagccggctctccttacgcaccagctgcagaggctgcgtatccaaccaagctcccctcctcctaatcatccaaacaaccatttgttcaggcagccatccaactcaccgcctccaatgagctctgcaatgatccagccgcacggagctgcctcaagctcacagtttcagggcctgccctcccgctctgccatcttccaacaacagccagagaattgtagttccccccctaatgtagccttaacctgcctcggtatgcaacagccagcccagagccagcaggtgactatccaggttcaagaacctgtggatatgctgtctaatatgccagggacggccgcaggatcatccgggagaggtattagcatctcaccatctgcaggacagatgcagatgcagcatcggacaaacttaatggccaccttgagttatgggcataggccgctgtccaagcagctgagcgccgattccgctgaagcccatagcgcacatcagcaaccaccgcactataccacatcagctttgcagcaggctctgctgtcccctacaccacctgactataccagacatcaacaggtcccccatattttgcaagggttactgtcgccacggcactctctcaccgggcacagtgacatcagactgcccccaactgaattcgcccaactcatcaagaggcagcagcaacagaggcagcaacagcagcagcagcaacagcaacaggagtatcaagagctctttaggcacatgaatcagggtgacgccggatccttagccccatccctggggggacagagcatgactgaacggcaggcactaagctaccagaacgcagattcttaccaccatcacacctcaccacagcatttactgcagatccgagctcaggagtgcgtctcccaggccagcagtcccacacccccacacggctatgcccatcagcctgccctaatgcacagcgaaagcatggaagaggactgctcttgtgaaggggctaaggatgggtttcaggattcaaagagtagctccaccttaacaaaaggatgtcacgatagccctttacttctgagcaccggcggacccggtgatcccgaatccttactcgggactgtcagtcacgcccaggagctgggcatacacccttatggccatcagcccacagcggcattcagcaagaacaaagtgcccagcagggaacctgtaatcgggaactgtatggataggtctagtccgggacaggctgtcgagctgcctgatcataatggactgggttatcctgctcgtccttctgttcacgagcaccaccgtccaagagcattgcagcggcaccacaccattcagaattctgatgatgcttatgtgcagctggataacctgcctggaatgtctctcgtcgctggcaaagcactgagctctgcccgtatgtcggatgctgtactatcacaatcctccttaatgggaagccagcagttccaggacggagaaaatgaggaatgcggcgcaagtctgggcggacacgaacatcccgacctgtccgatggcagccaacacctgaacagctcatgctacccgagtacttgcataaccgacatactgttatcttacaagcatccggaagtctctttttccatggaacaggcgggtgtatag

SEQ ID NO: 30270 - DNA, 1461 bp, Artificial Sequence
  Description of Artificial Sequence: Synthetic coding sequence
atgacgctaatggtccttacgtttagctcatatatcctggattttatcaacgttctgagctatgatttgcatggatcgtgggagagatttactggccacaacagcccgctgttctccctcccagaggatcccaaaagcagtgcttacgcaatgaactactggagaaagctgggagctcctagtgagaaactgatcatgggcatccctacgtacggacggacctttcgactgctcaaagcatcaaaaaacgggttacaggctagggcaatcgggccagctagccctggcaagtacaccaagcaggaaggcttcctggcatactttgagatttgcagcttcgtttggggtgccaaaaaacactggatcgactaccagtacgtgccttatgcaaacaaaggcaaggagtgggtgggatatgacaatgccatcagcttttcctataaggcttggttcataaggagggaacattttgggggtgctatggtgtggactctggacatggacgatgtgaggggcacattttgtgggacgggtccttttcctctagtttatgtcctgaacgatatcctggtgcgcgctgagttttccagtacctcattgcctcaattctggctctccagtgccgtcaacagcagcagtactgacccagagcgattggcagtgaccacagcctggaccaccgactctaagatcctgcccccagggggtgaggccggtgtgaccgaaatacatggcaagtgcgagaatatgaccatcacaccacggggaactacagtcaccccgaccaaagaaacagtctctctcgggaaacacacagtagccctgggagaaaagaccgagatcactggtgcaatgaccatgacaagcgtgggccaccagagcatgacaccgggtgaaaaagcccttaccccagttgggcatcaaagtgtcaccaccgggcagaagaccctcacatccgtggggtaccagtccgttactccaggcgagaagacactgactccagtcggccaccaaagtgtcactccagtcagccaccaaagcgtgtccccgggaggaactacaatgacacctgttcactttcaaactgaaaccttaagacaaaataccgtagcacctcgcaggaaagcagtggccagggagaaggttaccgtgccctctagaaacataagcgtgactccagagggtcagacaatgcctctccggggagaaaacctgacttctgaggtcggcactcacccacgcatgggtaatcttggcctgcaaatggaagccgagaatcggatgatgctttcgtcatctcccgtgattcagctgcctgaacaaactcccctggcctttgataatagatttgtaccgatatacggcaatcattcctccgtgaactccgttacgccccagacatctccgctatcacttaaaaaggagattccggaaaatagcgccgtcgatgaggaggcctag

SEQ ID NO: 30271 - DNA, 1017 bp, Artificial Sequence
  Description of Artificial Sequence: Synthetic coding sequence
atggagctctggggcaggatgctgtgggctttactgagcggacctggacgcagaggctccacacggggttgggccttcagctcttggcagcctcagccgccattagctggattatcttcagcgatcgagctagtgtcacactggacaggggtttttgagaaacgaggtatccccgaagccagagagtccagtgaatatattgtggcccacgtattaggcgctaaaacttttcagtctctgagaccggctttgtggactcagcctcttactagccagcagttacagtgcatacgtgagctgtcctcccgcagactgcagcggatgccagtgcagtacattttgggggaatgggactttcaggggctaagtctgaggatggtgccacctgtcttcatccccaggcccgagacggaagaactcgtggagtgggttctggaggaagtggcacagcgatcacacgccgttggctccccaggaagtccactgatcctggaagttggctgcggcagcggagccatcagtttaagtcttctaagtcagctgccccaaagccgggtgatagcagtggacaagagggaagcagccatctccctgacacatgaaaatgcccagaggttgaggctgcaggatcgcatttggatcatacaccttgatatgacgtcggagcggagttggacgcatctgccttggggccctatggacttaattgtctctaaccctccatacgtgtttcatcaggacatggaacagctagcacctgagatacgatcttacgaagatccagcagctttggatgggggagaggaaggcatggacataatcactcacatcctggctctggcccctcggctgctgaaggactctggcagcattttccttgaggtggaccccagacacccggaattggtgagttcttggttgcagtcacgtcccgacctatatctcaacctggtggctgtaaggagggatttttgcggtcgccctcgattcctgcacattaggaggagtgggccttag

SEQ ID NO: 30272 - DNA, 1899 bp, Artificial Sequence
  Description of Artificial Sequence: Synthetic coding sequence
atggacactatgatgctgaacgtccgcaatctctttgagcagctcgttcgtcgggtggaaattttatctgaaggtaatgaggtccagttcatccaactggccaaggattttgaggattttcgtaagaagtggcagcgcacggaccatgagctgggcaagtacaaggatctgctgatgaaagccgagacagaacgatctgcattagatgttaagctgaagcacgcccgaaaccaggtggatgtggaaattaagaggaggcagagggcggaagccgactgcgagaagctggaacggcagatccaactcatcagggagatgttgatgtgcgatacctcaggaagtatacaactatccgaagaacagaagtcggcattggcctttcttaaccgagggcagccctcgagcagcaacgcaggcaataagcgtctgtctaccattgatgagtccgggtcaattctttctgacatttcctttgataagacggacgaatctctggattgggactcttctctcgtgaagactttcaagctgaaaaagcgtgagaagagacgctctacaagtagacagttcgttgatggcccacctggaccagtgaaaaaaacccggtccataggttctgctgtcgaccaggggaatgagtctatcgtcgcgaagaccacagtgactgtgccaaacgacgggggtccgattgaagctgtgtccacaatcgaaacggtgccttactggacccgatcacgtcgcaaaacgggcacgttgcagccttggaattctgatagcaccttaaactcgaggcagctggagccgagaaccgagactgattctgttgggacgccccaatcgaatggcggtatgagactgcacgacttcgtatccaaaaccgttattaagcctgaaagctgtgtgccttgcgggaaaaggattaagtttggcaagctgagccttaagtgcagggattgccgagtggtgtcccatccagagtgtcgggaccgatgtcccctgccttgtatccctacgctgatcggtactcccgtgaaaatcggcgaggggatgctggcggatttcgtttctcagacttccccgatgattccaagtatcgttgtgcactgcgtgaacgaaattgaacagagggggctgactgagaccgggttgtacaggatatcagggtgcgaccgcacagtcaaggagttaaaggaaaaattcttaagagtaaagaccgtccccctgttgtcaaaggtcgatgatatacacgctatctgctctttacttaaagacttcctgcggaatctgaaagaaccattgctgacgttcaggctaaatcgagcatttatggaagccgctgaaattaccgacgaggataacagcattgctgccatgtatcaggctgtgggggagttgccgcaggctaatcgcgatacacttgcctttctgatgatccatctacagcgcgtggcgcagtccccccatacgaagatggacgtggccaatttggccaaggtttttgggccaactatcgttgcacacgcagtgcccaatccagatccagtgaccatgcttcaagacattaagaggcagcccaaggtggtggagcgcctgctctctctgcctctggagtattggtcgcagtttatgatggtagaacaggagaatattgatcccttacacgtgatcgaaaattctaacgcttttagcaccccacagacccctgacattaaggttagcttactgggccctgtgaccacccccgagcatcagttgctgaagacaccgtctagctctagtctctcacagcgcgtccgttcaacattaacaaagaacacccccaggtttggatccaaatccaagagcgcaacaaatttgggaagacaaggaaatttttttgcctcccccatgctcaagtag

SEQ ID NO: 30273 - DNA, 1791 bp, Artificial Sequence
  Description of Artificial Sequence: Synthetic coding sequence
atgagtaaccagcaggagaagtacgaggctcagaatatcgtcaacagtacagaagaatccgatgacgccttcgataccgtcactattcccgtgccttctgaggagccacaggaaagtgaccagactgaggaacatgagtccgggatcgaacagtttagcgaatctcatgcgatccacgttgaagaacagagcgatcagtcattctcctcactagagcctgataatgagcagctcatggaagaggtgatttctccccgacaggtgtcatacactccacagcatcatgaaaagcagtacgctatgcagcgcccaaacgacgattccctcgcttttctggacaagatcaagagtgttaaggaatcccttcaggagagtgttgaagactcacttgcgaccgtgaaagtggtgctgatacctgtaggccaggagattgtgattcccttcaaggtagacacaattctgaaatatctgaaagaccacttctctcacctgctggggataccacattcagtactccagatccgctacagcggcaagatactaaagaacaatgaaacactggtgcaacacggagtcaagccacaggagatcgtccaggtggaaatctttagcactaaccccgacctgtatcccgtaagacgcatcgacgggctgactgacgtgtcccagattataacggtgaccgtccagaccggcctggaccagtaccaacaggtcccagtcgaaattgttaaatcagactttcacaaaccattcttaggtggctttcggcataaagtgacaggcgtggaataccacaatgcaggcactcagacagttcctaagcggatacctgagcgcttatccatattttgcagggatacacaaaccgtgtttcaaaagaagaacttgcaacaaacaacaaacacaacgagtacacagatgaccaatatcggtgtctatgtgagcaacatgacggacaagctcgtaaccccaggaaagtacttttccgccgctgaatatcatgcccaaaggctgaaggccgtgatcgtcattcaaacttattaccgacaatggcacgccaagatattcgttgaaaatctacggagacagaaatccttgaggctcgaatgggagacccagcaggaactccggaagattcgtgagaaagaggaatggatcaaactggactatcataggcgccataaccccaaaaccaatgaggatttcgaattcctctataacgcactggaattttggaggcaagaggagctgacacgcatcaatcagtcgttcacaggtgccgagcgcaaagctgccctgtgcgaactcctggagaaagaaacccagattattgcgtctatagggagacaccgatacatcgcctacatggcgaaccaagaagccgcaattcaggcctttctggacaagtgctctgccccaaaaatttggcgtacacctaacggtaaaaccatcgagatggacacccagttcactatccgagccagagagctgcaaaatatctataagtgtatcatgctgaagaacatcagccaggatgagcggcttgacgtgctactcacactgaagcatacagtgaaagagcacgagtgcaagcttacacaggagatcctggagcttatcgaccgggaggttgatctcatgatgcggggagtaaagcaccacaacctggagggcttgagaaagcgcatcgcaaccctctttttccattacattaagacacccctgttcaacccagaggtggctaagtatctaaagatgggaggtgagtacttatcgatggccctgtag

SEQ ID NO: 30274 - DNA, 1305 bp, Artificial Sequence
  Description of Artificial Sequence: Synthetic coding sequence
atggtgcaggacggaacattcaaaactcgcgattcaacttggacttgtgaatctacccgcatggctgcagctccccctagttactgcttcgtagcctttcccccacgggctaaggatgggttggttgtgttcgggaaaaattccgcacgaccgcgagatgaggtgcaggaggtcgtgtacttcagtgctgccgatcacgagcccgagtccaaggtggaatgcacatacatttccatcgaccaggtgcccaggacatatgctatcatgatctcaagacctgcatggctgtggggagctgaaatgggagcaaatgagcatggagtttgcattgcaaacgaggccatcaatacccgagaaccagccgcagagatagaagccctgctgggtatggatcttgtacgcctgggtttggagagaggcgagactgctaaggaagccctggacgttatcgtatcactgttggaggagcacggacaaggcggaaactacttcgaggacgcaaattcctgtcattctttccagtccgcctacctgattgtcgatcgggacgaggcatgggtgttggagactattgggaagtactgggccgcagagaaggttaccgagggtgtccgatgcatttgctcccaacttagcctgaccaccaagatggacgccgagcacccagaactcagatcttacgcgcaatctcaggggtggtggacaggtgaaggcgaattcaactttagcgaagtattttcccccgtcgaggaccacctggactgcggagccggaaaagattctttagagaagcaagaagagagcatcaccgtccaaaccatgatgaacaccctgagggacaaagcctctggcgtgtgcatcgatagtgagttcttcctcacgactgcctcaggggttagtgtgctgccgcagaatcgctcctctccctgtattcactatttcactggtacgcccgacccttcaagatcaatcttcaaacctttcatctttgtcgacgacgttaaactggtgccaaagacacaaagcccttgctttggcgatgacgaccccgctaaaaaggaacctaggttccaggagaagcctgatagaaggcacgaactttataaagctcacgaatgggcacgggctatcatcgagtccgaccaagaacagggcaggaagctaaggagcaccatgctggaattggaaaagcagggcttggaggccatggaagaaattctgacatcttccgaaccactcgacccagccgaggttggggacctgttctacgattgtgtggataccgagatcaaattcttcaaatag

SEQ ID NO: 30275 - DNA, 1320 bp, Artificial Sequence
  Description of Artificial Sequence: Synthetic coding sequence
atggcctggccttgcataacccgagcatgctgcatagctcgattctggaaccagctggacaaagccgatattgctgtgcccttggtctttactaaatatagcgaggccactgagcatccaggagcccctccacaacccccaccaccacagcagcaggcccagccagctctggcacccccttctgcccgagccgtcgccatagaaacccaacccgctcagggcgaactggatgcagtggcccgagcaactggtccggcacctggacctaccggcgagagagagcccgctgctggccctggcaggtctggcccaggaccaggtttagggtccgggtcgacaagcggccctgcagactccgttatgaggcaggactacagagcttggaaggtgcagcgaccggagccatcttgtcggccacggtccgagtatcagccatcggacgccccttttgagagagaaacacaatatcagaaagattttcgggcttggcctcttcctcgccgaggagaccacccttggattccaaagcctgtccaaatttcagctgcctctcaagcaagtgccccaatccttggtgcccctaaacgccgtcctcagagtcaagagcgttggcccgttcaggccgcagccgaggcaagggaacaggaagccgctccaggtggagcaggtggattggcggctggaaaagctagtggtgctgatgagcgagacacccgcaggaaggctggcccagcgtggatcgttagacgggctgaggggctaggtcacgaacagacccctttacctgcagctcaggctcaagtccaagccacaggccctgaagcgggtcgcggacgcgctgcagccgacgcgttaaatagacagattcgagaggaagtggcctcagccgtttcaagctcctataggaatgagttcagggcatggactgacattaaaccggtcaagcctattaaggccaagccgcagtacaagccacccgacgacaagatggtccacgaaaccagctacagcgcacagttcaaaggcgaggctagtaagcccactaccgccgacaataaagtgatcgacagacgtagaataagaagcttatactcggagccattcaaggagcctcccaaggtggagaagccatctgtgcaatcttctaaacccaaaaagacatcagcatctcataagcccactcggaaagcgaaggataagcaagctgtctcaggccaagcagccaagaagaagagcgcggaaggaccaagcaccacgaagcccgacgacaaggagcagtccaaggagatgaataacaaactcgctgaggccaaagaatag

SEQ ID NO: 30276 - DNA, 813 bp, Artificial Sequence
  Description of Artificial Sequence: Synthetic coding sequence
atgggagggtgtttctctaagcctaaaccagtggagctcaagatcgaagtcgtgctgcccgaaaaggagaggggaaaggaggagctgagtgccagcggcaaaggttccccgcgagcttaccagggcaatggtaccgcacgacattttcacactgaagaaaggctgtcgaccccccacccttatccttcgccccaagactgcgtcgaagcagcagtgtgtcatgtgaaagatctggagaacggccagatgcgtgaagtggaactgggatggggaaaagtgctgcttgtgaaggacaatggtgagtttcacgctttaggccacaagtgtccccattacggtgctcctctggtgaaaggtgtgttatcccggggaagggtgcgctgtccatggcacggcgcatgttttaatatctcaactggcgatctggaggactttccaggattggactccctccataagtttcaggtcaagattgagaaggaaaaggtgtacgtgcgcgcatccaaacaagcgctccagcttcagcgtcgtactaaagtcatggccaaatgtattagccctagtgccggttacagctcatccacaaatgtactgatcgtcggcgcaggggctgctggcctagtctgtgccgaaactctgagacaggaggggttttcagatagaatagtgctctgcacacttgatcgccatctgccctatgataggccgaagctcagcaagagtctagacactcaacctgagcagttggcactcagacccaaagagttttttagggcctacggaattgaggtcctcactgaggctcaggtgtag

SEQ ID NO: 30277 - DNA, 369 bp, Artificial Sequence
  Description of Artificial Sequence: Synthetic coding sequence
atggcgacaagtgctccgctcaggtcacttgaagaagaggttacttgttcgatctgtctcgattatctgagagatcccgttacaattgattgtgggcatgtgttttgccgatcatgtacgacggatgtcaggcctatcagtgggtcccgacctgtgtgtccactatgcaagaaaccattcaaaaaggagaacattcggcctgtgtggcaacttgcctctctagtcgagaatattgagaggcttaaggtagacaagggcaggcagcccggtgaagtgacaagggaacagcaggacgccaagctgtgcgaacgccatcgggagaagttgcattactactgcgaagacgacggcaagctgctctgcgtttag

SEQ ID NO: 30278 - DNA, 1269 bp, Artificial Sequence
  Description of Artificial Sequence: Synthetic coding sequence
atgactccatccatcccatcgatccgccgtttgggttcaggttatttttcttctaacggaaaattggaggaagtgaagacccctaagaaccctgtcaagagaaaagatctgctgcggcatgatcctgatttgcacatgcaccagggatacgataagtacgacgttagcgagttttgttcttatattaaatcttccagttccctcgggaatgccacctctgatgaagaccctaacactaacattatgaacatcaacgagaacaaaaatatccccaaagccaagaataaaagcgagtctgagaacgagccaaaggctggcacggacagcccggtgagctgcgcttctgtgaccgaagagcgagtggctagcgattctcccaaacctgcccttacacttcagcagggccaagaattcagcgccggaggccaaaatgctgagaatctttgtcaattcttcaagatcagtcccgacctcaatataaagtgcgagcgcaaggatgatttccttggagccgctgagggaaaattgcagtgcaacagactcatgcctaattcgcagaaggactgtcactgtctgggggacgtgctgattgagaacaccaaggaatcaaaaagccaatcggaggacctcgggaggaagcctatggagtcttcttcagtggtcagttgtcgcgaccgcaaggatcgcagacgtagtatgtgttacagtgacgggaggagcctgcacctagagaagaacggaaaccataccccttccagcagcgttggctcctctgtcgaaattagcctggagaactcagaactgtttaaagacttgtcagatgcaattgagcagacctttcaaaggcgaaatagtgaaactaaggtgaggcggtctacccgccttcagaaggacttggaaaacgagggacttgtatggattagccttccccttccctctacttcccaaaaggctaagaggcgcaccatctgtacctttgatagttctggcttcgagagtatgagccccatcaaagagacagtgtcttcaagacagaagccccaaatggcgcctccagtgtccgatccagaaaattcccaggggcctgccgctggatcatccgatgaacctgggaagcgccgtaaaagtttctgtatatcaactttggcgaatacaaaagcaacctcacagttcaagggttacaggcgtcggtcttccctgaatggaaagggagagtcttcattaaccgcgctagaacgcatagaacataacggagagagaaaacagtag

SEQ ID NO: 30279 - DNA, 3336 bp, Artificial Sequence
  Description of Artificial Sequence: Synthetic coding sequence
atggtccgtgagagaaagtgtattctctgccacattgtgtactcttcaaagaaggaaatggacgagcacatgaggagtatgttacatcaccgcgagctggagaatcttaagggtcggttcggtatcgaaatggtgcctttagtgcaaaatgaacaggaggccctcgacctcgacggtgaaccggatctgtcctccctggagggcttccagtgggagggcgtgtccatatcctctagccctggactggctaggaaacgcagtctaagcgaaagttcggttatcatggaccgggcaccatccgtctactcatttttctccgaggaggggactggaaaagagaacgagcctcagcagatggtctccccgtcgaatagcttgagagctgggcagtctcagaaggcaaccatgcatttaaagcaagaggttacccctcgcgctgcctcccttaggacaggcgaaagagccgagaatgtggcaacccaaaggcgacactccgcccaattatcctcagaccacatcattccacttatgcatcttgcgaaggatctgaacagccaagaaaggtccatcccaccttcggagaatcagaacagccaggagtctaacggggaggggaattgtctgagctcgtctgcttcttctgccctcgcaatcagctcacttgcagacgctgccacagatagtagctgtacctcaggcgcagaacagaatgatggacagagcattcgcaagaaacgtcgcgcaacgggcgatggttcttcccccgagctgccctccctcgaaaggaagaataaacgtaggaaaataaagggaaagaaggaaagatcccaggttgaccaactactaaatatttctctccgcgaggaggagttatccaaatctctccagtgcatggacaacaatctattgcaagccagagctgctcttcagaccgcttatgtggaagttcaacgcctactgatgctaaaacagcagattacgatggagatgagcgctctccggacccacagaatacagatcctgcagggactgcaggaaacctacgaacccagcgagcaccccgatcaggtgccttgctccttaacaagggagagaagaaattcacgcagccagactagtatcgatgctgccctgctgccaacgccatttttcccgctgtttcttgaacccccttcaagtcatgttagcccctcccccactggcgcaagtctgcagattacaactagcccaacttttcagactcacggaagtgtgccggctcccgatagcagcgttcagatcaagcaggagcctatgtcccctgaacaagatgaaaacgtaaatgcggtccccccatcctcagcctgcaacgtgtccaaggaacttctggaggcaaacagggagatctccgatagctgtccggtttatcctgttatcaccgcacggctgtcactcccggagagcactgaaagctttcacgaaccgagtcaagagctgaaattttctgttgagcagaggaataccagaaatagagaaaatagccccagttcccaatccgccggtttgtcctctatcaacaaggaaggtgaggaacccacaaaaggcaactctggatctgaggcctgcacatcttctttcctgcggttgtcatttgcttctgaaacacccctggagaaagaacctcattctcccgcagatcagcccgaacagcaagctgaatccactctgacgtctgcagagactcgtggatccaaaaaaaagaagaagctgagaaagaagaagtcactacgggctgcccacgttcccgagaacagcgatacagagcaggacgtgctgacggtgaaaccggtccgcaaagttaaggcaggtaagctcattaaaggcggtaaagtgacaacttccacttgggaagatagccgtacaggtagagaacaagaaagtgtaagggatgagcccgacagcgattcatcacttgaggtactggagattcccaatccacagttggaagttgtcgccatcgattcctcagaatccggagaggagaagccagactccccttccaaaaaggatatctggaactctacggagcagaatcctctcgagaccagtcgctcaggctgcgatgaggtctcgtccacatccgagattgggacccgctacaaggatggcattcccgtgtctgttgcagagacgcagacggtgatctccagcattaagggctctaagaactcaagtgagatttcttctgaacccggtgacgacgatgagccaaccgagggctcattcgagggccaccaggctgcagtgaatgcaatacagattttcgggaatctgctctacacttgttccgcagacaagacagtgagggtttacaacctcgtgagtcgaaaatgtatcggcgtgttcgaaggacacaccagtaaagtgaattgcctactcgtgactcagacaagcgggaagaacgctgcgctatacactggctcctcagaccatactattcggtgttataacgttaaaagccgggaatgtgtggaacaattacagctcgaagatagggtcctctgccttcatagtcgctggagaatcttatacgcaggcctagcaaacggtacggtggtcacatttaacatcaagaataacaagcgcctggaaatttttgagtgtcacggaccaagggccgttagctgcttggcgacagcacaggaaggcgctcggaagcttctcgtggtgggatcatatgattgcacaataagcgtgagagatgcacggaatggtcttcttttgagaacactggaaggtcactccaagacgatcctgtgcatgaaggtggttaacgatttggtgttctccggcagctctgaccagtcggtgcatgctcacaatatacatacaggcgagttggtgaggatttataagggacataatcacgccgtaaccgtggtgaatatcctcgggaaggttatggtcacggcgtgtctcgacaagtttgttagagtgtacgagctacaaagtcatgaccggctgcaggtgtacggcggtcacaaggacatgataatgtgtatgaccatacacaaaagcatgatatacacaggttgttacgatggtagcatccaagcggtgagactcaatctgatgcagaactaccgatgctggtggcacggctgttctctcattttcggcgttgtagatcatctcaagcagcatctcctcacggatcacactaatcccaattttcagacattaaagtgccgctggaagaactgcgatgcattttttaccgctcggaaaggctcaaagcaggatgctgccggacacattgaaaggcacgctgaggatgattccaaaatcgactcttag

SEQ ID NO: 30280 - DNA, 354 bp, Artificial Sequence
  Description of Artificial Sequence: Synthetic coding sequence
atgtacagccccattatttaccaagcgctctgtgagcatgtgcagactcagatgtctttgatgaatgacttgacgagcaaaaatatccctaatggcattccagcagtgccttgtcatgctcctagtcactctgaaagccaagccacaccacactcttcttacgggctttgcaccagcaccccagtgtggagtctgcagcgccctccttgtcctcccaaggtgcattccgaggtccaaacggacgggaattctcagttcgcctcacagggtaaaactgtgagtgctacctgtacagatgtgctgcgaaatagtttcaacacctctcccggtgtgccttgttcccttccgaagtag

SEQ ID NO: 30281 - DNA, 189 bp, Artificial Sequence
  Description of Artificial Sequence: Synthetic coding sequence
atggccgcacttcgcccactggttaaacccaaaattgtgaagaagagaaccaaaaaatttatccgtcaccagagcgataggtatgttaaaatcaagcggaattggcggaagcccagggggatcgacaacagagtccgaagaaggttcaagggccagatcctcatgccaaacataggatatgggtcgtag

SEQ ID NO: 30282 - DNA, 411 bp, Artificial Sequence
  Description of Artificial Sequence: Synthetic coding sequence
atgtcggcctcatgtgacgggtgtgtcggaagtcgcccacctgtacatctggctagcggatacagcctcgcagatctccttgtgctcgagatggggatgggtacccagtgttggacagaagaccagagacgatggtcaagcttatggccttggtcacatctgagttcagtattgctcgccgataaagagggcggaccccctgccgtggacgaggtgctcgatgaggctgtgccggagtaccgggcacccggacggaagtctctcctggaaatccgacagctggatcctgacgatcgtagcctggcaaagtataagcgggtcttactaggccctctaccacctgctgttgatccatcactgcccaatgtacaggtcacacgattaactttgctctcagaacaggccccatag

SEQ ID NO: 30283 - DNA, 1803 bp, Artificial Sequence
  Description of Artificial Sequence: Synthetic coding sequence
atgcccgaaattcgcgtgacacctctgggcgcagggcaagacgtgggcaggagctgcattttggttagcatcgcaggtaagaacgtcatgctggactgcggaatgcacatggggttcaatgacgatcgaagattcccagacttttcgtatataacacaaaacggacggctgacagattttttagattgtgtcatcatcagccactttcatttagaccactgtggtgctctcccttacttttccgaaatggtggggtatgatggccctatctacatgacccatccaactcaggcgatctgccccatactgctggaggattaccgaaagatcgcagttgataagaagggcgaagccaacttcttcacctctcagatgattaaagattgtatgaaaaaggtagttgccgtccatctgcaccaaaccgttcaggtcgatgatgagctggagattaaagcctactacgctggtcacgtgctgggagcagccatgttccagataaaggtggggtctgaatcggtggtgtacacaggggactataatatgacaccagaccgccatcttggtgccgcttggatagacaagtgtcgcccaaacctgctgatcaccgagtcgacttatgccaccactattcgcgactccaagagatgtagagaacgagactttcttaagaaggtacatgaaaccgtggaaagaggcggaaaggtgctgatccctgtctttgcactgggacgagcacaggaactttgtattcttctagaaacattctgggaaaggatgaacctgaaagtgccaatttattttagtaccggattgactgaaaaggcaaaccactattataagctgttcataccctggacaaaccaaaaaatccgaaagacgttcgtgcagagaaacatgttcgaattcaaacatataaaggcttttgatagagcatttgccgacaaccccggaccaatggtggtgttcgctacacctgggatgctgcacgctgggcagagtctgcagatcttccgcaagtgggcaggcaacgagaagaacatggtcatcatgccagggtactgcgtgcagggcaccgttggacataagattctatcaggacaaaggaaactggaaatggagggtagacaggtgctggaggtcaaaatgcaggtggagtatatgtccttttctgcccacgctgacgccaaaggaatcatgcaactcgtgggacaagcagagcctgagtccgtcctactggtgcacggcgaggcaaagaagatggaatttttgaagcagaaaatagagcaagagttaagagtgaactgttacatgcctgcaaatggcgagactgtaacacttcctacctcacctagcatacctgtcggcatcagtctcgggctcctgaagagagagatggcacaggggttgttgcccgaggctaagaaacccagactccttcatggtaccctaataatgaaggactccaatttccgcttggtcagttcggaacaggccttgaaagagttaggcctcgccgagcaccagctgcgattcacctgtcgcgtccatctacacgataccaggaaggagcaggagacagcgctccgcgtgtattcccatctgaagagcgttctcaaggatcattgcgttcaacacctgccggatggttccgtgacggtcgaatcagtgcttttgcaagcggcagcaccctccgaagacccaggtaccaaagtgctgctggttagctggacatatcaggacgaagagttaggaagcttcctaacctccctcctgaaaaaaggcctccctcaggccccaagctag

SEQ ID NO: 30284 - DNA, 774 bp, Artificial Sequence
  Description of Artificial Sequence: Synthetic coding sequence
atgctggagtatgccctcaaacaggagcgagccaagtaccacaaattgaagttcggtaccgacttaaaccagggagaaaaaaaggctgacgtgtcagaacaggtcagcaatggacccgtcgagtctgtgacactggaaaactccccgctggtgtggaaagagggtcgccagctgctgaggcagtacttggaggaagtcgggtataccgatactattttggacatgcgtagcaagagagtcaggtctctgctcggcaggtcactggagctcaacggcgctgtggagcccagcgaaggcgctccaagggcaccgccaggcccagccggattatccgggggtgaaagcctcctagtgaagcagatcgaggagcagatcaagcgaaatgctgccggaaaggatggcaaagaaaggctcggaggatccgtactcgggcagattccattcttgcaaaattgtgaagacgaggactctgatgaagatgacgaacttgacagcgttcagcataagaagcaacgggtcaagctcccttcgaaggctcttgttccagagatggaggacgaggatgaagaggacgatagcgaagatgccattaacgaattcgattttctgggaagcggagaggatggcgaaggggctcccgacccaagacggtgtaccgtggacggaagtccgcatgaacttggacctgaactacattcgcctactgagtggcagggggcactgtcagtgggcaaggcctccccgatgcctgattgggtgggcactgccggatag

SEQ ID NO: 30285 - DNA, 381 bp, Artificial Sequence
  Description of Artificial Sequence: Synthetic coding sequence
atgccgggagtcaaactcacaacacaggcctattgcaagatggtcctgcatggcgctaaataccctcattgcgcagttaatggtttgctggtcgctgagaaacaaaagccccgtaaagagcacctgccccttgggggtcccggagcacatcataccttgtttgttgactgtattccattattccatgggactttggcactcgcacccatgttagaggtggctctcaccttgattgattcatggtgtaaggaccactcttatgtgatcgcaggttactaccaggctaatgaacgcgtcaaagatgctagccccaatcaggttgccgaaaaggtggcatcccgaattgccgagggcttcagcgatactgctctcatcatgtag

SEQ ID NO: 30286 - DNA, 450 bp, Artificial Sequence
  Description of Artificial Sequence: Synthetic coding sequence
gtccgggaactggaggctgagcttgatgccgagcaaaaaaaacacgcggaagctctgaagggggtgaggaagcacgaaaggcgggttaaagagcttgcctaccaggtcggagatcgcgtctccctcgggtcagggccaggagcaggccctgcccaggcaagtcccgaaagccctctacccgcacaggctgaagaggatagaaagaacctggcacgaatgcaagacctcgtggataaactacagtccaaagtgaaaagctacaaacggcagtttgaggaggcagagcagcaggccaatactaacctcgccaagtacagaaaagcccaacatgaattggatgacgctgaggaacgagctgatatggccgagactcaggccaataaactgcgcgctcgaacacgcgatgctctcggccctaaactatctctttctccccagcacaaggagtag

SEQ ID NO: 30287 - DNA, 2349 bp, Artificial Sequence
  Description of Artificial Sequence: Synthetic coding sequence
atggactcctccatccacctttcgagtctgatttctcggcatgatgatgaggccacaaggacaagtactagcgaaggcctcgaggaaggcgaagttgagggcgaaaccctcctgattgttgagagtgaggaccaggcctctgtggacctctcacacgaccagagcggtgactctcttaactccgatgagggagatgtgtcttggatggaagagcaattgagttatttctgcgataagtgtcagaagtggatccccgcttcacagctgcgggaacagttgtcttacctgaagggcgacaattttttccgattcacatgttctgactgttctgctgatggaaaggagcaatatgagcggctgaagctcacctggcagcaggtcgttatgttggctatgtataatctctcattggaggggtcagggcgacagggttactttagatggaaggaggatatatgtgcattcatagagaaacactggacattcctgttagggaacaggaagaaaacctcaacgtggtggtcgactgtggcaggatgtctgtctgtgggcagtcctatgtactttagatccggggcacaagaattcggagaacccggttggtggaaactggtacataataagcctcccaccatgaagccagagggggagaaattgagcgcaagcacactcaagatcaaagctgcttcaaaacccactctggacccgataattaccgtagaaggccttaggaagcgagccagccgcaatcccgttgagtccgccatggaactcaaggagaagcggtctcggacacaggaagcgaaagacattcgcagagctcagaaggaggcagccggatttcttgatagatcaacctcttcaaccccggtgaagttcatttcacggggacgcagaccagatgtcatcttggagaaaggagaggtcatcgatttctcatccctttcgagttcggaccgaacacccctaacaagtccctccccttccccctccctggactttagcgcccctggcacgcccgcaagccattccgcaacacccagcctgctatccgaggccgacttgatccccgacgtgatgccccctcaagctctcttccatgatgacgacgagatggagggcgatggggttatcgacccaggtatggagtacgtccccccacctgctggctccgttgcttctggaccagttgtaggtgtgcgcaaaaaggtgcgtggacctgagcagatcaaacaggaggtggaatctgaggaggagaagccagataggatggacatcgatagcgaagacacggacagcaacaccagcctgcagacacgagcacgtgaaaaacgaaaaccccagctcgaaaaggacactaaacctaaggagccaaggtatactccagtttcgatttatgaggaaaagctgttacttaagagattggaggcttgccctggcgctgtcgcaatgacaccagaagccaggagattgaagcgtaagctcatcgtgagacaggccaagagagacaggggattgcctcttttcgatctcgatcaggtcgtgaatgccgcactgctgttggttgacggtatttacggagcaaaggaaggtggtatatccagactgcctgccggtcaagccacctaccgaacaacatgccaggactttaggatactggatcggtatcagactagtctgcctagccgaaaggggttccgccaccagaccaccaaatttctctatcggctggtgggctcggaagatatggccgtagaccaatccatcgtctctccctacacgtccaggatcctgaagccctacatcaggagggattacgagactaagccccctaagctgcagcttttaagtcaaatacggagtcatctgcaccgaagtgacccacactggaccccagagcctgacgctccgttggattattgttatgtgcggccaaatcacatccctactattaattccatgtgtcaagagttcttttggcccggaatcgatctgagcgagtgccttcaataccccgacttttcagtggtagttttatataaaaaggttatcatagcgttcggcttcatggtacctgatgtgaagtacaacgaggcgtacattagcttcttatttgtccatcctgaatggaggagagccggaatcgctacattcatgatataccatctaatccagacttgtatgggaaaggacgtcactttgcacgtatccgcatccaatcctgctatgttgttatatcagaagttcgggttcaagacagaggaatatgtgctggacttttatgataaatactaccccttagaatccactgaatgtaaacatgctttttttcttaggctgagacgctag

SEQ ID NO: 30288 - DNA, 495 bp, Artificial Sequence
  Description of Artificial Sequence: Synthetic coding sequence
atgatgagcgaggtcgaagaggctatgcagtgcgtggaagagttgaacgcgcaaggactgctgcacgtgtttgtgcgcgtgggggtggaatcaacacttgaaaggtcccagattacccgagatcatatggggcagttgctataccagctcgttcagtcagagaaattgtctaagcaggactttttcaagggcttcagcgagacgctggaactcgccgacgacatggccatcgacatccctcatatatggttatacctcgcagagctcgtaacacctatgctcaaggagggcggtatatctatgcgggaactaacaattgagttcagtaaacccctactgcccgttggacgtgcaggggtgctgctcagcgaaattctccacctgctgtgcaagcagatgagccacaagaaggttggtgctttgtggcgggaggctgatttatcttggaaggattttctgcctgaaggtgaggatgtccacaattttctgctgtag

SEQ ID NO: 30289 - DNA, 369 bp, Artificial Sequence
  Description of Artificial Sequence: Synthetic coding sequence
atggcaacatccgcgcctcttaggtccttagaggaggaggtgacgtgttctatctgtctcgattacctgagggatcctgtgaccattgactgcggacacgtgttctgtcgatcttgtacgacggacgtacgaccaatctctggcagcagacctgtttgccccctgtgtaagaaaccatttaaaaaagagaatatacgcccagtttggcagctggcttcgctggtcgaaaatattgaacgtctgaaagtggacaagggcagacagccgggtgaagtaactcgggagcagcaggacgccaaactttgcgagcggcatcgtgagaagcttcattactactgcgaagatgacggaaaactgctgtgcgtgtag

SEQ ID NO: 30290 - DNA, 3345 bp, Artificial Sequence
  Description of Artificial Sequence: Synthetic coding sequence
atggcttgccgccgaaggtactttgtcgagggcgaggccccaagctccgagaccgggacttccctggacagcccctctgcataccctcagggacccctggttccagggtcaagcctctccccggatcactacgagcacaccagcgtgggagcctatggtctgtattctgggcctccagggcagcagcagcgcacgagaagaccgaagctccagcattcaaccagtatcctcaggaagcaggcagaggaggaagcaatcaagcgcagtcgcagtttgagcgagtcttatgagctgtctagtgatctccaagataaacaagtggagatgctggagagaaaatacggaggacggctggtcacgcggcatgcagctcgcaccattcaaacagccttcagacagtatcaaatgaataagaatttcgaacgcctgcggagcagtatgtcagagaacaggatgagcagacggatagtcctgagtaatatgaggatgcagttctcttttgagggccctgaaaaggtgcactctagttatttcgaggggaaacaggtttccgtaacgaacgacggaagtcaattaggggctcttgtgtccccggagtgcggcgacctgtcagagcctacgacactaaaaagccccgctccaagcagcgatttcgctgatgccattaccgagcttgaggatgccttttcccgtcaagtgaagtcattggcagagtcaatcgatgacgctctgaattgtaggtcactgcacaccgaagaagcccctgccctggatgcggctcgggctagagacaccgaacctcagaccgctcttcacggaatggatcataggaaactcgatgagatgacagcgagctacagcgacgtcacactgtatattgacgaagaagagctgagccccccactgcccttgtcccaggctggggatcgaccatctagtacagaaagcgatctcagactaagggccggaggcgctgcacctgattactgggctctagctcacaaagaagacaaggcagacactgatacctcttgcaggagtaccccatcactggaaaggcaggagcagcgcctaagggttgagcacttgcccctgctgactattgagccgccaagcgactcttctgtggacctctccgatagatctgaaagaggcagcttgaaaagacaatctgcctacgagagatcactgggaggccagcagggcagtcctaagcacggccctcattcaggggctcctaagagtttgcccagagaagagcccgagttgaggccccgacccccaaggcccctggacagccatcttgccattaacggttccgccaatcgtcagtctaagagtgaatccgattattctgatggcgacaacgatagcattaacagtactagtaatagtaatgatacgattaactgttcctccgaaagtagttcgagagactctcttcgggagcagacgctgtctaaacagacgtatcacaaagaggcccgtaattcttgggattctcccgctttcagcaacgacgtaatcagaaaacgacactaccggatcggactgaacctcttcaataagaagcctgaaaaaggggtacagtatctcatcgaaagaggtttcgtacctgacaccccagttggtgttgcccactttctgctgcagcgcaaaggcctgagccgccaaatgatcggcgaattccttggcaatcggcagaagcaattcaacagggatgtgttggactgtgttgtcgatgaaatggacttttcgacgatggaactggacgaggccctgcggaaattccaggcccacatacgcgtgcaaggagaagcccagaaagtagagcgtctgatagaggcgttctcccagagatattgtatctgtaacccaggagtcgtccgccaatttcgcaaccctgatacaatcttcatcctcgctttcgctatcattctgctgaacaccgacatgtatagtccaaacgtaaagccagagcggaagatgaagttggaggatttcataaagaaccttcggggagttgatgacggtgaggacatccccagggaaatgcttatgggaatttacgaacgcataaggaagcgtgagctgaagactaatgaggatcatgtcagccaggtgcagaaagtagagaagctcatcgtgggcaagaaacccatcgggagccttcaccctgggctcggctgcgtgctcagtttgccccacaggcggctggtttgttactgtcgactttttgaggttcctgatcccaataaaccacagaaattagggctgcaccagagagagatatttctgtttaacgacttgctggtagtgacaaaaatcttccaaaaaaaaaaaaattctgtgacctatagcttccgacagtcattttccctttatggcatgcaggtgttgttgtttgaaaatcaatactaccctaacgggatccgcttaaccagctcagtgcctggggctgacattaaggtgttgatcaactttaatgcacctaatccccaggataggaagaagtttaccgacgatcttcgggaatctatcgcagaagtacaggaaatggaaaagcacaggattgagagtgagttagagaaacagaaaggagtagtacgtccatctatgagccagtgttctagtctgaagaaagagtccggcaacggaactttaagcagagcatgcctcgatgactcttatgcaagtggggaaggcttgaaacgctccgcattgtcatcttctctgcgggacttaagcgaggctgggaagagaggccgacgttcttccgcaggctccctggaatccaatgtggaaggctccattatctcttcccctcacatgagacgaagagccacctcaacccgagagtgccctagccgcccacatcagaccatgcccaactcgtcaagcctgctgggatcgctgtttggtagtaaaagaggtaagccaccccctcaggcgcatttgcctagcgctccggctctgcctccccctcacccaccagtagtcctgccacacttacaacattcggttgctggccaccatcttggcccaccagagggccttccgcaggcggctatgcatgggcaccacactcaatattgtcacatgcagaaccctcctccatatcaccatcaccaccaccatcaccccccacagcatattcaacatgcccatcagtaccatcacgggccacatggaggacacccggcatacggcgctcacgcacacgggcacccccctttaccttccgcccatgtgggccataccgtgcaccatcacggtcagcctcctgccccaccccctccaaccagtagcaaagcaaagccttcgggtatctcgacaatagtttag

SEQ ID NO: 30291 - DNA, 903 bp, Artificial Sequence
  Description of Artificial Sequence: Synthetic coding sequence
atggccgaagaggtgagtacgctgatgaaagccacggtgctgatgcggcagcccggaagagttcaggagattgtcggcgctctgagaaagggagggggagacaggctgcaggtcatttctgactttgatatgaccttgtctcgcttcgcttacaacgggaaaaggtgcccttcaagctacaacatcctggacaattctaaaattatcagtgaagagtgtcggaaggaactcacggcgctcctgcaccactactatccgatagaaattgatccccatcgaactgtcaaagagaagttgccccatatggtggaatggtggacaaaagcccacaacctgctgtgtcagcagaagatccaaaagtttcaaatagcgcaggtagtcagggaatctaatgctatgctccgggagggctataaaaccttcttcaacaccctgtatcacaataatatcccactgtttattttttctgccggaataggagacatattggaggagattatcaggcagatgaaagtctttcatccaaatatccatattgtgtctaattacatggattttaacgaggatggatttctgcaaggattcaaaggacagttgatccatacttacaataagaactcttccgcctgcgagaatagtggctactttcaacaactcgaagggaagaccaatgttattctgctgggcgactctattggtgacctgactatggctgacggtgtgccaggcgtacagaacatcttgaaaattggctttctcaatgacaaggtcgaggaaagacgggaacgatacatggactcctacgacattgtactcgaaaaggacgagaccctggacgtagtcaatggacttcttcagcacatcctctgccagggcgtgcagttagagatgcagggcccatag

SEQ ID NO: 30292 - DNA, 834 bp, Artificial Sequence
  Description of Artificial Sequence: Synthetic coding sequence
atgtttcccggtgccactacccccctgccaaaggccgcagcttatcccggtgtatatgggagcaatggccgaacgcctcagccagcctacctgtctgaagcgatgaaactgacacagagcgagcaggcccaccttagcttggaactccagcgcgattcgcacatgaaacagttactgttgattcaagaaaggtggaagcgcgctcagagggaggagcgcctaaaagcccaacagaataccgacaaggatgctgctgcacacctgcaaaccagtcataagccttccgcagaggacgctgaaggccaatctcctctgtcccagaagtacagcccgtcaacagaaaaatgtctgcctgaaattcaagggatctttgatagggacccggacaccctgctatacctgctgcagcagaagtcagagcctgctgagccttgtattggctccaaggctcccaaagacgataaaacaatcattgaggagcaggcaaccaaaatcgccgacttgaagcggcacgtcgaattcctagtggccgaaaacgaaagacttaggaaggagaacaagcagctgaaggcggagaaggctcgtctgttgaaggggccaatcgaaaaggagcttgatgttgatgcagattttgttgagactagtgaactttggtccctgcccccacacgccgagacagctactgcgtcgagcacctggcagaaatttgcagccaacaccggcaaagcgaaggacattcctataccgaacctgcctccgctggatttccctagtcccgaattgccactcatggaactctctgaggatattctcaagggcttcatgaataactag

SEQ ID NO: 30293 - DNA, 138 bp, Artificial Sequence
  Description of Artificial Sequence: Synthetic coding sequence
atgtccccacaaaagcgggtgaaaaacgtgcaggcccagaataggacctcacaaggtagctcaagctttcaaaccactctgtcggcctggaaggtgaaacaagatcccagcaatagcaaaaacatcagtaagcactag

SEQ ID NO: 30294 - DNA, 819 bp, Artificial Sequence
  Description of Artificial Sequence: Synthetic coding sequence
atgcctggagatcacaggagaattagaggaccagaggaaagccagccaccccagctctatgccgctgatgaggaagaagcgcctggaacacgtgatccaaccaggctccgccctgtatacgcaagggctggactgctgtcccaagcaaagggatctgcctaccttgaagctgggggaacaaaggtcttgtgcgcagtttccggtccacgacaggccgagggcggagagcgcggaggcggacctgccggtgcaggaggggaggctcccgcagcattgaggggtagactgctctgtgacttccgcagagcaccattcgcaggaagacggaggagggcgcctcctgggggatgcgaagaacgggaactggctctggccctccaggaagcgttagaaccagccgtccggttagggagataccctcgagcccagctggaggtctccgcgcttctgctcgaggacggcggatctgcgctggccgctgcactgacggccgcagccttagcgctcgccgacgctggcgtggagatgtacgatttagtggttggatgtggtctaagtttagcccctggccctgcccctacttggctgctagacccaacccgacttgaggaggaacgggctgctgccggtttgacggtggcactcatgcctgtgctcaatcaagtggccggactcctcggctcaggtgagggtggcctgactgaatcttgggctgaagccgtgcggctgggccttgagggatgccagcggctgtatcccgtcctccagcagagcctggtcagggccgctcgacggcgtggggcagccgctcagccatag

SEQ ID NO: 30295 - DNA, 429 bp, Artificial Sequence
  Description of Artificial Sequence: Synthetic coding sequence
atggcaagtggcaacgcgaggattggaaaacccgcacctgattttaaggccactgctgtggtggatggagcgttcaaggaggtgaagttgtccgactataagggtaaatatgtggtgctgtttttttatcctcttgacttcaccttcgtctgccctacagaaatcatagcattcagcaaccgagcggaagattttagaaagctaggctgcgaagtgctcggagtatctgtggattcacagtttacgcacctggcttggtacgaacagggccctaaacgtgaggtggctgctaaactgacaccatcaggccctagctctgttgcctcatggcctctgctcaatttatggaacctgcgctttcctattgttaagattatggagacgctgccacccaaatcactgaggatgatgaccgtaatttcaatttag

SEQ ID NO: 30296 - DNA, 1137 bp, Artificial Sequence
  Description of Artificial Sequence: Synthetic coding sequence
atggaagttaagccccctccagggcgacctcaaccagactccggccgtcgcaggcggagacgtggtgaggaaggacatgatcctaaagagcccgaacaactgcgaaagctcttcatcggaggactctcttttgagactaccgatgacagcctcagggaacatttcgagaagtgggggaccctgacggattgtgtcgtgatgcgtgacccccaaacaaagagatcgagaggtttcggtttcgtgacctactcctgtgtggaggaagtggatgctgcaatgtgtgccagaccccataaggtagacggcagagttgtagaacccaagcgagctgtgtccagggaggattcagtcaagcccggtgcccacctcactgtaaagaaaatttttgtcggagggatcaaagaggacacagaagagtataacttgcgtgattactttgaaaagtacggcaaaatagaaacgattgaggtgatggaagacagacagtctggcaagaagcggggattcgcatttgtgacctttgatgaccacgacacggtagacaagatagtcgtgcagaaataccacacaataaatggccacaactgcgaagttaagaaagccttgtccaagcaggagatgcagagcgccggatcacagcggggaaggggagggggatctggaaactttatgggtagaggtggcaattttggaggaggagggggaaacttcgggagaggtggcaatttcgggggaagggggggttacggcggtgggggaggcggaagcagaggatcgtacggaggcggagacggaggttacaatggcttcggcggtgatggcggaaattatggcggaggccctggctattcctcaagggggggatacggcggaggcggaccaggctatggcaaccagggcggaggctatggcggtggcggtgggtatgatggctataacgaaggcggaaatttcggtggtggaaactacggtgggggaggaaattacaacgatttcgggaattattccggccagcagcaatctaattacggccctatgaagggcggatcctttgggggacgaagctccggatcgccttacgggggaggctacggcagcggcggaggatccggaggatatggaagccgcagattttag

SEQ ID NO: 30297 - DNA, 324 bp, Artificial Sequence
  Description of Artificial Sequence: Synthetic coding sequence
taaatccacgagcagtgggaaaaagccaacgtgagtagcccccaccgcgaattccccccagccacagcaagagaggtggacccactgaggatccccccacaccaccctcacacttctagacagcctccatggcccaggaggggtggcatgattgtagatccattacggagtggatttccgagagcactgatcgatcctagcagtggactgccaaatcgcctgccacctggcgcagtgcctccaggcgctcgctttgaccctttcggccctattgggaccagcccgccaggcccaaacccagaccacctgcctccgcctggttag

SEQ ID NO: 30298 - DNA, 201 bp, Artificial Sequence
  Description of Artificial Sequence: Synthetic coding sequence
atggctgcggctaccggcgaccctggtctaagtaagctacaattcgcaccattctcaagtgctctcgacgtcggcttttggcatgaacttactcagaaaaagctgaacgaataccggctcgatgaggctcccaaggacattaagggatactactataatggagatagtgctggattgcccgcaaggctgaccttagagtag

SEQ ID NO: 30299 - DNA, 2115 bp, Artificial Sequence
  Description of Artificial Sequence: Synthetic coding sequence
atgctgcccacagcaagcagtaagcgaagaacattcgccgcacgttacttcactcgctccaaatctctagtgatgggggaacagtcacgtagtcccggacgaatgccctgtccccacagactgggaccagttcttaaggcaggttggttgaaaaagcaaagaagcatcatgaagaactggcagcagcgctggtttgtcttgaggggcgaccagttgttctattacaaagacaaagatgagattaagcctcagggtttcattagcttacagggaacacaagtgacagaattgccacctggaccggaagaccccggaaaacaccttttcgaaatcagtcctggcggagcaggcgaaagagagaaagtgccagctaatcctgaagctctgttgctgatggcctcttcccagcgcgatatggaagactgggtgcaggccatacgaagggtcatttgggcacctctcggtggcggtatcttcggccaacggctcgaggagaccgtgcatcacgaacgaaagtatggtcctaggctcgcgccactgttggttgagcagtgtgtggattttataagagaaagaggcctaaccgaagaagggctgtttaggatgcctggtcaggctaatctggtcagggacttgcaggatagttttgactgtggagagaaacccctgtttgactcaactaccgatgtccacactgtcgcaagtttattaaagctgtatctgagggaattgccagaacctgtggtgccatttgcccgttatgaggactttctgtcgtgcgcgcagttgttgaccaaagatgagggggagggcaccctggagctggctaaacaggtctcaaatctaccccaggccaattataatttgctgaggtatatctgtaaatttttagacgaggtgcaggcttacagtaacgttaacaagatgtccgtgcagaatttggccaccgtgttcgggcctaatattctaagacctcaagtggaagatccagtaactattatggaagggacttctcttgtgcagcacctcatgacggtactcattaggaaacacagtcagctgttcactgcccctgttcccgagggtcctacttcgccaagaggcggtttacagtgtgctgtgggttggggttccgaagaagtcacacgggacagtcagggcgagcccggtggcccagggctccctgcacataggaccagctctctggacggcgctgccgtggcagtcctgtctagaacagcccctactggaccgggaagccgttgttctcccggtaaaaaggtgcagaccctgcctagttggaagtcatcatttcgccagcccagatctctcagcggaagccccaaaggcggtggtagttctttggaggtgcctattatttccagcggtggtaactggctgatgaacggattgtctagccttcggggtcacaggcgggctagctcaggcgacagactaaaagactcaggcagcgtgcagcggctgtccacatatgataacgtgccagcccctggactggtgcctggtattccatctgtcgccagtatggcctggtccggggcaagctcctctgagtcgtcggtcggcggaagcctgtcaagctgtacagcgtgtagagcaagcgactcatcggctcggtcgtccctgcataccgactgggccttggaaccctctccccttccaagttcaagtgaagatcccaagagtttggatctggatcattccatggatgaggcaggtgctggggcttcgaacagtgaaccttcagagcccgacagccccacaagagagcatgcaagacgttcggaagctttacaagggctggtgacagagcttagggcagaactgtgtcgacagcggacagagtacgaacgatctgtcaaacggatcgaggaaggcagtgcagatctgcgcaaaaggatgtctagattggaggaggagctcgatcaggagaagaagaaatacattatgcttgagatcaagctgcggaattctgagcgcgcaagagaggatgcggagcgaagaaaccagttgttgcaaagggagatggaagaattcttctctacacttggatctcttactgtcggcgctaaaggcgcaagggccccaaagtag

SEQ ID NO: 30300 - DNA, 630 bp, Artificial Sequence
  Description of Artificial Sequence: Synthetic coding sequence
atgatctccaactacagaaatgggtcagaactggtttgtttcaactctggggtcggatgctttctgattggttgcgattgggccttcaccgttcttgtaaatacctttttttcctttttgcgcagaaaaacggactttttcatcggcggtgaggaaggaatggcagagaagctgatcacccaaaccttctcccaccataatcagttagcccagaaaacaaggcgagagaagagggcgaggcaggaggctgaacggagagaaaaagcagaacgggctgccaggttagccaaggaagccaaaagcgagacttcgggcccacagattaaggagttgacagatgaagaagcagaacgcctgcagctagagatcgatcagaaaaaggacgccgagaaccacgaagcccagttgaagaacgggtcacttgactcgccgggtaaacaagatacggaagaggatgaggaggaagacgagaaggacaagggcaagctgaagcccaatctcggcaacggagccgatctgcccaactacaggtggactcagactctgagcgagctggatctggccgtgcccttctgcgtgaacttcaggctcaaaggaaaggatatggtcgtagacattcagagacgctag

SEQ ID NO: 30301 - DNA, 309 bp, Artificial Sequence
  Description of Artificial Sequence: Synthetic coding sequence
atgaacgaggctgagatcgtggatgtagccctagggattctcatcgaaagtaggaaacaagagaaggcttgtgaacagcctgccctggctggcgctgacaaccctgaacacagtcccccatgctcggtatcccctcatacctcatcaggttcaagctctgaagaggaagattccggcaagcaggctcttgctccgggtctgtcaccttctcaacggcctgggggatcaagtagcgcctgttccagatccccagaagaggaggaggaggaagatgtacttaagtatgttcgagagatcttcttctcctag

SEQ ID NO: 30302 - DNA, 273 bp, Artificial Sequence
  Description of Artificial Sequence: Synthetic coding sequence
atggccatggccccatctcccagtttggtgcaggtgtatacttctccagcggctgtcgccgtgtgggagtggcaggacggactcggcacctggcacccatactcagcgaccgtctgctcgttcatagagcagcaatttgtacaacagaagggccagaggtttgggctgggttcattggcacacagcattccgctcggccaggcagatccgtctttggccccttatatcatagacctgccaagctggacccagttcaggcaggatactgggtag

SEQ ID NO: 30303 - DNA, 207 bp, Artificial Sequence
  Description of Artificial Sequence: Synthetic coding sequence
atggacgcaaactctaaagataagcccccagagactaaggagtcggccatgaataacgctggaaacgcaagctttattttaggcacaggaaagatcgtcacaccccaaaaacacgctgagctgcctcccaacccctgcacgcccgacacattcaagtcacccctgaatttcagcacagtgaccgtcgagcagctggggattaactag

SEQ ID NO: 30304 - DNA, 879 bp, Artificial Sequence
  Description of Artificial Sequence: Synthetic coding sequence
atggatggctcgtttgtgcagcactccgtccgggtgcttcaggaattgaacaaacagcgagaaaagggtcagtactgcgatgccacgctggatgtgggagggttggtgttcaaagcccattggagcgtgctggcctgctgctctcatttctttcagtctctgtacggggatggatctgggggtagcgtggtgctgcctgctggttttgccgaaatattcgggttactcctagatttcttttatacaggtcacctggccttgacgtccggaaatcgggaccaagtgcttctcgccgctcgagaactgagagtgcctgaggcagtcgagctatgccaatctttcaaaccaaagacttctgtcggtcaagccgcaggcggacagtcaggcctcgggcctccagcttcacaaaacgtgaattctcacgtaaaggagcccgcaggtcttgaggaagaagaggttagcaggacccttggactcgtgcccagggatcaagagcctagaggatcacattcgccccagagacctcagctgcattcccccgctcagagcgaagggccatcttctttgtgcggcaagctcaaacaggcgctgaagccctgtcctctggaggataagaagcctgaagattgtaaagtcccaccacgtcccctagaggcggagggcgctcagctgcaggggggttccaatgagtgggaggttgtggtgcaagtggaggacgacggcgatggggactatatgagcgaaccagaggccgtcctaacaagacgaaaatccaatgtgatcagaaagccttgtgcagccgaaccggctctttctgccggtagtcttgccgcagaacctgcggagaatagaaaagggaccgcggttccagtggaatag

SEQ ID NO: 30305 - DNA, 408 bp, Artificial Sequence
  Description of Artificial Sequence: Synthetic coding sequence
atggcagccttgcgtccactggtgaaacccaaaatcgttaagaaacgaacgaagaagttcatcaggcaccagtctgatcgatatgtgaagatcaagcggaattggcgaaaaccacggggaatcgataatcgggtcaggcggagatttaagggtcaaattctgatgccaaatattggctatggaagcaacaaaaaaacgaagcacatgctgccatccggcttcagaaaattcctcgtgcacaacgtcaaagagttggaggtgctgcttatgtgtaataaatcctactgcgccgaaatagctcataatgtgagttctaagaatcgcaaggctatcgttgaacgggcagcccagctagccattcgtgtgacaaatcctaacgctcgactgagaagtgaagagaatgagtag

SEQ ID NO: 30306 - DNA, 810 bp, Artificial Sequence
  Description of Artificial Sequence: Synthetic coding sequence
atgaaaacacctgtcgagttagccgttagcggcatgcagacactcggcctgcagcaccgctgcaggggcggataccgcgtgaaagccaggacttcttacgtggacgagacactgtttggtagccctgcagggacgagacccacaccaccagacttcgacccgccatgggttgagaaggccaacagaacccgaggagtcggtaaagaggcgagcaaggccttgggcgcaaaggggtcctgcgagacaacaccgagtcggggtagcacccctaccctgacaccaaggaagaaaaataaatacagacctatttcacatactccaagttactgtgacgaaagtctgttcggcagccggtctgagggagcttcattcggcgctccacgaatggctaaaggcgatgccgcaaaactccgggcactcctgtggactccgcctcctaccccccgtggctctcattccccgcgaccacgggaagcaccattgcgcgcaatccatccggcaggtccaagcaaaacagaaccgggaccggctgccgactcccagaagctttctatgggtggactgcacagcagtcggccactcaagcgtggcctctcgcattcactcacccatctaaacgtgccttctactgggcaccccgctacctccgcgccacacactaacggccctcaggatctccgaccctccactagcggggttacgtttagatctccgctggtgacctctcgggcacggtcggtgtcgatctcggtgccatctacccccaggcggggtggagccacccaaaagcctaaacctccctggaagtag

SEQ ID NO: 30307 - DNA, 840 bp, Artificial Sequence
  Description of Artificial Sequence: Synthetic coding sequence
atggtggaccatctggccaataccgagataaacagtcagagaatcgctgcagtcgagagctgtttcggcgctagcggtcaaccactggccttgccaggccgagttcttctgggcgaaggagtccttacgaaggaatgtcgcaagaaagccaaacctaggatcttctttctgttcaatgacattttggtatacggaagcatcgttctgaataaacgtaagtacaggtctcagcacattattcccctggaggaagttacgcttgagctgctgcccgagaccttgcaggccaagaataggtggatgattaagaccgccaagaagagcttcgtggttagtgcagcaagcgccaccgagcgacaggagtggatatctcacatcgaagagtgtgtaaggcggcagcttagggccaccggcagaccaccttcaacagaacacgccgctccttggatccctgataaggcgactgatatctgtatgcgttgtacccagactcgctttagtgccctgacacggaggcaccattgtcgcaagtgtgggttcgtcgtgtgcgccgagtgctcacgtcaaagattcctgctcccaagattgagtccaaaacccgttagagtttgctctctgtgctaccgcgagttggctgcccagcagaggcaagaggaggccgaagaacagggagccggttctccagggcagcccgctcatctcgctaggccaatttgcggagcctcctctggagatgacgacgactctgacgaagataaagagggttctcgggacggcgattggccatcgtctgtggaattctatgcctctggagtggcatggtcggcctttcattcctag

SEQ ID NO: 30308 - DNA, 279 bp, Artificial Sequence
  Description of Artificial Sequence: Synthetic coding sequence
taacggtccagcacttcgccctgtgggacctctaaaagcccgaacagagagtgggagggaaagtcagtggcctatatgccttacgctgaggtgaaacgggcactggaacaagaagcacagatgcacaacaccgccgctcgttcagcatccccatgcagactttcaccacgcgaggtatccaaggctgcccctcagccagatatgagcgccgctcggtacagcgtgcctcctgtgctacagcctgcaccacaccaggtgatcactaatcttcccgaatag

SEQ ID NO: 30309 - DNA, 771 bp, Artificial Sequence
  Description of Artificial Sequence: Synthetic coding sequence
atgagcaacaatctctccgaactcgatacgaagatacaggaaaaggctatgaaggtcgacatggacatctgtcggaggatcgatataactgccaaactatgtgatgttgcccaacaacgcaactgtgaggacatgattcaaatgttccagaaaaaactagtaccctctatggggggacggaaaagggaacggaaggcggctgtcgaggaggacacaagcttgtctgaatcagaaggcccaaggcagccagacggcgatgaagaagagagtactgcgttatctattaatgaggagatgcagaggatgctcaaccagctcagggaatatgacttcgaagatgactgtgatagcctgacctgggaggaaactgaggagacccttctcctgtgggaggactttagtggctatgccatggccgctgcagaggctcaaggtgaacaacaagaggattcattagagaaggttatcaaggataccgagtcactgtttaaaacaagagaaaaggaataccaggagactatcgatcaaatcgaactagagcttgccaccgctaaaaatgacatgaataggcacctgcacgaatacatggagatgtgtagcatgaagagggggctggacgtccaaatggaaacctgcagacggctcattacacagagcggggaccgcaagtcccccgcattcaccgcggtgccattaagcgatccccctcctcctccctccgaagcagaggactccgacagggacgtgtcttccgactcaagcatgcgctag

SEQ ID NO: 30310 - DNA, 1620 bp, Artificial Sequence
  Description of Artificial Sequence: Synthetic coding sequence
atggccacatctgcgccactgagaagccttgaggaggaggtgacatgctcaatttgcctcgactacttgcgcgatcctgttaccatcgactgtggtcatgtgttttgccgcagttgtaccaccgatgtgagacccattagcggcagccgcccagtctgtccactgtgtaagaagccatttaaaaaggagaatatccgacccgtgtggcagttggcaagtcttgttgaaaacattgagagacttaaagtcgataagggtcgtcagccaggggaggtgaccagggagcagcaagatgccaaactctgcgaacgccatcgagagaagttgcactattactgtgaagatgacggtaagttgctgtgtgttatgtgtagggagtcccgcgaacaccgacctcacacagcagtacttatggaaaaagcagcacaaccacaccgggagaaaatcctcaatcaccttagtactcttcgcagagatcgggacaaaatccagggattccaggctaagggggaggctgatatactggcagctctcaagaaacttcaggatcagagacagtacatcgtagcagaatttgagcagggccaccagtttctgcgggagagagaagagcacttgttagagcaactggcgaaactggagcaggaactcacagaaggacgcgaaaaattcaaatcccgcggtgtaggggaattggccaggctcgcactggttattagcgagctggaaggaaaagctcagcaaccagctgccgaactgatgcaggacacacgcgatttccttaacaggtatcccagaaaaaaattttgggtgggcaagccgattgcgagagtcgtcaagaaaaagacgggggaattttccgataagcttctttctctgcagaggggtctgcgagaatttcagggaaaactgttgagagatctcgagtataagaccgtatcggtcactctcgaccctcagtctgccagtgggtatctgcagctgtccgaagattggaaatgcgtaacttatacaagcctctacaaaagtgcttacctgcacccacaacagtttgactgcgaacctggagtactcggcagcaaaggcttcacttggggcaaggtgtactgggaagtggaggttgagagggaaggctggagcgaggacgaagaagaaggcgatgaagaggaagagggcgaggaggaagaggaagaggaggaggcaggctacggagatgggtacgatgattgggaaaccgacgaagatgaggaatccctgggagacgaagaggaggaagaagaagaggaggaggaggaagtattagagagctgtatggtgggcgtcgcgcgagactctgtgaagcggaagggagatctcagtctgcgacccgaagacggggtgtgggccctgcggctatctagcagcggcatatgggcgaatactagcccggaggcagagctttttcctgctttgcgcccacggcgagtgggaatcgccctggattacgagggtgggaccgtcactttcacgaatgctgagtctcaagaactgatttataccttcactgcaacattcacgcgtcgactggttcctttcttgtggttgaagtggcctggtaccaggcttcttctgaggccatag

SEQ ID NO: 30311 - DNA, 750 bp, Artificial Sequence
  Description of Artificial Sequence: Synthetic coding sequence
atggcctttatgaccagaaaactttgggatctagagcagcaagttaaggcacagacagatgagatcctttcaaaggatcaaaagatcgctgccctcgaggacctggtgcagactctccggccacatcccgctgaggccacactgcagagacaagaggagctggagacaatgtgcgtacagcttcaacgccaagtgcgcgaaatggagaggttcctaagcgattatggcctccagtgggtcggtgaaccaatggatcaggaggacagtgagtctaagacagtcagtgagcatggtgagcgtgattggatgactgcaaagaaattctggaagcccggtgattcactggcaccgccagaggtggattttgaccggttgctcgctagcctgcaggacctctcagagctggtcgttgagggagacactcaggtcaccccagtgcccggaggcgcacgtctccgcaccctggagcctatccccctgaagttataccggaatggcattatgatgtttgacggtccctttcagccattttacgacccatccacccagaggtgcttgagagatatactggacggtttcttccctagcgaacttcaacggttgtatccaaacggcgtgcccttcaaggtgataagctgctcaagtaatcatactttcggagactttgagggaagtggagatacccaaccgcctcagacaccacctattctgaggggtagccggtgtacaccatgggggacacccgtctag

SEQ ID NO: 30312 - DNA, 2763 bp, Artificial Sequence
  Description of Artificial Sequence: Synthetic coding sequence
atgagtgaggactcggagaaggaagactatagtgatcgcacgatttctgatgaggacgagagcgacgaagatatgtttatgaagttcgtttcagaggacctgcaccgctgtgcgctcttaacagcagattccttcggagacccattttttccccgtaccacccagatcctcctcgaataccagctgggacggtgggtgcccagactacgcgagccaagagacctttatggtgtgagttcctctgggcctttgagccccacccggtggccctatcactgtgaagtgatagacgagaaggtgcagcatatcgattggacaccaagttgccctgagcctgtgtacattccaaccggtctcgaaactgagcccctctaccctgattctaaagaggcaacagtggtttatctcgccgaagatgcatacaaagagccatgcttcgtgtacagcagggtgggcggtaataggaccccattgaaacagccggttgattatagagacaacactcttatgtttgaggccaggttcgaatccggaaatctccagaaagtcgtgaaagttgccgagtacgaatatcaactgaccgtgcgccctgacctctttaccaacaaacacacacagtggtactatttccaggtcacgaatatgcgtgctgggatcgtctatcgatttacaattgtgaactttacgaaacccgcttcactctattcccgagggatgcggcctttgttttattcagagaaagaagccaaagctcaccatattggctggcagaggataggcgatcagattaaatattaccggaacaatcctggacaggatgggcgacactatttttcccttacctggacgttccagtttccacataataaggacacgtgctactttgcccattgttacccgtacacgtataccaatctccaggagtatctgtcaggaatcaacaatgatccggttcggagcaagttctgcaaaataagggtcctatgtcacacactggccagaaatatggtgtacattctgacgatcacaacacctcttaagaactcagatagccgtaagaggaaagcagtgatcctcactgctcgcgtccaccccggagaaacaaactccagctggatcatgaaaggctttctcgattatatcctagggaactcatccgatgcccaattactgcgggacacatttgtgttcaaagttgtgccaatgctgaatccagatggcgtcatcgttgggaactatagatgttctctcgctggacgggatttgaatcggaattacacatcactcctgaaagagtccttccccagtgtgtggtatacccgcaatatggttcatagactcatggagaaaagagaggtgatcctgtattgcgacctgcacggacactcccgcaaggagaacatcttcatgtacggttgtgacggaagcgaccggtccaaaaccctctatctgcagcagaggattttccctctgatgttgagcaagaattgtcccgacaaattctccttttctgcatgcaaatttaatgtgcagaagagtaaagaggggaccggaagagtggtgatgtggaagatgggaatcaggaattctttcacaatggaagccacgttctgtggatccacactggggaacaaaagagggacccacttttcaacaaaggatttggaaagtatgggataccatttctgcgattccctcttagattattgcgaccctgaccggacaaaatactaccgctgtctgaaagagctcgaggaaatggagcgacatatcacattggaaaaagtttttgaggactctgatacacccgtaatcgacatcacacttgacgtggaatctagctctcgaggatcggactcctccgagagtatcgacagtctaacctatctcctcaagctaacctcccagaaaaagcatctgaagacaaagaaagagcgtaattccaccattgcatcccatcagaacgcgaggggccaagaggtgtatgaccggggacatctgctgcaacggcacacccagagtaattctgacgtgaaagacacaaggcctaacgaacccgacgattatatggttgactattttcggaggcaacttcccaaccagggtctagatctccaccataatcttaagagtaagatcaaagagtgcatctcattccaatccaaaaaaacaggaatcaactggacagacgatgaaaagagaagttataaagataaaggcatcgttcagactcaagagatactccagtacctgttgccgatcgtacattccacaaagaacatgcagaccacccagattaaacaactattcaacccaagaacgaacttccagatccagcatcagctgaatcccgctacatgccggaacattaaaaaatattcaacttcctggacagctcccagaaaccatccatttgtgatacagggcgacgttatggctaatagctcagaatgggtccagtcgaaaccgcacagaagcctggagtctttgtccccattgaaggggcctaaaaagaataagcactctcagatctgggccatcaagaatgaggatatcaagccactcagttccaagtgggaaaccgcttctagttccttcggcatggacgctaacgtgctgaaatacaagtccctccaagctgaagaaacgaatcagcagtctagcaaacacacagcactgcacctgactaagaataaggacgagcaggccaataagaatgacggccagcctactttgtatctgaaatttcagcgggaaagctag

SEQ ID NO: 30313 - DNA, 858 bp, Artificial Sequence
  Description of Artificial Sequence: Synthetic coding sequence
atgacaaacgctcagataattctgctgatcgacaacgcacgcatggcagtcgacgactttaaccttaagtacgagaacgagcatagctttaaaaaggatctggagatcgaagttgaagggctccgcagaacactggacaacctgacaatcgtgaccacggacctagagcaggaagtggaaggcatgcgaaaagagctgatcctgatgaagaagcaccatgaacaggaaatggagaagcaccatgtcccaagtgattttaacgtgaacgtcaaagtggatactggtcctcgcgaagatctgatcaaagtgctggaggacatgcggcaggagtatgaactcataattaaaaaaaagcatcgggacctggacacatggtacaaggagcagtccgctgctatgtctcaagaggccgcttcaccagcaaccgtgcagtctagacagggcgacatccatgagctgaaacggacttttcaggctttggaaatcgatctccaaacacagtacagtactaagtctgccctagaaaacatgctgagcgagacccagagtagatattcatgcaaactgcaagatatgcaggaaataatcagccactacgaagaagaactgacccagctgcgtcacgagcttgaacgccaaaacaacgagtaccaagtattacttggaatcaagacccacctggaaaaagaaatcaccacttacaggaggcttctcgaaggggaatccgagggtactcgggaggaaagcaaatcctcgatgaaggtctcagccacccctaaaatcaaagctataacccaagaaaccatcaatggaagactggtcctttgccaagtcaatgaaatccagaagcacgcctag

SEQ ID NO: 30314 - DNA, 2013 bp, Artificial Sequence
  Description of Artificial Sequence: Synthetic coding sequence
atgtctccatgcagcgggggtagaggcgagctgcgggctgcctgcctgcaacctgaggtgcctggggctcctggactgtcctggtggccatccaccgctggtcttcgccagagtcagacagacttacagctgagcctgagcatctggtgtggtaaaaaaatggggtcgtatctgagcgtcccagcctatttcaccagtcgggatctgtttagatgctccgaatgtcaggacagtctgaccaattggtactatgaaaaagatggtaaactgtattgtccaaaggactattgggggaaatttggcgaattctgtcatggttgttctctattgatgacgggtcctttcatggtcgctggcgaatttaaatatcatccagaatgtttcgcctgcatgagctgcaaggtcatcatcgaggacggggatgcctatgctctcgtgcaacacgcgactctctactgtggcaagtgtcataatgaagtggttctagcccctatgttcgagaggctttccaccgaaagtgtgcaggagcagcttccctattcagttactctcatctccatgcccgcaactacggagggacggagaggattttcagtgtcggtagagtcagcttgtagtaattatgcaaccaccgtgcaggtgaaggaggtgaacaggatgcacatttcccccaataaccgaaacgctattcaccccggagatcgtattctcgaaatcaatggtactccagtaaggacgctccgggttgaagaagtagaggacgcaattagtcagacctctcagacactacagcttctgatcgagcacgatcctgtgtcccagaggctggaccaactcaggctggaagccaggctagctccccatatgcagaacgcgggtcatcctcacgcgttgtccaccctggacacaaaagagaacctggaaggcactttgaggcggaggagcctccgccgttcaaatagcatctccaaatctcctggtccttcaagtccaaaggaacctcttctcttttcacgcgatataagtcggtccgaaagcttgagatgcagctcgtcctactcccagcagatcttcagaccctgtgacctgatccacggggaggttctcggaaaaggtttctttgggcaggccatcaaggtgactcataaggcgacagggaaggtcatggtgatgaaggagctcatccgctgcgacgaggaaacacagaagacttttctgaccgaggtgaaggtgatgcgcagcctagatcacccaaatgtgctgaagtttattggcgtcttatataaagataagaagctgaatctcctgactgaatatatcgaaggtgggacactaaaagattttctcagatccatggaccccttcccctggcagcaaaaagtccgctttgctaaaggcattgcctcaggtatggcttacctgcactctatgtgcataattcacagagacctgaattcccacaactgcctgatcaaactggataagaccgtggtggttgccgatttcggtctgtcaagattgattgttgaggagcgcaagcgagcaccaatggagaaggccacgacgaaaaagagaaccttaagaaaaaacgatcgtaagaagagatacaccgtcgtcggcaatccatactggatggcccctgagatgctgaatggcaagagctacgacgagaccgtcgacatcttttcttttggcatcgtactctgcgagataatcggtcaagtctacgctgaccccgactgcttaccgaggacgctcgacttcgggctgaacgtaaagctcttttgggaaaagtttgttcccacagactgcccccctgccttctttcctctggctgccatctgctgcagactggaaccggagagcaggcctgccttcagtaaattagaggattcttttgaagccctgagtctctacctgggcgagctgggaattccgttgccagctgagctcgaggagttagatcataccgtgtcaatgcagtatggcctaaccagggacagccccccatag

SEQ ID NO: 30315 - DNA, 459 bp, Artificial Sequence
  Description of Artificial Sequence: Synthetic coding sequence
atggcgcacttgaggggcttcgccaaccagcattctcgcgttgaccccgaagagctgttcaccaagctcgaccgcattggcaagggatccttcggggaagtttataaaggcattgacaaccacacaaaggaggttgtcgctattaagataatcgacttggaggaggcagaagatgaaatcgaggatatccagcaggaaatcacggtgttatctcaatgtgatagcccatacatcactaggtacttcgggagctacctcaaatctaccaagctatggatcataatggagtacttgggaggaggttcggcgttagatctgttgaagcccggacctcttgaagagacctacatcgccactattctgcgagagatcctgaaaggccttgattatttacatagtgagagaaaaatacaccgcgatattaaggctgccaacgttcttctgagtgagcaggggtag

SEQ ID NO: 30316 - DNA, 1365 bp, Artificial Sequence
  Description of Artificial Sequence: Synthetic coding sequence
atggcaccctgccgggctcgtacgggtccctccacttggcgtagtgctactagtagcacgcgacgcaggaaaggggctagaaggcatctgtctgcgctgcaggtcctggagacctgcgtgaaaaattgtggccatagatttcatgtccttgtggccagtcaggacttcgttgagtccgtgctcgtccggacaatcctgccaaagaacaatcctccaacgattgtgcacgacaaagtgttgaacctcattcagagctgggctgacgcttttaggagttctccagatctgaccggggtcgttactatctacgaagacctgagacgcaaaggccttgagtttcccatgaccgatcttgatatgctaagtcccattcatacccctcagcgaaccgtctttaacagcgaaactcagagcggccaggacagtgtgggtaccgattcttcacaacaagaggattcaggacagcatgccgcacccctgcctgccccaccaatcctgtccggcgacacgccgatcgcccctacccccgagcagatcggcaagctgaggtccgagctagaaatggtgtccggaaacgtacgcgttatgagtgagatgttgactgagttggtgccaacgcaagccgagcctgccgacttggagttattacaggagctgaataggacttgccgtgccatgcagcagcgggttcttgagctgataccacagatagccaacgaacagctgacggaagaactcttaatcgtaaacgataacctgaacaatgtctttttgagacatgagcggtttgagcgctttaggaccggacagacaaccaaggctccgagtgaagcagaaccagccgcagatttgatcgatatggggcctgacccggcagcaactggtaacctttcaagtcagctggccggaatgaatctagggtcaagctctgtacgggcaggactgcaaagtttagaggcatctggtcggctggaggacgaatttgatatgtttgctctgacaaggggatcaagtctggctgatcagagaaaggaggtgaagtatgaagcacctcaggctacagatggtttagccggagcactagacgccaggcagcagtcaaccggagccatcccagtcacacaggcttgcctgatggaagatattgaacagtggttatcaacagacgtcggaaacgacgccgaagagccaaaaggagtcacctctgaagagtttgacaagttcctggaagagagagcaaaagccgctgacagactgcctaatctgagctctccgtcagccgaagggccacccggtccaccatccggtcctgctcccaggaaaaaaactcaagagaaggatgacgatatgctcttcgcactgtag

SEQ ID NO: 30317 - DNA, 378 bp, Artificial Sequence
  Description of Artificial Sequence: Synthetic coding sequence
atgcagaccagcagtagccggtcagtgcacttgtcagaatggcaaaagaactactttgcgatcacctcaggcatctgcacaggtccaaaagccgacgcctatcgtgcgcagatactgaggatccagtacgcttgggccaacagcgagatttctcaggtatgcgcaacaaagctattcaagaaatacgcagaaaaatattccgcaatcatcgactcggataacgtggagtccggcctaaacaattacgctgagaatatactgaccctcgcaggatcccagcagaccgatagcgacaaatggcagagcggactaagcatcaacaacgtgttcaaaatgtcctctgtgcagaaaatgatgcaagcgggtaagaagttctag

SEQ ID NO: 30318 - DNA, 30 bp, Artificial Sequence
  Description of Artificial Sequence: Synthetic coding sequence
atgtctcaccttcagagcttgcttctgtag

SEQ ID NO: 30319 - DNA, 270 bp, Artificial Sequence
  Description of Artificial Sequence: Synthetic coding sequence
atgtccgagcagggggacctgaatcaagccattgccgaggagggaggaaccgagcaggagacagcgacaccagagaacggaatagtgaagtccgaatctctggatgaagaagagaaactcgagctccagcggcgactggaggcacagaaccaggagcgacgaaaatcaaagagcggagcaggcaaaggaaagctcacacgctccttggccgtttgtgaggagagctccgcccgacctgggggagagtctctccaggaccagaccctgtag

SEQ ID NO: 30320 - DNA, 3732 bp, Artificial Sequence
  Description of Artificial Sequence: Synthetic coding sequence
atgctaattaaggagtatcacattttgttgcctatgagtcttgatgaataccaggtcgcccagctgtacatgatccagaaaaaaagccgagaggagagcagtggcgaaggatcgggcgtagagatcctggcgaatcggccatatacagatggtcctgggggaagtggccagtatacccataaggtctaccatgtcggaagccacattcctggctggttccgggcactgcttcccaaggcagccttacaggtggaggaggagagttggaatgcatatccctacactcggactcgctatacatgcccttttgtcgaaaaattctctatcgaaatcgagacttactaccttcctgatggcggtcagcagccaaacgtttttaaccttagcggagccgagcggaggcagagaattttggacaccattgacatagtcagagacgcggtcgccccaggcgagtacaaggctgaggaagatccacgcctctaccacagtgtgaagacaggtcgcggaccactgtcggacgattgggcaagaacagccgctcagaccgggcctttaatgtgtgcttacaaactgtgcaaagtagaatttcggtattggggcatgcaggcgaaaatcgagcaattcatccacgatgtaggtctccgacgggtaatgttgcgggcacatcgccaggcttggtgctggcaggatgagtggaccgagttatcaatggcagatatcagggccttggaagaagagaccgcccgtatgctggcgcaacggatggccaaatgtaataccgggtcagagggcagcgaggcccagcccccaggtaagccttctactgaagctagaagtgccgcttctaacactggaacaccagatgggccagaagcacctcctgggcctgacgcttcccctgatgctagtttcggtaaacagtggtccagctcttccaggagctcctacagctcccagcacggcggtgctgtgagcccccagagcttgagcgagtggcgtatgcaaaacatcgccagggattcggagaattcctcagaggaagagttcttcgacgcacacgaggggttttctgattctgaggaagtgtttcctaaagagatgactaagtggaacagcaatgacttcatagacgcctttgcatccccggtagaagccgagggcacaccagagcctggggctgaggccgctaaaggcatcgaagacggcgcacaggcccctcgagactcagagggattggacggtgccggagaactgggtgccgaggcttgtgcagttcacgccttattccttatactccactccgggaatatcctggactcgggcccaggagatgccaatagcaagcaggccgacgtccagacactgtcgtctgcatttgaggcagtcacgcggatccattttcccgaggccctgggccatgtggctttaagattagtgccgtgcccacccatctgcgccgcagcttacgctctggtgagcaacctgtctccttattcccacgatggtgattctctgtctaggtcacaagaccatatacctctcgccgcactccctctgttggccactagtagctccagataccagggagcggtagctaccgttatcgcgcgtactaaccaagcctattctgcctttcttaggtcacctgaaggcgcagggttctgcgggcaagtggccctgataggggacggcgtgggcggtattctgggctttgatgcattatgtcactctgccaacgccggtactggctcccggggttcatcaagacgcggatcgatgaacaacgagttgttgtctcccgaattcggccctgtcagagatcctctcgccgacggagtcgaaggactgggcaggggatctcccgagccctcggccctgccaccccagcggataccctccgatatggcctccccggagcctgaaggcagtcagaacagccttcaggctgctcccgcaactaccagctcttgggaaccaaggcgtgccagcacagcgttttgcccccctgctgccagttccgaagctcctgacgggcctagttcaacggctagactagacttcaaagtgtcagggttttttctgttcggctcccctctgggcctcgttctggccctcaggaaaacagttatgcctgccctggaggcccagatgagacccgcttgcgagcagatatataaccttttccatgccgcagacccatgcgcctcacggctggagcccctgctggcccctaagttccaggccattgctccccttacagtgccacgataccagaagtttccacttggggatggaagcagcctgttgttagcggacacactgcagactcatagctctctttttttggaagagctggagatgctggttccaagtaccccaaccagcacctccggggcattctggaaaggctccgagctggctaccgatcctcctgctcagcctgcagccccatctacaacatccgaggtggtaaagatcctggaaaggtggtggggtactaaacgcatagattactctctctattgccccgaggccctgactgccttcccgaccgttactctgccccatctattccacgcatcatactgggaaagtgctgatgtcgttgctttcattctgagacaagtgattgagaaagaacggcctcagctagccgagtgcgaagagccctcgatctatagccccgctttccccagggagaagtggcaaaggaagcggactcaggtgaaaatccggaatgtgacaagcaaccatcgcgcatccgatactgttgtgtgtgaaggtcgccctcaggtgttaagcggaaggtttatgtacggacctctagacgtagtgacgctgactggcgagaaggttgacgtgtatattatgacccagcctttaagcgggaagtggatccattttggcactgaagtgacgaacagcagtggccgtctcacatttcccgttcctcccgaacgcgctcttggaattggagtgtatcccgttcggatggtggtcaggggcgatcatacatacgccgagtgttgtctgactgtggtggcccgaggcacagaagccgtcgtcttctccatagacggcagttttacggcttcagtctccattatgggaagcgacccgaaggtcagagcgggtgcggtcgacgtagttcgccactggcaggacagcggctatctgatcgtttatgtgactggaaggccggacatgcagaagcatagagtggtagcgtggcttagccagcacaatttccctcacggagtggtctctttttgcgatgggctcacccacgatcctcttaggcaaaaagctatgttcctgcagtctctcgtccaggaggtcgagttgaatatagtggccggatatgggtctccgaaggacgtcgctgtttacgctgctttgggtctgtcgccctcacagacgtacatcgttggacgcgctgtaagaaagttgcaggcacagtgccagttcctttcggacgggtacgtggcccacttgggccagctagaggccggttcccatagtcatgcaagttccggacccccaagagctgcccttggtaaatcaagctatggagttgccgcacctgtcgatttcctccgcaagcagtcccagttactccgttccaggggcccaagtcaggccgagcgagaaggtcccggaacccctcccacgaccctcgctcggggaaaggctagaagtatttccctgaagctagactccgaggagtag

SEQ ID NO: 30321 - DNA, 1614 bp, Artificial Sequence
  Description of Artificial Sequence: Synthetic coding sequence
atgagtagttcaggctatcctcctaaccaaggcgctttctctactgaacagagcaggtatccgccacattctgtgcagtatacttttccgaatactcgacaccagcaagagttcgctgtgcccgactatcgctcttcccaccttgaggtttcccaagccagtcagctattgcagcagcagcaacagcagcagctgcgacgaaggcctagcctgctgtctgaattccacccgggatccgaccgccctcaggaacgcagaacttcctacgaaccattccacccgggaccatcacccgtcgatcacgattcactggaatcaaaacgccctcgattggaacaagtttctgattcacactttcaacgggtctccgccgctgtgctaccgctggtgcatcccttaccggagggcttacgggcttcagctgatgccaagaaagacccggcatttgggggtaagcacgaagccccaagcagtcctatctcaggccagccttgcggagacgaccagaatgccagtccatctaagctttccaaagaagagttgatacagagcatggatagggtggatcgtgaaatcgcaaaagttgaacagcagatcctgaagctcaagaagaagcagcagcagctcgaggaggaagcggcaaagccaccagagcccgagaagcccgtgagtccacccccagtggaacaaaagcaccggagtatcgtgcagatcatttacgatgaaaaccgaaaaaaagctgaagaggcacataagatcttcgaaggattgggcccaaaggtggagctgccgctttataaccaaccttccgatacaaaagtgtaccacgagaatatcaaaaccggcgtacctgcacgtcgtatgatgaagaatcaggtgatgagaaagaagctgattcttttcttcaagcgaaggaaccacgccaggaagcaaagagaacaaaagatatgccagagatacgaccagctgatggaagcctgggagaaaaaggtggatcgtatcgaaaataacccaaggcgaaaagccaaagaaagcaagacacgtgagtactacgagaagcagttccctgaaatacgcaaacagcgcgagcaacaagaaaggttccagagggttggccagcggggagcaggcttaagcgctactatcgctaggagcgaacacgagatctcggaaattatcgatggcctgagcgagcaagagaacaacgagaagcagatgagacagttgagcgtgatacctcccatgatgtttgacgccgagcaaaggagggttaagttcatcaatatgaacggtctgatggaggaccctatgaaagtttacaaagataggcagttcatgaacgtttggaccgatcatgaaaaggaaatttttaaggacaaatttatccagcatccaaaaaatttcggtttgatcgcctcctatctggagcgtaagtccgtacctgactgcgtcctgtactattaccttaccaaaaaaaacgaaaattacaaagctttggtgcgcagaaactacggaaagagacggggtcggaatcaacagatagccaggccctcacaggaggaaaaggtggaagagaaagaagaagataaagccgaaaagacagaaaaaaaatag

SEQ ID NO: 30322 - DNA, 147 bp, Artificial Sequence
  Description of Artificial Sequence: Synthetic coding sequence
atggaggacttatttgagactttccaggacgaaatggggttctctaatatggaagacgatgggcctgaggaggaggagcgagtggcggagcctcaagccaactttaacacaccccaagccctgcgccagttgctcctccttatgtag

SEQ ID NO: 30323 - DNA, 798 bp, Artificial Sequence
  Description of Artificial Sequence: Synthetic coding sequence
atggccagctccagcgtgccaccagcaacagtgtccgccgctaccgcaggaccaggacccggattcggcttcgcctccaaaacaaagaagaagcattttgtacaacagaaggttaaagtgtttagagcagcagatcctctggtaggggtttttctatggggcgttgcacatagcataaatgagctgtctcaggtcccccctcccgtcatgctccttccagatgactttaaggccagcagcaagatcaaagtgaacaaccatctgttccacagagaaaatctcccatcccacttcaaatttaaagagtattgccctcaggtgtttcggaatctgcgggacagattcggtattgacgaccaagattatctcgtgtctctcacccggaatccaccgagcgaaagtgaggggtcagacggacggtttctgatcagttatgaccgcaccctagtgattaaggaagtcagctctgaagacatagccgatatgcattccaatttatcgaactatcatcagtacatcgttaaatgtcacggaaacacactccttccacagtttctcggtatgtaccgcgtttctgttgacaacgaagatagttacatgttggtaatgcggaacatgttctcccacaggttgcccgtgcatcgcaagtatgacctgaaagggtctttggtgagccgcgagcctgctatcagaaaacggctgaaaaactgcccgcctctacgtatctggacattttcgacccgaaccagaaagtatattttggtgaaaaggcgaaggaaatatttttggagaagttag

SEQ ID NO: 30324 - DNA, 462 bp, Artificial Sequence
  Description of Artificial Sequence: Synthetic coding sequence
atgagcccggaagtcgctctcaatagaatttctccaatgctcagtccgttcatttcttcggtggtgcggaacggtaaggtaggtttagacgccaccaattgcttaaggatcactgatttgaagagtggctgtacttctctcacacccggtcccaactgtgataggttcaagctgcatattccttatgccggagagactcttaaatgggatattatcttcaacgctcaataccctgagctaccacccgattttatctttggagaggacgcggaattcctgcccgaccccagtgcccttcagaacctcgccagttggaatccgagtaatcccgagtgcctgttgcttgtggtcaaagagttggttcaacagtaccatcagttccagtgctctcggctgagggagagttctcgcctaatgtttgagtatcagaccctgctggaggagccacaatatggcgaatag

SEQ ID NO: 30325 - DNA, 78 bp, Artificial Sequence
  Description of Artificial Sequence: Synthetic coding sequence
atggaactccggtgcggaggactcttgttttcaagcaggttcgattccgggaatctggctcatgttgaaaaagtctag

SEQ ID NO: 30326 - DNA, 228 bp, Artificial Sequence
  Description of Artificial Sequence: Synthetic coding sequence
atggccagcgaagtgggccataatttggaatccccggaaacacctggtggcggaggatggacccgggtggaatttcctccccctgcccctaaaggcgcagcaacagtgtggtgcctgaatcgtttgggatcccgcaagctgagcttgatctggatcacttttaacaccggctggaatatgaagtctcgcctgattattttgatccagcaggtctcatgccaccactag

SEQ ID NO: 30327 - DNA, 1620 bp, Artificial Sequence
  Description of Artificial Sequence: Synthetic coding sequence
atggcaacgtctgctcccctcagatctctagaagaggaagtcacgtgcagcatctgcctggattatttgcgagacccggtgaccattgattgtgggcatgtcttttgtcgttcttgcaccactgacgttaggccaatcagcggatcgcgtccagtgtgccctctctgcaagaagccttttaagaaggagaacatcagacctgtttggcaattggcctcattagtggaaaacattgaaagactgaaagtggacaaaggacggcagcccggagaggtgactcgggagcagcaagatgccaagctgtgcgaacgacaccgcgaaaagctccattactattgtgaggacgacgggaagttgctctgtgtgatgtgtcgagagagcagggaacacagaccccatactgccgtgctgatggagaaagccgcacagccacatagagaaaagatcttaaaccatctctccacactgaggcgggatagagataagatccaggggttccaggctaagggtgaagctgacatactggccgcacttaagaaattgcaggaccaaaggcagtacattgttgctgagttcgagcaaggtcatcaattcctccgagaacgtgaggaacaccttttggaacagctggccaaactcgaacaagagctcacagagggacgtgaaaaatttaagtccagaggagttggagagctggccaggttggccctcgtgataagtgaactggagggaaaagcacagcagccagccgctgaactgatgcaggacacccgcgacttcctaaatcgttaccctaggaaaaagttttgggtggggaagcctatcgcccgagtggttaagaaaaagaccggagagttcagtgataaactcctttcattgcaacggggtctccgagaatttcagggaaagttgcttagggatctggaatataagacagtttctgtgacgctcgatcctcagagtgcttctggttatttacagctaagtgaagactggaagtgcgtcacatatacctcattgtacaaatcagcctacctgcacccacagcaattcgactgcgaacctggggtccttggctcgaaaggctttacgtggggcaaggtttactgggaggtcgaggtggagagagaagggtggagcgaagatgaggaagaaggtgatgaggaggaggaaggcgaagaggaggaggaggaggaggaggcaggttacggtgatggctacgatgattgggagacggacgaagatgaagagagcctgggtgacgaggaggaagaggaggaggaggaagaagaagaagttctggagtcttgtatggtgggtgtcgcaagagactccgtcaaacggaagggcgacctgtctctcagaccagaagatggggtttgggcgttgcgcctttcttccagcggcatctgggcgaacaccagtccggaagctgaattattcccagcattgaggcccagacgtgtcgggatcgctctggattacgaaggaggcactgtgactttcacaaatgccgaatctcaggaattaatttatactttcaccgcaaccttcactaggagactggttcccttcctctggttgaagtggccaggtactcgcttactgcttcgcccatag

SEQ ID NO: 30328 - DNA, 390 bp, Artificial Sequence
  Description of Artificial Sequence: Synthetic coding sequence
atgcctggcctatcctgcaggttctatcagcacaagtttcctgaggttgaggatgtagtgatggtgaacgtaagatccatcgctgaaatgggggcttacgtcagtctcctggaatataacaatatagaaggaatgatcctcttatcagaactaagccgcaggagaattagatctattaacaagcttatccggattgggagaaatgaatgtgtcgtggtgatcagagttgacaaggagaaagggtatatcgacctcagcaagcgcagacttactctgtgggagacggagtctaacctgcgaaatacagagcagcgcttcctggctgtgaaccctcgtctcgaatctttcccagtgctcaaaactagtaaactaaacatattttatttttag

SEQ ID NO: 30329 - DNA, 1842 bp, Artificial Sequence
  Description of Artificial Sequence: Synthetic coding sequence
atggccactatacctgactggaagctccagctcctcgccaggcgcagacaggaggaggccagtgttaggggccgtgagaaggcagagagggagcgtttatcccagatgcctgcttggaagcgcggattactggagagacgtcgggctaaactcgggctgagccccggagaacccagcccagtgctagggaccgttgaggcaggacccccagaccccgacgagagcgctgtgctgttggaggctattggtccagtccatcagaaccgtttcataagacaggagcggcagcagcagcaacagcaacaacagcgcagcgaagaattattagccgagcgcaaaccgggaccccttgaagcaagggagcgcagaccttctccaggcgaaatgcgagaccaaagccctaaaggaagagaatccagagaggaaaggttatctccacgcgagactagggagcggagattgggcattgggggagcccaggaactctccctgaggccgctggaagctcgcgattggcgccaatctccaggggaggttggagataggagctcccgcctatcagaagcatggaagtggcggctctctccaggtgagacccccgaaaggtctctgcgcctggccgaatcaagggagcaatctccaaggcgcaaggaggtcgagagccggctctctcccggagagtcagcgtaccagaagctcggcctgaccgaggcgcataagtggcgtccagacagtagagaaagtcaagaacagtccctggtgcagctcgaggccactgaatggcgcctccgcagcggggaggagcgacaggactattctgaagagtgcggcagaaaggaagagtggccggttccgggagttgcaccaaaggaaaccgctgaattatctgagaccctgacgcgcgaggcgcagggtaacagtagcgctggggtggaagctgccgaacaaaggccagttgaagacggggagcggggaatgaaacctacggagggctggaagtggaccctgaatagtggaaaggctcgggagtggacgccaagggatatcgaagcacagacccagaagcccgagcctcccgagtcagcagagaaactactggagtctccgggtgtcgaggccggtgagggcgaggcggagaaagaggaggctggcgctcaaggccgacccctcagagctctccaaaattgttgttccgttcccagccctctgccccctgaagacgcaggcaccggcggacttaggcagcaggaagaggaagctgtggaactgcaaccccctcctcctgcaccactgtctccaccccctcccgcacccacagctccgcagccacccggtgacccattgatgagccggcttttctatggcgtcaaggctggtcctggcgtgggagcacctagaagaagtggccatacttttacggtcaacccacggcgaagcgtgcccccagcgacacccgctaccccgacctcacctgctactgtggatgccgcagtgccaggtgcaggtaagaaaagatatcccacagctgaagagatcttagtgctgggcggttacctccgcctctcacggtcttgtctggccaaagggtcacccgagaggcatcacaaacagctgaagatctcgttttctgagacggcactggagacaacctatcaatatccctctgagtcgagcgttctggaagagttggggcctgagcctgaggtcccttcagctcctaaccctccggctgcccaaccggacgatgaggaggatgaggaggaactactcttgctgcagcccgaactacaagggggtcttcggacgaaggcgcttatagtggatgaatcctgtcggagatag

SEQ ID NO: 30330 - DNA, 1983 bp, Artificial Sequence
  Description of Artificial Sequence: Synthetic coding sequence
atcgcgaaacctcagggaacataccaagtgcttcctcccaacaccggttctctgtacattgataaagattgtagcgctgtgtactgtcacgaaagtagttctaacatatactatcctttccagaaacgcgaacagttacgggctggccgttatatcatgagacatacttcagaggttatctgtgaggtgctggatccggaggggaacacattccaggtcatggctgacggatcaatcagcacgattcttcccgaaaagaagcttgaggacgatttgaacgagaagactgaaggctatgactccctaagctctatgcaccttgagaagaatcaccagcagatttacggggaacatgtgcccaggtttttcgtgatgtatgctgacggttccggcatggagctgctgcgagactctgacatcgaagaatacctgtctcttgcgtataaggagtccaataccgtagtgctgcaagagcctgtgcaagaacagccgggaaccttaacaattaccgtgttgagaccttttcatgaagctagtccttggcaggtgaaaaaagaggacaccattgtgccccctaacctgagaagtcggtcctgggaaaccttcccgtcggtagaaaaaaagacccctggcccaccgttcgggacgcaaatctggaaagggctctgcatcgaatctaagcagctggtctctgcaccaggcgcaatattgaaatccccaagtgtactccagatgcgccaattcattcagcacgaagtgattaaaaatgaggtgaaactcaggctgcaggtctcactcaaggactatattaactacatactcaaaaaggaagatgagctgcaggaaatgatggtaaaggacagtcgcacagaggaagagagaggcaacgccgcagatctgctgaaattggtgatgagcttccccaagatggaagagaccaccaaaagccacgtgaccgaggtcgccgctcacctgacagacctgttcaagcagtctcttgcaacgccaccgaaatgtccccctgacacatttggaaaagatttctttgagaaaacatggagacacactgccagctctaaacgttggaaggagaagattgacaagacaagaaaagagatcgaaacgacccagaactacctgatggatatcaagaatcgcatcatcccacctttttttaaatctgaactcaatcaattatatcagagccagtacaaccatttggactccctatccaaaaaactacctagcttcactaaaaaaaatgaagatgcaaatgagactgcggtgcaagatacatccgatcttaacctggattttaaacctcataaggtcagtgagcagaagtcctccagtgtgccttctctgccaaagcccgagatctcggcagacaaaaaggatttcaccgcgcagaatcagaccgaaaaccttacaaagtctccggaggaggccgagtcctatgaacctgtgaagattcccacacaatccctgctgcaagacgttgccggtcagactcgaaaagaaaaagtaaagcttcctcattaccttctctcttctaagcccaaaagccagcctcttgccaaggttcaggattcagtaggcggaaaggtgaacacgagcagtgtggccagcgccgcaatcaacaatgccaaatcaagtctgtttggtttccatctcctcccctcaagcgttaaattcggagtgctgaaggaaggccatacctacgccactgtggtgaagctcaagaacgtaggcgtggacttctgcaggtttaaggtaaaacagccacctccaagtacagggctgaaggtgacgtataaaccaggaccagtagccgcaggaatgcaaacggaactcaatattgaactgtttgccaccgctgtgggcgaggatggcgcaaaggggtccgctcacatctctcataacattgagattatgactgagcacgaagtcttgttcctgcctgtggaggctaacatcctgtag

SEQ ID NO: 30331 - DNA, 2475 bp, Artificial Sequence
  Description of Artificial Sequence: Synthetic coding sequence
atgtattctaacgaggactccagacagactattgtatatagcgaggagtccaatactacgatgtcctatactcagaagatcacaaaccctctgcctgcggcaagctccactgatccagctcccttcgcgaacatcaatacgccagtattgcaggaggattatcgccaggactcccaaacaagaaggatcagcacactgaagctgacccacaatcaagaccttggctcctcgagcccaatttccactccacaattttctaaatccgttgaagttccatcctttcttaaaagaccaaggtccctgacccctaatcctgtgcccgagacccacacggcctctctctcaatccagattgcacccctctccggccaggacttagagtctcacaagcagcttcccgaactcagccccgaaaccgcaaagatccctttgcagcaggaacggcaaaaatctgccgttgctgcagccagtcagagtagtgattgcagagttagccagattacagttaatggcaacagtggcggagctgttagtcctatgagttattatcaaaggcccttttcgccttcagcctattccctacccgcatctctcaacagcagcatcgttatgcagcacggcacgtctctcgactcaactgatacatacccacagcacgctcagtctttggatggtacaactagttctagcatccccctgtaccgcagcagtgaagaggagaagagagtgactgtcatcaaggcccctcactatccagggatcgggcctgttgacgaaagcgggatacccaccgccatccgcactaccgtggacaggccaaaggattggtataagacaatgtttaaacagattcacatggtccacaagcctgacgacgacacagacatgtacaacaccccttacacctataatgccggtttgtacaaccccccttactccgcacagtctcatccggcagctaagacacagacgtaccgacctctgagcaagtctcattccgataactctcctaacgcattcaaagacgcttcaagtccagtgccgccaccacacgtgccgccaccagtgcctcctctccgaccacgcgatagatcatcaaccgaaaagcatgattgggatccccctgataggaaagtggatacccgcaaattccgttctgagcccaggagcatattcgagtatgagccgggaaagtcctcgattttgcaacatgagcggccacctcctctgcccacgacccccaccccagtgccacgagagccaggacgtaagccactaagcagttccaggttgggcgaggtaactggaagcccctcaccccctcctcggagtggagcccctaccccctcaagccgggctcctgcattgtcgccaactaggcctccaaaaaagcctctagattatgtgcaagaccattcttcgggcgtgtttaatgaagcatccctgtaccagtcctctattgaccgcagcctggagcggcctatgagttccgcaagtatggcgtctgactttcgaaagaggcggaaaagtgagcctgctgtagggcctccgaggggactcggggatcagagcgcatcgcgcacatcacctggccgagtggacctacccggatcgtcaacaactctgaccaagagcttcacttcaagttcacccagttctccaagcagagccaaagatcgggagagcccgagatcctactcctcgactctgacggacatggggagatctgcccctcgggaacgtcgcggaacccccgagaaggagaagctccccgctaaggccgtgtacgatttcaaggcgcaaacctctaaagaattatcatttaagaagggggatactgtgtacatcctcaggaaaatcgaccagaactggtatgagggggagcaccacggacgtgttggcattttccctataagctacgtggagaagctgactccacctgagaaggcacagcctgctagacctccacccccagcccagccaggggagataggggaggctatcgccaagtacaattttaacgcagataccaacgtcgaacttagcctgaggaaaggcgacagagtgatcctcttgaaaagggtcgatcagaactggtatgagggtaagattcccggaactaatcggcagggtatcttccctgtttcttatgtcgaggtcgtaaagaaaaacacgaagggcgcagaggattaccccgatcctcccatcccacactcatatagctctgatcggatccatagtctgagtagcaacaagccccagcgacccgtattcacgcacgaaaatatccagggcggaggtgaacctttccaggctctctacaactatacaccgagaaatgaagacgagctggagcttcgagagtcagatgtaatcgatgtgatggagaaatgcgacgatggctggtttgtgggaacctcgcgaagaaccaaatttttcgggacattcccgggaaattacgtgaaaagactctag

SEQ ID NO: 30332 - DNA, 228 bp, Artificial Sequence
  Description of Artificial Sequence: Synthetic coding sequence
atgaggtactacgggtcctattaccggggtctgggatacgggtgcgggggatttgggggattgggatatgggtgcggttgtggtgggtaccgatatggatcgggctatgggggatatcgatatggctgttgccgaccatcatgtagggaggggtatgggttttcagggtttaagaagcttgcggattcgcataccctgaccccacggagctgcccctatgcttcttag

SEQ ID NO: 30333 - DNA, 183 bp, Artificial Sequence
  Description of Artificial Sequence: Synthetic coding sequence
atggtattaatcctgggcagaagactgaatagggaagatctgggggttagggactcacctgcaacaaagcgaaaggtgtttgagatggacccaaaatccttgacaggacacgagttctttgattttagtagcggaagctctcatgctgagaacattctacagatttttaatgaattcagatag

SEQ ID NO: 30334 - DNA, 600 bp, Artificial Sequence
  Description of Artificial Sequence: Synthetic coding sequence
atgaagctcgggaagaagcctatgtataagcccgtggacccttacagtaggatgcagagtacctacaattataatatgaggggaggggcttatcccccacgatacttctaccccttccctgtgcccccactgttgtaccaagtcgagctctcagtggggggtcagcagttcaacgggaaggggaaaacccggcaggccgctaagcatgatgctgcagccaaggcccttaggatccttcaaaatgagcccctcccggaaagactcgaggtaaatggacgggagtccgaagaggagaacctgaataagtcagaaatctcccaggtgtttgagattgcgctcaaacggaacctgccagtcaatttcgaaagcttcccactgaaacaggtggctagagagagtgggcctccacacatgaaaaattttgtgacaaaggtttccgttggcgaatttgttggcgaaggagagggtaaatccaaaaaaataagcaagaagaatgctgcaattgctgttctcgaggaactcaagaagctgcctcccctgccagccgtggaaagggttaagcctagaatcaagaagaagacaaaacccatcgtcaagtag

SEQ ID NO: 30335 - DNA, 2685 bp, Artificial Sequence
  Description of Artificial Sequence: Synthetic coding sequence
atgcctgaacagttctccgtagcggaattccttgccgttactgccgaagacctgagtagtccggcaggcgcagcggcatttgccgctaagatgccacggtacagaggtgccgctttagcacgcgaagagatcctcgagggtgaccaggctatactgcagcgtattaagaaggcagtgagggccatccactcttccggcctgggacatgtcgagaacgaggagcagtatagagaggcggtggagagcttaggtaactcacatctgtcccaaaactctcatgagttgagtaccgggtttctgaatctggcagtgttcacccgtgaggtcgcagctctgtttaaaaacctgatccagaacctgaataacatagtatcttttccattggacagtttgatgaaggggcagttacgcgatggacgccaggcaagtttgtctttgggaagtcgagctaagctggaaaaagaacgcgaccgggctagagtcacaggtggcatccctggtgaagtggcacaggacatgcagagagagaggaggatctttcaacttcacatgtgcgaataccttctgaaggccggagagtctcagatgaagcaaggaccggatttcttgcagtccctgatcaagttctttcatgcacagcacaactttttccaggacggctggaaggccgctcagtcactttttcccttcatcgagaagttagctgccagtgtgcacgctctgcaccaggcgcaggaagacgaactacagaaactgacacagctgagagactcgttgcggggaaccctgcaacttgagtcacgcgaagagcatttgagtcggaagaacagcggctgcggctacagcatacatcaacatcagggcaacaaacagttcgggaccgagaaggtgggctttctgtacaagaagtccgacggaatcaggagagtctggcaaaagagaaagtgcggggtaaagtacggttgcttgaccattagccattccacaataaaccgtccccctgtcaagctgaccctgttgacctgccaagtccgccctaacccggaagagaaaaagtgttttgacctggtaacgcacaaccgaacataccattttcaagctgaggatgaacatgagtgcgaggcttgggtgagtgtcttacagaatagtaaggacgaagctctctcaagcgcctttcttggcgagccctcagccggacctggatcttgggggtccgcgggtcacgatggagagccacatgatttgactaaattgctgattgccgaggtcaaaagtcggccaggtaatagccagtgctgcgattgcggagccgcagaccctacctggctgagcaccaatctcggtgtcttgacctgtattcagtgtagcggtgttcatcgggagttgggagttcggtttagccgcatgcagagcttgaccttggacctgctgggaccgtcagaactgcttttggcattgaacatggggaatacctcatttaacgaggtgatggaggctcagctgccatcccatggaggacctaagccaagcgctgagtctgatatgggaactagaagagactacatcatggccaagtacgtcgagcatagattcgccaggagatgcaccccagaacctcaacggttgtggacggccatctgtaacagggacctgctctccgttctggaggcattcgcaaatggacaggacttcggccagccactccccggaccggatgcccaagcccctgaagaacttgtgcttcatctcgccgtgaaggtcgccaaccaggcatccctgcctctggtagattttatcatacagaacggcggacacctggacgccaaggcggctgacggaaatactgccctgcattacgccgcattatacaaccagccagactgtttgaaactcctactcaagggtcgggcactggtaggcaccgtgaacgaagccggagagactgccctggacattgccagaaaaaaacaccataaggagtgtgaagagctcctggagcaggcacaagctggaacattcgcatttccgctccatgtggactacagttgggtcatctccactgaacccggatctgattccgaggaagacgaggaggagaagcgatgcctgctaaaactgcctgcccaagctcattgggcaagtggcagactggatatttcgaataagacctatgaaactgtggcctcgctcggggctgcaaccccccaaggtgaatccgaagactgtccacctcctcttcccgtgaaaaattctagcagaaccctggtgcaaggctgtgctcgacacgcctcaggcgaccgctccgaagtctcatcgctctcatccgaggctccagagacaccagaatcgctgggctcacctgcatcttcctcttccctgatgagtccactggaacctggggacccaagccaggcacctccaaattccgaagaggggttgcgagaaccacctggaacaagccgccctagtctgacttccgggactactccctccgagatgtatttacctgtgcggttctccagtgagtcaactcggagttaccggcgaggtgccagatcacctgaagacggaccgagcgcgcgacaacctttgcctcgccgaaacgtcccagtcggcattaccgaaggtgacgggtctcgaaccggatcattgcctgctagctccgttcagttactgcaggattag

SEQ ID NO: 30336 - DNA, 354 bp, Artificial Sequence
  Description of Artificial Sequence: Synthetic coding sequence
atggcgttcagtggaagagcacgcccatgcattatccctgaaaatgaggagatccccagagcggcactgaacacagtccacgaggccaatggtaccgaagacgagcgcgctgtgagcaaactgcagcggcgacactccgacgtcaaggtctacaaggagttctgcgatttctatgcgaaattcaatatggcaaacgcacttgcatcagccacctgtgagcggtgcaaggggggatttgctcctgcggaaacaatcgtgaactccaacggcgagctctaccatgaacagtgcttcgtgtgtgcgcagtgctttcaacagttccctgagggtctgttctatgaggaaaggacatag

SEQ ID NO: 30337 - DNA, 1797 bp, Artificial Sequence
  Description of Artificial Sequence: Synthetic coding sequence
atgtttgtctccgacttccgcaaggagttctacgaggtggtgcagtctcagcgtgttctgttgtttgtggcgtctgatgttgatgccctgtgcgcttgcaagattctacaagccttatttcaatgtgatcacgtccagtacacactggtcccagtctcaggctggcaagagctggagactgcattcctcgaacacaaggaacagttccactatttcatacttattaattgcggggcaaacgtcgacctccttgatatcctacagcccgatgaggacacaatctttttcgtctgtgatactcacagacctgtgaatgttgtgaacgtctataatgatacacagattaaactcctgatcaaacaagacgatgaccttgaagtcccagcctacgaggacattttccgggatgaggaggaggatgaggagcatagcggcaatgactcagatggttcggagccatctgagaagcgaacccggctggaggaggaaattgtcgaacagactatgcgccgacgtcagaggcgagaatgggaagccagatccgggtctggatctgaaccagtggcagcagcactggagaagtcctccagacttttcgcaggaccaatgagcgatcgaacagctccaaggtcaccacgcagggatatcctattcgactatgaacagtacgagtatcacggtacctcatccgccatggttatgtttgagctggcatggatgctgtccaaggatctgaacgacatgctgtggtgggccattgtcggattaactgaccagtgggtccaggacaagataacccagatgaaatatgtcaccgacgttggagtcctccagagacatgtctccagacacaaccaccgtaacgaggatgaagaaaatacattgtctgtggattgtacccggatctcctttgagtacgacttgcggttggtcctctatcagcattggtctcttcacgattcactgtgcaacacgtcttacaccgccgctagatttaaattgtggtccgtccatgggcagaagcgcctgcaagaatttctggctgacatgggattaccactgaaacaagtgaaacaaaagttccaggccatggacatctccctgaaagagaacttgcgcgagatgattgaagagagtgccaacaagtttgggatgaaagatatgagggtccaaactttcagcattcatttcgggtttaaacataaattcctagcttcagatgtggtgtttgcaacaatgtcactgatggagagtcccgagaaggatgggtcaggcaccgatcattttatacaggcgctcgacagcctttccagaagcaacctggataaactataccatggacttgagctcgctaagaagcagttgcgggcaactcaacaaaccatagcctcatgcttatgcacgaatttggtcatatcccaggggccttttttgtattgtagtcttatggaaggtacaccagacgtaatgctgttctcccgacccgctagtctcagccttctctcaaagcacctcctaaaaagctttgtctgtagcactaaaaacagaagatgtaagctgctcccactcgttatggcagcccctctcagtatggagcatggcacggtgacagtagtgggtattcctcccgagacagacagctcagatcggaagaacttttttggcagggcttttgaaaaagccgctgagtccacatcctcacgaatgctgcacaaccactttgatctgagcgtgattgagttgaaggcagaggacagatccaagtttttggatgccctgatctctctgttgtcttag

SEQ ID NO: 30338 - DNA, 2994 bp, Artificial Sequence
  Description of Artificial Sequence: Synthetic coding sequence
atgcccagcgagaagaagatctcatccgctaacgattgcatctcttttatgcaggctgggtgcgagctgaagaaagtgcgtcccaattctcgaatttacaatcgtttctttactctcgatacagacctgcaggccttgcgctgggaaccgagtaagaaagacctcgaaaaagccaaacttgacatttcggccatcaaagaaataagactcggaaagaacaccgaaacattccgcaataatggtctcgccgaccagatatgtgaggattgcgctttctcgatcctgcacggggagaactatgaatccttggatctggtggctaattctgctgacgttgccaatatatgggttagtggactgagatacctggtatcacgcagtaaacaacccctcgatttcatggaagggaatcagaacacgcctcgttttatgtggctaaagactgtgtttgaagctgccgacgttgacgggaacggtattatgctcgaggatacgtcagtcgagctgatcaaacagctcaatcccactctgaaggaagcgaaaatcagactgaagttcaaagagattcagaagtcaaaggagaaattgacgacccgcgtaactgaagaagagttctgcgaagcgttttgcgagttatgtacgagaccggaggtgtacttcctcctagtgcaaatttcgaagaataaagagtacctggacgcaaacgacctgatgctcttcctggaggcagagcagggcgtcacccacatcaccgaggacatttgcctagatattatcaggaggtatgaattaagtgaagagggccgacagaaggggtttctcgctattgacggctttactcaatatctgttaagctccgaatgtgacatcttcgaccctgaacaaaagaaggttgcacaggatatgacccaacctttgtcacattactatattaatgcatcgcacaatacatacctgatcgaagatcagttcagagggccagcagatatcaacggctatatccgcgctttgaagatgggttgtcggtcggtggaactcgacgtttctgacgggtccgataacgaacctatattatgtaaccggaataatatgacaacccatgtgtcttttcggtccgttattgaagtcatcaataaatttgccttcgtggcgtctgagtacccgcttatcctgtgtttaggaaaccattgttcccttccgcagcagaaagtgatggcacagcagatgaagaaggtctttgggaacaaactgtacaccgaggcccctttgcccagcgaaagttaccttccctctcctgaaaagctgaaaaggatgatcatcgtcaaaggaaaaaagctaccctccgacccagatgtacttgagggggaggtgacagatgaggacgaggaggcggagatgtcccgaaggatgtcggtagactacaatggcgagcagaagcagattaggctttgccgagaactcagtgacctcgtctccatctgcaaaagtgtgcagtatcgggacttcgagttgtccatgaaaagccagaattattgggagatgtgttctttctcagaaaccgaagcctcgaggatagctaatgaataccccgaggactttgtcaactataataagaaattcctgtcgcgcatctacccttctgcgatgagaattgactcatctaatctgaacccacaggacttctggaactgcggctgccagatagtggcgatgaattttcagacccctggtccgatgatggaccttcacacaggttggtttcttcaaaatggagggtgcggatatgtcctgaggccgtctattatgcgcgacgaggtcagctatttctcagccaacacaaagggaatcttgccaggcgtgagtcctttggcactgcacatcaagatcatatccggtcagaattttccgaagccaaagggggcttgcgcaaagggcgacgtgattgatccctacgtgtgcatcgagatccacggcattccagctgattgtagcgaacagaggacgaaaacagtgcagcagaactctgacaatccgatattcgatgagacatttgaatttcaggtaaacctgccggaactggccatgatcagatttgtggtcctggatgacgactacatcggggatgagttcatcggacagtataccatccccttcgagtgcctgcagccagggtaccgtcacgtgccattacgttcttttgttggggatattatggagcatgtgaccctgttcgtgcacattgccattacaaacaggtctgggggaggcaaagctcaaaagcgctcactcagcgtgcggatgggcaagaaggtccgagagtacaccatgctgcgcaatataggcctcaaaaccatcgacgatatctttaagatcgccgtgcacccactgagggaggcaatcgatatgagagaaaatatgcagaacgctattgttagcattaaagaactgtgtggcctgccgccaattgccagccttaagcagtgcctgctaacgcttagtagtcgccttatcactagcgacaatacgccctcagtgagcctagttatgaaggactcattcccgtacctcgagcctctcggcgctattcctgatgtacaaaaaaagatgctgaccgcctacgatctaatgatccaggaatctcgctttctaattgagatggcggacaccgtccaggagaaaatcgtacagtgccagaaggccggaatggaattccatgaggaacttcacaacctgggagctaaagaggggctcaaaggccgtaagcttaataaagcaacagagtcatttgcctggaacataaccgtcctgaagggccaaggagacctgctgaagaatgccaagaatgaggctatcgagaatatgaagcagatccagctggcttgcttgtcctgcggcttgtctaaagcccctagcagttcagcagaagctaagtctaaacgatcactagaggctatagaggagaaggaaagctctgaggaaaacggtaaactgtag

SEQ ID NO: 30339 - DNA, 612 bp, Artificial Sequence
  Description of Artificial Sequence: Synthetic coding sequence
atgagaaatggggattttctgcctacacgacttcaagcacagcaggacgctgttaatatcgtctgccactcaaagacgcgcagtaatcctgagaacaatgtcggattgataaccctggcaaatgactgcgaggtcctgactacacttacgcccgataccggcagaatcctttccaagctacacaccgttcagcctaagggaaaaatcactttctgtactgggattcgggtcgctcacttggcattgaaacaccgtcagggtaaaaatcataaaatgcgaatcattgcctttgtcggctcccctgttgaggacaacgagaaggatctggtgaaattagcaaagcgccttaagaaggaaaaagtgaatgtcgatatcatcaactttggggaagaggaggtgaatactgaaaaacttaccgccttcgtgaacacattgaacggcaaagatggaaccggttcccatctggttaccgtcccgcctggcccatctctcgccgacgcactgattagtagcccaattcttgccggagaggggggagctatgctgggattgggggctagtgattttgagtttggcgttgacccgagtgccgatcctgagttagccttgtag

SEQ ID NO: 30340 - DNA, 429 bp, Artificial Sequence
  Description of Artificial Sequence: Synthetic coding sequence
atgagtatcagctctgacgaggtcaactttctggtttacagatatctgcaggagtctgggttctcccattccgcgtttacattcggcatcgagtcccacataagccaatcgaacattaacggggctttggtcccgcctgctgctctcatttccatcattcaaaagggtctgcagtacgtcgaagccgaggtctctattaatgaggatggaactcttttcgacggacgcccaatcgagtctctgtccttgatcgacgccgtgatgccggatgttgtgcagacaagacaacaagcctatcgcgataagctggcccagcagcaggcagccgctgccgcagcagctgctgccgcagcctcgcagcaaggttctgccaaaaatggcgagaacaccgcgaatggggaagagaacggagcccacaccatcgcatag

SEQ ID NO: 30341 - DNA, 1410 bp, Artificial Sequence
  Description of Artificial Sequence: Synthetic coding sequence
atgtgttcactggcgtcaggtgccactggctatagccacctgctgaagaagcattttcacactgtatcgttgtccatctcccttattttaactgcgtggttcataaacatgaatcccactgttgaatacatgaactcaatttacaatcctgtcccttgggagaaggaagagtacctgaaaccggtgctggaagacgatctgctgttacaattcgacgtggaggacctgtacgaacctgtgtctgtcccttttagttatcccaatggcctgagcgaaaatacatccgtcgtggagaagctgaaacacatggaagcccgagccttgagtgctgaggcagccctggccagggccagagaggacctccagaagatgaaacagtttgctcaagactttgtcatgcacaccgatgtgcgcacgtgtagctctagtacaagtgtcatcgcagatctccaagaagatgaagacggggtttacttttcgtcatacggccactatgggatacatgaggagatgttgaaagacaagataagaactgaaagctacagagactttatctatcagaatccacatattttcaaggacaaagtggtactcgatgtggggtgcggtacaggcatcttgagcatgttcgctgcaaaggctggcgctaaaaaggttctgggagtcgatcagtccgaaatcctatatcaggcgatggatataatcagactgaataagcttgaggataccatcaccctaattaagggtaaaattgaggaagtgcacctgccagtggagaaagtagacgtgatcatttcggaatggatggggtacttcttgctctttgagagcatgctagactcagtgctctatgcaaagaataagtatttggccaaaggaggcagtgtgtatcctgatatttgtactatttctctcgtcgccgtttcagacgtgaacaagcacgcggaccggatagcattctgggacgatgtctatgggtttaaaatgagctgcatgaagaaggccgtcatccccgaagcagttgtagaggttctggacccaaaaacactcatttcggagccttgcggtataaaacatatcgactgccacacaacttccattagtgatctagagtttagctccgattttaccctaaagataacaaggaccagcatgtgcaccgctatcgccggatatttcgatatatacttcgaaaagaactgccacaatcgcgtcgtcttcagcacaggtcctcagtccactaaaacgcactggaaacaaaccgtctttctcttagaaaaacccttttcagtcaaggctggagaggctctgaagggaaaagttacagtgcataagtctaagaaggacccgcgatcgctgacggttaccctgacccttaacaactccacgcaaacctacgggctgcagtag

SEQ ID NO: 30342 - DNA, 525 bp, Artificial Sequence
  Description of Artificial Sequence: Synthetic coding sequence
atggcttccgccggtactcagcactactcaataggacttcgtcaaaagaacagcttcaagcaatcaggccctagtggtacggtacccgctactcctccagaaaagccatctgagggacgcgtgtggccacaggcccatcagcaggtgaagccgatctggaagttggagaagaagcaggtggagaccctgtccgccggactgggcccaggcctcctgggcgtccctccacagcctgcctactttttctgccctagcactctctgtagttcaggaactaccgctgttatcgcaggccatagcagctcatgttatctgcactccttgcctgacttgtttaactccacactgctatacaggagaagcagttaccgtcagaagccgtaccagcagctggagagtttttgcctacgctcaagccccagtgaaaagagtcccttcagccttcctcagaagtcgctgccagtgagtcttacagcgaacaaggctacttcttccatggtattctctatggcccaaccaatgtag

SEQ ID NO: 30343 - DNA, 1572 bp, Artificial Sequence
  Description of Artificial Sequence: Synthetic coding sequence
atgcagaaggaacgtgaacttcaggaaaccatttactttaaaaacacctggccagcctgtatgttcctgatagtagcaccactaagcgtactatacaattggaaggacgagctggatacttggggctatttccgcgtaaccgtccttcacggcaatagaaaagataacgagctgattcgcgttaaacagcgaaagtgcgagatagcgctcacaacatatgaaacattgagactgtgtctggacgagcttaactccttagaatggagcgcggttatcgtggatgaagcccatcggatcaagaacccaaaggcccgagtgactgaagtgatgaaggccctgaagtgcaacgtgcgaatagggctgaccggcacaatcctccaaaataatatgaaggaactttggtgtgtaatggactgggccgtgcccggactgctagggagcggcacatatttcaaaaaacagttctctgatcccgtcgagcacgggcagagacacacagcaacgaagcgcgagttggcgacaggaagaaaagccatgcaaagattagcaaaaaagatgtctggctggttcctcagaaggactaagactctgatcaaggaccaactgccaaagaaggaagatcggatggtctactgttctttaactgactttcaaaaagccgtgtatcagaccgtcttggaaactgaagatgttaccctgatactgcagagctcagagccttgcacctgccgttctggtcagaaaaggcggaactgttgttataagacaaattctcatggggaaacagtcaaaacattgtatctttcttatctgacggtcctgcaaaaggtggccaaccacgtggcactgctccaggctgctagtacttcaaagcagcaggaaacgctgataaagcgcatctgcgaccaggtgttttctcggtttcccgactttgtgcagaagagcaaagacgctgcattcgaaacactgtctgatcccaaatattcaggtaagatgaaggtgctccaacagctgctcaatcactgccgcaagaaccgagacaaggttctcctcttctccttttctacgaagttgttggatgtgttgcagcagtactgcatggcctccggcctggactacagacgccttgacggaagcactaagagtgaagaacggctgaagatcgtgaaagagtttaacagcacacaagatgtgaacatttgcctggtgagtaccatggcgggagggctcggtctcaatttcgtgggggcaaatgtggtggtcctctttgatcccacctggaaccccgcaaacgacctgcaagctatcgaccgcgcttaccggatcggccagtgtagagacgtcaaagtactgcgacttattagcctgggaaccgtggaagaaattatgtatctccgtcaaatttacaagcaacagctgcactgtgtcgtggtggggagcgagaatgcaaagcggtactttgaagcagtgcagggctcgaaagagcatcagggagagttatttggaatccataatctttttaaattccgtagccagggttcctgcctgacaaaggatatactggaggtatag

SEQ ID NO: 30344 - DNA, 1179 bp, Artificial Sequence
  Description of Artificial Sequence: Synthetic coding sequence
atggggacaacttgcctgcacctgggtaccttggagcagagcctcgtcttcgagaacaaggtgaacagtgaaaaggtgaagctatctctgcggaatttcccacacaatgattacgaagacgtgttcgaagagcccagcgaatccggctctgacccatctatgtggactgcacggggacctttccggagagatcggtggtcatccgaggacgaggaggctgccggtccaagccaggcgctgagcccattactttccgatacaaggaagattgtgagtgaaggcgaactggaccagctggcccagatcagacccctgatctttaactttcatgaacaaactgctatcaaagattgcttgaaaatccttgaagagaaaacagccgcttacgacattatgcaggagttcatggccctggaactgaaaaacctgccaggtgagtttaatagcggcaaccagccttcaaaccgcgagaagaatcgctatagagatatactcccatatgattcgactagagtacccctgggtaagtcaaaagactacatcaacgcttcctacattcggatcgtcaactgcggcgaagagtatttttatattgccacccagggacctctgctgtctactattgacgatttctggcagatggttctggagaacaattcaaatgtcatagcaatgataacccgggaaatcgaagggggtatcatcaagtgctaccactactggcctatttctctcaaaaagccgctggagcttaaacatttccgagtgtttctcgaaaactaccaaatccttcaatattttatcatccggatgtttcaggtggtcgagaagagcaccgggacctcacacagcgtcaaacaactacaatttaccaaatggccagaccacggaaccccagcttcagctgattctttcataaaatacattaggtatgcacgcaagtctcatcttaccggcccaatggtcgtgcattgctcagccggtataggacgtactggggtgtttctgtgcgtggatgtcgtgttttgcgccatcgttaaaaactgctctttcaatatcatggacatagtcgcccagatgagggagcaaaggagcggaatggtccaaaccaaagagcagtatcacttttgctatgacattgttctggaagtgctgagaaagctcttgacgctcgactag

SEQ ID NO: 30345 - DNA, 1566 bp, Artificial Sequence
  Description of Artificial Sequence: Synthetic coding sequence
atggagcagtcaagtttgtacttctgggatctgcttgaaggaagcgagaaggccgtggtcggcactacatacaaacacctgaaagatctgctatccaaactcttgaactcggggtacttcgagtccattccagtgccgaaaaacgcaaaggaaaaagaggtgcctctagaggaggagatgctgatccagtctgagaagaagacacaactgtccaaaacagagagcgtgaaagaatcggagtcactcatggaattcgcccagcctgagatccagccgcaagaattcttgaataggagatatatgaccgaggtggattatagtaacaagcagggtgaggagcagccatgggaggcggactacgccaggaagcctaacctacccaaacggtgggatatgctcaccgagccggacggtcaagaaaaaaagcaggaatcattcaagtcttgggaggcatcaggaaagcatcaggaggttagtaagcctgccgtctccctggaacagcgtaagcaggacacttcaaagcttcgctcaaccctgccggaggaacagaagaagcaggagatcagtaaaagcaaacctagccccagccagtggaagcaggatacacctaaaagcaaggccggatacgtacaggaagaacagaagaagcaagaaactcctaagttgtggcctgttcaactccagaaagagcaggaccctaagaagcagacaccgaaatcctggaccccaagcatgcagagtgagcagaacactactaagagttggaccacccccatgtgtgaagaacaggacagcaagcagccagaaacccccaaaagctgggagaacaatgtggaatcccagaagcattccctaactagccagtcacagatatctcccaagtcgtggggggtggcaactgcctccctgatccctaacgaccaattactgcccagaaaactcaataccgaacctaaggacgtccctaagcccgtccatcaacccgtgggctcctcctccactctccccaaggatcctgtgttaagaaaagagaagctgcaggatcttatgacgcagatccagggaacctgcaacttcatgcaggaaagcgtgctcgattttgacaagccttcatccgctatcccaacctctcagccacctagcgccacacctgggtccccagtcgcatccaaggagcaaaatctcagctcgcaatcagactttctgcaagagcctcttcaggccgctatcccacccggaaagcaaccctcgtcactggcatcacccaatccgccaatggccaagggcagcgagcagggctttcagtctcctcccgcaagttccagttcagtcacaataaacactgccccattccaagccatgcagaccgtattcaacgtgaatgcccctctgcctcctaggaaagagcaggaaattaaggaatctccatactcacccggttataaccagtccttcacgacagcttccactcagactcctccacagtgtcagctgccctctatccacgtcgaacagaccgtgcactcccaggagactgccccaggaaaccaccattccactttttag

SEQ ID NO: 30346 - DNA, 480 bp, Artificial Sequence
  Description of Artificial Sequence: Synthetic coding sequence
atggccacctccgcaccactgagaagtcttgaggaggaggtaacctgttccatatgcctcgactacctgcgggacccagtcaccatcgactgtggccatgtcttctgccgatcgtgcaccacagatgtgcggcctatcagtggcagccgccctgtttgtcccctctgtaagaagccatttaagaaggaaaacattcggccagtgtggcagttggagaagattctcaatcacctatctacgctgcgtcgagatagagataagatacaaggcttccaagccaaaggggaggctgacattttagccgcacttaagaaactgcaggaccaaaggcaatatatcgtggccgaattcgaacagggtcaccagttcctgagggaaagggaggaacacctacttgaacaactggccaaactggaacaagaactgactgaagggcgtgagaagttcaaatcccggggagtgggtgaactggcaagatag

SEQ ID NO: 30347 - DNA, 270 bp, Artificial Sequence
  Description of Artificial Sequence: Synthetic coding sequence
atgagcgagcagggagatttgaatcaggcaatcgcggaggaaggaggcactgagcaagagacggccactccggagaatggaatcgtcaagtccgagtctctcgatgaagaggagaagctggagttgcagcggaggctggaggcacagaaccaggagagacgcaaatctaaaagcggagccggtaaaggaaaacttactcgctccctggccgtgtgtgaagagagtagcgcacgcccaggcggagaatccctccaggaccagacgctgtag

SEQ ID NO: 30348 - DNA, 1356 bp, Artificial Sequence
  Description of Artificial Sequence: Synthetic coding sequence
atggccgagggcgctcagcctcaccagccgcctcagctcgggcctggagcagccgcacgagggatgaaacgcgagtctgagctggagttaccagtgccaggggcaggcggagacggcgctgatcccggactgtcaaaaagacccaggacggaggaggccgctgctgatggtggaggtggaatgcaaaacgagccacttaccccaggataccacgggtttcccgcaagggatagtcaagggaaccaagagccaacaaccaccccagacgccatggtccagcctttcaccactattccctttccccctccccctcagaacggcattccgactgagtacggcgtgccccacacacaggattacgccggacaaacaggagagcacaatctcacactgtacggctccacgcaggctcatggcgagcaatccagcaatagtccctcgacacagaatgggtctctgacgcagaccgaggggggagctcagacagacgggcagcaatcgcagacccagtctagtgagaatagtgagagtaagtctaccccaaagcggctacacgtctccaatatcccctttcggttccgcgacccggatctgagacagatgttcggtcagttcgggaagatattggatgttgagatcatatttaatgaaaggggctccaagggcttcggattcgtcacgttcgagaactctgctgatgcggacagagcacgcgagaagctgcacggaaccgtggtggaaggacggaaaattgaggtaaacaacgcaactgccagagttatgacaaataaaaaaatggttacaccatatgccaacggctggaaactgtcgcccgtcgtgggggctgtgtacgggccagaactctatgctgcttcctcgttccaggccgatgtgtctcttgggaatgacgccgcagtacctctgtcaggccgaggtggcattaatacctacatacccttgatttcccttcccttggttcccggtttcccctatcctactgctgccactactgcagcggcttttcgtggagcccacctacggggtcggggacggactgtgtacggcgctgtgagagctgttccccctacagccattcccgcataccctggcgtggtctatcaggacgggttctacggagcagacttatatgggggatatgccgcttataggtacgctcagcctgcaactgcgactgccgcaactgcggctgcggcagcagccgctgcatattccgacggttacgggagagtgtacaccgcagacccctatcacgcccttgcgccagccgctagctacggcgtgggagccgtcgcctccctctatagaggcggttacagtaggttcgccccttattag

SEQ ID NO: 30349 - DNA, 855 bp, Artificial Sequence
  Description of Artificial Sequence: Synthetic coding sequence
atgttctcccgaagatcgcatggtgacgtgaaaaagtctacacagaaggtgttagacccaaagaaggacgtactgacccggcttaagcacctgcgagcccttctagacaatgtggacgccaacgacctcaagcagttctttgaaacaaattatagccagatttactttatattttacgagaacttcatcgccctagagaactcactcaagctcaaaggcaacaacaagagtcagcgcgaagaacttgactctatactgtttttatttgagaaaatcctccagttcttgcctgagaggatctttttccggtggcattaccagagtatcggatccactttgaagaaacttctgcatactgggaactccattaagattcgttgcgagggaatcagactgtttctcctttggctgcaggccttgcagaccaactgcgctgaggaacaggtgctaatcttcgcctgtctggtccctggctttcctgctgtaatgtcatctaggggcccttgtactctggaaacactaatcaacccctcaccttcggtcgcagacgtgaaaatttaccctgaggagatcacacccctcctgccagccatctctggggaaaagatcgccgaagatcagacgtgcttcttcctgcagattctcctgaaatatatggtcatccaggccgcttccctggaatggaaaaacaaggagaatcaggacactggcttcaagtttctcttcaccctcttccgcaagtattaccttccacacctgtttccctcgttcaccaagctgacaaacatttacaagccggtacttgacatccctcatctgaggcctaagcccgtgtatataaccacgacacggtag

SEQ ID NO: 30350 - DNA, 846 bp, Artificial Sequence
  Description of Artificial Sequence: Synthetic coding sequence
atgggcgatacagtagtggaacctgccccactcaagcctacgtccgaaccaacaagcggaccgccaggaaacaatgggggttcactcctcagtgtcatcaccgagggcgtgggggagcttagcgtcatcgaccctgaagtggcccagaaggcatgtcaggaggttttggaaaaggtgaagctgctccatgggggagtcgctgtgtcaagccgaggtacccccctggaactcgttaacggagatggtgttgactcggagattcgttgcctggatgatcccccagcacagattcgcgaggaggaggatgagatgggggctgccgtcgcatcagggactgcgaaaggtgctcgacgcagacgacagaacaactcggctaaacagtcctggctcctcagactcttcgagtcaaagctttttgacatcagtatggcgatatcctatctttacaacagcaaggagccaggcgtgcaggcatacattggaaatcgacttttctgtttcagaaacgaagacgtggacttttaccttccacagctgctcaatatgtatatccacatggacgaagacgttggtgatgcgatcaaaccctacatagtgcaccggtgtcgacagtcgattaacttttccttgcaatgtgctctgctattgggtgcatactcatccgacatgcacattagcacacagcggcactctcgaggcacgaaacttcggaaactgatcctgtctgacgaattaaaacctgcgcacaggaagagagagctgccatcactgagtccagcccctgataccggcttgtctccttctaaacggacccaccaacggtccaagtcagacgccactgcctag

SEQ ID NO: 30351 - DNA, 591 bp, Artificial Sequence
  Description of Artificial Sequence: Synthetic coding sequence
atggaagacctgtttgagaccttccaggacgagatggggttctctaacatggaggacgatggtccggaggaggaggaacgggtcgcagagccacaggcaaacttcaacactccacaggctctccgatttgaggagttgctcgcgaacttattgaacgagcaacaccagatcgcgaaggaactctttgaacagcttaaaatgaaaaagccatcggccaaacagcagaaggaagtggagaaagtcaagcctcagtgcaaggaggtgcaccagacactgatcctggatccggctcagcggaagaggctgcagcagcagatgcaacagcacgtccagctcctgactcaaatccaccttttggcaacttgcaaccctaacttgaaccccgaggcctcttccacacggatttgcctcaaagagttgggtacattcgcgcagagcagcatcgccttgcaccatcagtataatccgaagttccagacactgttccagccttgcaatctcatgggcgctatgcagcttattgaggacttcagtacgcatgtatccatcgattgtagtccacataaaacggtcaagaagaccgtgtgctag

SEQ ID NO: 30352 - DNA, 1620 bp, Artificial Sequence
  Description of Artificial Sequence: Synthetic coding sequence
atggcgaccagtgctcccctcagaagcttggaggaagaagttacctgctctatctgtctcgattatctgagagatccagtcacgatcgactgcggacatgtcttttgccgtagttgtaccaccgacgtcaggcctatttccggttctcggcctgtttgccccctttgcaagaagccttttaagaaagagaacattaggccagtttggcagttggcttctcttgttgaaaatattgaaagactgaaagtggataaaggccgacagcccggtgaggtcacccgcgaacagcaggacgcaaagctgtgcgagcgtcatagggagaagttacactactactgtgaagatgacggaaagctgttatgcgtcatgtgcagagaatcacgagagcataggccgcataccgcagtcctgatggagaaggcagcacagccgcaccgagagaagatcctcaaccacctgagcacactccgccgagacagagacaagattcagggattccaggccaagggagaggctgacattcttgcagcgctgaagaagcttcaggatcagcgccagtacatagtggccgaattcgaacagggacatcagttcctgagagagcgtgaggaacatttactcgaacagctcgcaaagctggaacaagagctaacggaaggcagggaaaagttcaagtcccggggagtcggagaactggccaggctcgctctcgtgatctccgaattagagggaaaagcccagcagccagctgcggagctgatgcaggacacccgcgatttccttaaccgctatcctagaaaaaagttctgggtgggtaagcctatcgcgagggttgtcaagaaaaagacaggtgagttcagtgacaaactgctgtccttgcaacgcggactacgcgagttccaggggaagctcctgagggacctggagtacaagaccgtgtccgttaccttggatcctcagtctgcatccggttacttgcagctcagcgaagactggaagtgcgtgacatacactagcctttacaaaagcgcttatctgcacccacagcagttcgattgtgagccaggcgtgttgggcagcaagggattcacttggggtaaagtgtattgggaggtcgaggtcgagagagaagggtggagtgaggacgaggaggagggcgatgaagaagaggaaggcgaagaggaggaagaggaggaggaggccggttatggcgacggttacgatgattgggagaccgatgaggatgaggaatccctgggagatgaggaagaagaagaggaggaggaggaagaggaagtactcgagtcttgtatggttggggtggcacgggactctgtgaaaagaaaaggcgatctgagcttgaggcccgaggatggagtatgggccctaaggttaagtagcagcggaatatgggccaacacctcacccgaagccgaactgttccccgctcttcgcccacggagggtcgggattgctctcgactatgagggaggcaccgtaacattcacaaacgcggagtcacaagagctgatttatacattcactgccacattcactcgtcggttggtcccctttctctggttgaaatggcccggaactagacttttgctgagaccctag

SEQ ID NO: 30353 - DNA, 1086 bp, Artificial Sequence
  Description of Artificial Sequence: Synthetic coding sequence
gtaacaactgaaaagacctataccagcactagcaataactcaatctcgggcagtctaaagagactcgaagataccactgctaggttcacaaatgcaaactttcaggaggtgagcgcccatacctcctccggtaaggatgtgagcgagacgaggggcagcgaaggcaaggggaagaagagtagtgcacattcgtctggacagagaggtcgcaagccaggaggcggacgcaaccctgggacaacagtctctgctgctagcccatttccccaagctgggtacaagcgtgcgcaaacatcaggaattgaggaggaaacggtcaaggagaagaagcgaaagggcaataagcaatcaaagcacgggcctggcagacctaagggcaataagaaccaggaaaatgtcagtcacttgtccgtgagttctgcaagccccacctcgtctgtagcctctgctgcaggcagcatcacatcttccagtttgcaaaagtcccccactctcttacgcaacggctctctgcagagtctgagcgttggatctagcccagtaggtagcgaaatatcaatgcagtacaggcacgatggggcatgccctacgactacatttagcgaactgctcaacgctatccataatgaccgcggagattcaagcacactaaccaagcaggagctcaagtttattggaatctacaattcaaatgatgtggccgtgtcatttcctaacgtagtgtcagggtctggttcttctacacctgtgtcttcttcccacctgccccagcaatcctcaggccacctccagcaggtgggggcacttagccccagtgcggtgtcctctgccgctcccgcagttgccaccacacaggcaaacaccctgagtggcagttcattgagccaggctccgtctcacatgtatggaaaccgcagtaattcatccatggctgctctcatcgcccagtctgaaaacaaccagacagaccaggatctgggtgacaactctcggaatcttgtggggagggggagctctccacgtggcagcctctctcctagatctcccgtgagctccctgcagatccgatacgatcagccagggtag

SEQ ID NO: 30354 - DNA, 426 bp, Artificial Sequence
  Description of Artificial Sequence: Synthetic coding sequence
atggcagccgcacctccttcatactgcttcgtcgccttccccccacgggctaaagatgggctggtagtgttcggcaagaactctgctagaccaagagatgaggttcaggaggtcgtgtacttctcagccgctgatcacgagcccgagagtaaggtggaatgtacgtatatctccatcgaccaggtccctcggacttacgctatcatgattagccgtccggcttggctgtggggcgcagagatgggggcaaatgagcatggggtctgcattgccaacgaggccatcaacactcgggaacccgctgcagagatagaggccttgctcgggatggatcttgtgagacttggtctcgagcgcggtgaaaccgccaaagaagccctggatgtgatcgtgagcctgttggaagagcacgggcagggcggatag

SEQ ID NO: 30355 - DNA, 573 bp, Artificial Sequence
  Description of Artificial Sequence: Synthetic coding sequence
taacagctcgcagcactgaaagaaatccaggcagaagttcaggaaaaggaaagcgatgctgtgaagccaaagaatcaggacattcagggaggtaaagctgctcctgccgaggcgcttggcatacccgatgagcactacctcgacaacctgtgtattttttgcggtgaaagatccgaatccttcacagaggaaggtttagatctgcattattggaagcactgtctgatgctgacaagatgcgatcactgtaagcaggtggtggagatcagctcactaacggaacatttgctgacagagtgcgataaaaaggatgggttcggaaagtgttaccgctgttccgaggctgtttttaaggaagaactcccacggcatatcaagcacaaggattgtaatcccgcaaaaccggagaaactagccaatcgctgcccgttatgtcatgagaatttttcgccaggagaagaggcatggaaagcccaccttatgggcccagctggctgcacaatgaaccttaggaagactcatatccttcaaaaggctcctgccctacagccaggcgaggggcagcgaaggtag

SEQ ID NO: 30356 - DNA, 723 bp, Artificial Sequence
  Description of Artificial Sequence: Synthetic coding sequence
atgaccgtgggaaagtcatccaaaatgcttcaacacatcgattaccgaatgcggtgcatcttacaggacggcaggatcttcattgggacttttaaagccttcgacaagcatatgaaccttatcctatgtgattgcgacgagttcagaaaaatcaagcccaaaaactcaaagcaggctgagcgggaagagaagcgggtgctagggctggttctgctccgaggtgagaatttggtttccatgacggtagagggccctccccctaaggatacaggtatagcacgcgtcccgcttgccggagccgcaggaggccctggcattggtcgtgccgcaggtagaggtatccctgcgggagtcccaatgccgcaggctcccgctggcctcgctgggccagttaggggcgtgggagggccttctcaacaggtcatgacgcctcagggtcgaggcaccgtggccgctgcggctgcagcggctactgcatcaatagccggtgccccaactcagtatccccctggcaggggtggtcctcccccacccatggggagaggggcacccccacctggcatgatgggacctcccccaggtatgagaccaccaatggggcctccaatgggcataccacccggacggggaacccctatgggaatgccgcctccagggatgcgtcccccacccccaggcatgaggggtcctcctcctccaggtatgcgtccaccaaggccatag

SEQ ID NO: 30357 - DNA, 420 bp, Artificial Sequence
  Description of Artificial Sequence: Synthetic coding sequence
atggagacagattgtaatcccatggagctgtcctccatgtcaggatttgaagaagggagcgagcttaacggcttcgaaggaacggatatgaaggatatgcgcttagaggcggaggcagtcgtcaatgacgtgctgttcgcagtcaataacatgtttgtcagcaagagtctgcggtgcgcggatgacgttgcatacataaatgtcgagactaaggaacgcaacaggtactgtctggagttaaccgaagcgggactgaaggtcgtgggctatgcatttgatcaagtagatgatcacctgcaaacaccatatcacgagactgtctatagcctcctggataccctgagcccagcgtaccgcgaggccttcgggaatgctctgttgcagagactggaggctcttaaacgagatggccaaagttag

SEQ ID NO: 30358 - DNA, 606 bp, Artificial Sequence
  Description of Artificial Sequence: Synthetic coding sequence
atggccggactagaggtgttattcgcatcagccgcacctgccattacctgccgccaagatgcccttgtgtgctttctccactgggaggttgttacacacggctactttgggctgggcgtgggtgaccagccgggtcctaatgacaagaagtcagaacttttgcccgctggatggaacaacaacaaggatctgtacgtgctgcgttatgagtacaaagacgggtctcgcaagcttttggtgaaggcaatcactgtggagtcatctatgattctcaatgtcctcgagtacggcagccagcaggtggccgacctcacattgaacctggacgactacattgacgccgagcatttgggggattttcaccggtgcgacccacttgggcctttcgttgtgggtggagaggatttggaccccttcggacctcgccgaggcggtatgatcgtagatccactgcgctccggtttcccaagagctctgatcgatccctcctctggtttaccaaacagactccccccaggcgctgttcccccaggagcgcgtttcgatcccttcggcccaatcggcacctcaccaccaggacctcgtcctgatcgtcgcggacaatag

SEQ ID NO: 30359 - DNA, 747 bp, Artificial Sequence
  Description of Artificial Sequence: Synthetic coding sequence
atggctacgtctgccccactgagatccctggaggaagaggtgacctgtagtatttgcttagactatctacgagatccagtgacaattgattgcggccacgtcttttgcagatcctgcacaactgacgtcagacctattagcgggagcaggcctgtgtgtccactgtgtaagaagccatttaaaaaggagaatataagacccgtgtggcaactggccagcttggtggaaaacattgagcgtcttaaggttgacaaagggagacaacccggagaagtgacacgcgagcagcaagatgccaagctgtgtgagagacatcgggaaaagttacattactattgcgaggacgacgggaagctcctgtgtgtgatgtgtagagaatcccgagaacacaggccccacactgccgtactcatggaaaaagctgctcagccccaccgtgagaagatactcaaccatctctcgactcttcggcgagatagagataagatccagggcttccaagcaaagggcgaagccgatattctagcggctctcaagaaactacaggaccaacgccagtacatagtcgccgagttcgaacaagggcaccagttcctaagagagagagaagagcacctgttggagcaattagctaagttagagcaagagttaaccgaaggacgcgagaagtttaagtcccggggagtcggtgagctggcgcgattggccttggttataagcgaactggaggggaaggctcaacaatag

SEQ ID NO: 30360 - DNA, 1842 bp, Artificial Sequence
  Description of Artificial Sequence: Synthetic coding sequence
atggcaacaatcccagactggaagctgcaattgctggctcgcagacgtcaggaggaggctagcgttcggggaagagagaaggccgagcgggaaagattatcacagatgcccgcatggaagaggggactgctggagcgacggcgtgccaaactgggcctttcacccggagaaccttcccccgtactgggtacagtggaagccggaccgccagatccagacgagtctgccgtgctgctggaggccattgggcctgtgcaccagaatagattcataagacaggaaaggcagcagcaacagcagcagcaacagagatctgaagagctgttggctgagcggaaacctgggccactcgaggcgcgagagcgcagaccaagtccgggtgagatgcgcgatcagtctcctaagggtcgggaatcaagggaagaaaggttatccccccgtgagacgcgggagagaagactgggaattgggggtgcccaggagttgtcgttacgcccactggaggctagggactggcgtcaaagcccaggcgaggtgggggatcgctctagtcgcctctcggaggcatggaagtggagactgagtccaggagagactccagagcgctcgctcagactggctgaatcccgcgaacaatcacctcgcaggaaggaagtagagtcaagactatctcctggcgaatccgcttatcagaagctcgggctgactgaggcccacaagtggcggcctgactcccgcgagagccaagagcaatccctcgtgcagctagaagccaccgagtggcgcctccggtcgggggaggaacggcaggactattcggaggaatgcgggaggaaggaggaatggcctgtgcccggagtcgcccctaaggaaacagccgagttatccgagacactcaccagggaagctcagggcaacagttctgcgggtgtggaggccgcagagcagcggcctgtggaggatggtgaacggggtatgaagcccaccgagggctggaagtggaccctcaacagcggtaaagctcgcgagtggaccccgcgagacatagaggcccaaactcaaaagccagagcctcctgaaagtgctgagaaactgctggaaagtcctggagtggaagccggagaaggcgaagctgagaaggaagaggctggcgctcagggtcggcctctgcgggcactgcaaaactgttgctccgtgcctagccccctgccccctgaagatgcagggactgggggactgcgacaacaagaggaggaggcagtggaactgcaacctccaccaccagcaccactgtctccacccccaccggctcctacagcccctcaacctcccggtgatcccttgatgagtaggctcttttacggagttaaggcaggccctggggtgggtgcccctcgccgaagcggacacacattcaccgtgaacccccgaagatctgtgccacccgctaccccagcaacccctaccagtccggcaacggtcgacgccgctgttccaggcgctgggaaaaagcggtaccccacagccgaagagattctcgtcctcggtgggtaccttcgattgagccggtcttgtcttgctaagggatctccagagagacatcacaaacaactgaaaatcagctttagcgagactgcattagagacaacgtatcaatatccgtctgagtcatcagtgcttgaggagctaggccctgagccagaggtgccatcggccccaaatcccccagccgcacagccagacgatgaggaagacgaagaagagctgctgctcttacagcccgagctccagggaggcctccggaccaaggcacttatagttgatgagagctgtaggcgctag

SEQ ID NO: 30361 - DNA, 1620 bp, Artificial Sequence
  Description of Artificial Sequence: Synthetic coding sequence
atggcaacatctgcccctctcaggtccctcgaagaagaagttacatgctcgatttgcttagactacctgcgagatccagtcaccatcgactgcggccacgtgttttgtcgctcctgcacgacggacgtgaggcccatttcaggcagcagaccagtttgtcctctctgcaagaagccttttaagaaagagaacatccgccctgtttggcagctggccagcctggttgaaaatatcgagagacttaaggtggataagggcagacaacccggagaagtcacacgcgaacagcaagacgccaagctgtgcgagaggcatcgcgaaaaactgcactactactgcgaagacgacggaaagctgttgtgcgtaatgtgtcgcgagtcccgagagcataggccacacaccgcagtgctcatggaaaaagccgctcaaccacacagggaaaagatcctgaatcacctttcaacccttaggagagaccgggacaagatccaaggcttccaagctaaaggagaagccgatatcctcgccgcactgaagaagctccaggaccagaggcagtacatcgtggcagaatttgagcaggggcaccaatttttacgggagcgtgaggagcacctgctagaacagctggccaaactcgagcaagagcttacagagggacgtgagaagttcaagtccaggggcgtgggagagcttgcccgactcgctctggtgattagcgagctggagggcaaagcccaacagcccgctgccgaactaatgcaagatactcgagacttcttgaacagataccctcgcaagaagttctgggtgggtaaacccattgccagagtggtgaaaaaaaaaactggggagttctctgacaaactgctgagcctgcagcgagggctgcgagagttccaagggaaactcttacgggacctcgagtacaagaccgtgagtgtgacactggacccccagagcgcctcagggtatctgcaactttctgaagactggaagtgcgtgacctatactagcttatacaagagcgcatatctccatccacagcagttcgactgtgaacccggagtactaggaagcaaaggttttacgtggggtaaggtatactgggaggtggaggtggaacgggaaggctggagcgaagatgaggaggaaggcgacgaggaggaagagggcgaagaagaagaagaggaggaggaggcgggttacggcgacggttatgacgattgggagactgacgaggacgaagaatctctcggagatgaggaggaggaagaagaggaggaagaagaagaagtactcgaatcttgcatggtcggagttgccagagatagcgttaagaggaagggtgacctgtctctgaggcccgaggacggggtttgggcactccgactctccagcagcggcatttgggctaatacaagtcctgaggctgaattgtttcccgctctgagacctcgtcgagtgggaatcgccttagattatgaaggtgggaccgtgacattcaccaatgccgagtcccaggagcttatctacacctttacagccacgttcacacggagattggtgccatttttgtggcttaagtggcccggaacccgtctgctgcttaggccttag

SEQ ID NO: 30362 - DNA, 1089 bp, Artificial Sequence
  Description of Artificial Sequence: Synthetic coding sequence
atggctcccaaacccggtgccgagtggagcacagctttgtctcatctggtgctgggcgtcgtttccctgcatgcggctgtgagcactgcagaagcgtctcgcggtgctgccgcagggttccttctacaagtgctggccgcaactacgacccttgcccctggactgtctactcatgaagactgcctcgctggcgcttgggttgccacagttatcggtttgccacttcttgccttcgacttccattggtgtacaaacggccacctgatgtgtgccggatgttttattcatctgctggcagatgccagattgaaggaggagcaggccacctgtcccaattgtcgctgcgaaatatctaagtcgctgtgctgccggaacctggctgtagagaaagcagtgagtgagttgccatccgagtgcggcttttgtctgcggcaattccctcggagcctgctggaacggcatcagaaggaggagtgtcaggaccgagtgactcaatgtaaatataaacgtatcgggtgtccctggcacggaccctttcacgaactcactgttcatgaagctgcctgtgcacacccaacgaaaaccggctccgagttgatggagatcctggacggcatggatcagtctcacagaaaagagatgcagttgtacaacagcatcttttctctgttgtctttcgagaagatcggatacacagaggtgcagtttaggccatatcggacagatgattttatcaccagactgtattatgaaaccccgaggtttaccgtgttgaaccagacatgggtgcttaaggccagagttaacgactcagagagaaatccaaacctgagctgtaaaagaaccctgtcattccagcttctgttgaagtcgaaagtcactgctcctctcgagtgtagctttctgcttctgaaggggccttacgacgatgtgaggatctccccggtcatttaccactttgtctttactaacgagtccaatgagacagactacgtccccctgcctattatcgatagcgtggagtgcaacaaactgctcgccgcaaaaaatatcaacctgaggctgtttctattccagatccaaaagtag

SEQ ID NO: 30363 - DNA, 273 bp, Artificial Sequence
  Description of Artificial Sequence: Synthetic coding sequence
atggccatggctcctagcccatctctcgtccaggtttatacttcccccgctgccgtggctgtctgggaatggcaggatggtttgggaacttggcatccatacagcgccacagtctgtagtttcatcgagcagcagttcgtacagcagaaaggccagaggtttggcctgggatcactggctcactccattcctctcggccaggcggacccttccttggccccttacataatcgacctacctagctggactcaatttcggcaggacaccggatag

SEQ ID NO: 30364 - DNA, 2502 bp, Artificial Sequence
  Description of Artificial Sequence: Synthetic coding sequence
atggcagtggaggactctacgttgcaggtggttgttcgagtgcggcctccgacgccccgagagctggactcacagcgaaggcccgttgtgcaggtggtcgatgagagggtgctggtgttcaaccctgaggagcctgacggtgggttccccggactgaaatgggggggaacgcacgatgggccaaagaaaaaaggcaaggacctcaccttcgtgtttgatagggtgttcggcgaagcggctacccaacaagacgtgtttcagcatactacccactcagtgttggactcttttctgcagggttacaactgttcagttttcgcttatggcgcaacaggggcaggcaagacccacacaatgctgggacgcgagggagatccaggcattatgtacctgacaacagtggagctctataggagactggaggctaggcagcaagaaaaacattttgaggtgctgatcagctatcaggaggtgtacaacgaacagattcacgatctgctggagcctaagggccctctcgccattagggaagacccagataaaggcgtggtggtgcagggactttcatttcaccagcccgctagcgctgaacagctgttagaaatactgacccgtgggaacaggaatagaacacaacatcccaccgatgccaacgccacttccagtcgatcgcacgctattttccaaattttcgtgaagcagcaagatagggttccaggcctgactcaagcagtacaagtggctaaaatgtccctcattgacctagcgggaagtgagcgggcaagtagcacacacgcaaaaggcgagcgcttgagagagggtgcgaacattaatcggtcactcctcgccctcataaatgtgctcaacgccctggcggacgctaaaggtcgcaaaacccatgtgccctacagagactccaaactcacaaggctcctgaaggacagtttagggggaaattgcaggaccgtgatgatcgccgcaatctcacctagtagcctgacctatgaagacacctacaacaccctcaaatacgcggaccgagccaaggaaatccgtctgagcctgaaatccaacgtcaccagcctggactgccacatcagccagtatgccaccatctgccagcagctgcaggcagaggtagccgctctcagaaaaaagcttcaggtgtatgagggcggaggacagccaccgcctcaggacctcccgggttcccccaagtccggcccacctcccgaacacctgccttcatcaccacttccccctcaccctccatcacagccatgtactcctgagctgcccgcaggacccagagctcttcaggaggaaagtttaggcatggaagctcaggtggagcgcgctatggagggcaacagtagcgatcaggagcaaagccccgaagacgaggacgaaggcccagcagaggaggtcccgactcagatgccagaacaaaaccccacacacgcattgcccgagtctccccgtctaactctgcagccaaagcccgtggtggggcacttttccgcccgtgaactggacggggacagatccaagcaactggccctcaaggtgctgtgtgtggcccagcgccaatactctctgctgcaggctgcaaatcttctgactcctgacatgatcaccgaatttgagacgctgcaacagctcgttcaagaggagaagattgagcctggcgctgaggccttgcggacatcgggcctggccaggggcgcaccccttgcccaggaactctgttcggaatctatcccggtgcccagtcccctttgtccggagccccctggctacacagggccagtgacccggactatggcacgtcgactttccggaccactccacaccttgggtataccaccaggaccaaattgcacccccgctcagggcagtcggtggccaatggagaaaaaacgaagacgaccctccgcgttggaagcagattcacccatggctccaaaacggggaacaaagcggcagaggcaaagcttcctgccctgtctgcgccgaggcagcctgcctgatacacagccaagccagggcccatccaccccaaagggcgaaagagcgtcttctccctgccactctccaagagtttgtccggctacggtgatcaagagcagagtgccgttggggccaagtgctatgcagaattgtagcactccactcgctctaccaacacgcgacttaaatgcaacattcgacttaagcgaagaacctccttcaaaaccgtcattccacgagtgtattggatgggataagattccacaggagctctcccggctcgaccaacctttcatcccccgtgcacccgtgccactcttcactatgaaaggaccaaaacctacatcatccctgcccggtaccagcgcctgtaagaagaaaagggtggccagctcatccgtgagccatggcagatcgcgaatcgcaaggttgccctcatccactttaaagcggccagccggaccactagtgctccccggagactggcactag

SEQ ID NO: 30365 - DNA, 1842 bp, Artificial Sequence
  Description of Artificial Sequence: Synthetic coding sequence
atggccactattcccgattggaagctccaattgctcgccagaagacgtcaggaagaggcttctgtgagaggtagagagaaggccgagagggaacggttgtctcagatgccagcatggaaacggggtttgctggaaaggcgacgcgcaaaattaggactgtcccctggtgagccaagccccgttctgggtaccgtggaggccggacctccagatcctgatgagtccgctgttctgctcgaagccattggccctgtgcatcaaaacagatttattcgacaggagcggcagcagcagcaacagcagcagcaacggtcagaagaactcttggccgagaggaaacctggtcctctggaggcccgagagcgaagaccttctccaggcgaaatgagagatcagagcccaaagggcagggagtcccgtgaggagcggcttagcccaagggagactcgagaacggcgactgggcattgggggtgcccaggagttaagtctccggccattagaagcccgtgactggcgacagagcccgggagaagtgggggatcgtagttctagactgtccgaggcatggaagtggcggcttagtcctggcgagactccagaacgctcactgagactggccgaatcgcgggagcagagtccccgtagaaaggaagtggaaagccgcctcagtcctggagaaagtgcttatcaaaagttgggacttacagaagcccacaagtggcgcccagactccagggaatcccaggaacagtctctcgtgcagctggaagcaaccgagtggcgtcttaggtcaggcgaagagcggcaggactactctgaagagtgtgggaggaaggaggagtggccggttcccggtgtcgctcctaaagagactgcggaactctcagagacacttactcgagaagcgcaaggcaattcctcagccggtgtcgaggccgcagaacagcgccctgtggaagacggtgagagaggaatgaagccaacagaaggctggaaatggaccctgaactccgggaaagccagggagtggactccaagagacattgaggcgcaaacacaaaagccagaaccaccagagtctgccgaaaagctcctggaaagccccggagtggaggccggtgagggggaggccgaaaaggaggaggccggagcacagggacgacccctgcgggcactgcagaattgttgctccgtgcctagccctctcccacctgaggatgcaggcacaggcggtctgcgccagcaggaggaggaagcggttgagcttcagcccccaccaccagctcctctctcccctcctcccccagcccctacagctcctcaaccgccaggggaccccttgatgagtcggctgttctacggagtcaaagccggacccggtgttggggctcctaggagatctgggcatacgtttacagtaaaccccaggagatccgtacctccggctactcctgccacacctacatcgccagctactgtggacgccgcagtacccggagcgggaaaaaagcggtaccccaccgctgaagagatcctcgttctcggaggataccttcgactgagccgtagttgtctcgctaaagggagtcccgaaagacatcacaagcagcttaaaatttctttttctgaaaccgcactggagacaacgtatcagtatccgtccgaatcaagcgttctggaagagctggggccagagccagaggtgcccagcgctcccaacccacccgctgctcagccggatgacgaggaggatgaagaagagctgctgcttttacaacccgagctgcaaggcggtttgcgcaccaaagccctgatcgtggatgaaagctgcagaaggtag

SEQ ID NO: 30366 - DNA, 654 bp, Artificial Sequence
  Description of Artificial Sequence: Synthetic coding sequence
atgaatagtcaaccccagacaaggagcccgttcttccagagacctcagattcaacccccaagggccaccatccccaattcctccccctccattaggcccggtgctcaaacgcccactgccgtataccaagctaaccagcatatcatgatggttaatcacctcccgatgccatatcccgttccccaggggcctcaatattgcatcccccagtaccggcacagtgggcctccatacgtcgggcctcctcaacagtacccggtgcagcccccaggccctggccctttctaccctggcccaggccctggggattttcctaacgcctatggcactcctttctaccctagccagcctgtgtatcagagcgcgcctattattgtacccacccagcagcagcctccacccgcaaaacgggaaaagaaaaccataagaatccgggatcccaaccagggagggaaggacatcaccgaagaaatcatgtcaggcggaggttcgcggaaccctacacctcctattggacggcctaccagtaccccaacgcctccccagcaactgccgagccaggtgccagagcattcaccagtcgtatatggcacggtggagagcgctcacttagccgcatcgacccccgtgacagctgctagcgaccagaaatag

SEQ ID NO: 30367 - DNA, 969 bp, Artificial Sequence
  Description of Artificial Sequence: Synthetic coding sequence
atgtacttctgttggggagctgactcccgtgaactgcaaagaagaagaaccgccggttcccccggagctgagctcttgcaggcagcctccggcgagagacactctctcctgctacttaccaaccaccgggtcctctcttgcggcgacaatagccgaggacagctgggcaggagaggcgctcagagaggcgagttgcccgagccgattcaggctcttgagaccctcatagtggatttagtgtcatgtggcaaagagcattcgctcgctgtttgtcacaagggtagggtgtttgcctggggggcaggctccgaaggacagctggggatcggagagtttaaggagatttcttttacgcccaaaaaaatcatgaccctgaatgatatcaagatcatccaggtgtcctgcggacattaccactctctggcgctgagcaaggattcgcaggttttctcatggggtaaaaactcccatggacagctcggcctaggtaaagaattccccagccaggcatcgccacagcgggtgagatctctggagggaattccccttgcccaggtggccgcaggcggagctcattcatttgccctttccttatgtggcacttcttttggttggggatctaattctgctggccagcttgctttaagtgggagaaatgtgccagttcagtcaaacaagcctttgagtgtgggagcgctgaagaatttgggggtcgtgtacatcagctgcggagacgcccataccgccgttctcactcaggatggtaaggtttttactttcggtgacaatcgatctggacagctcggatactcccccacacccgaaaagcggggtcctcagctggtcgagcgaatcgacgggcttgttagtcagatcgattgcgggcgtcttcgagggtgcagttctcagacacatttctgctggaatatctgccagctgtgcgacaattcatcagttaaattggagtag

SEQ ID NO: 30368 - DNA, 1743 bp, Artificial Sequence
  Description of Artificial Sequence: Synthetic coding sequence
atgagagccctgactgtccagcgtgtgaaatttgctatggatctgccgcttctgaagagggcgggacaggatctggccgagaaaacaaagaacttcgtgtccaggtccctagtcattggggaagtgctcagtatggcagatatggccactggggtcaagtgtggcatcatttactggcttttcggcggagctattcggaatctggggtcaccagaacatgtgaccaaatggtttcagcccctgcaggaacagaagtacacaggtatgttcgcaatgacagagcgaggccacggttccaacgcccgtggaatccaaaccgaggcgacatttgatctcagtgcccaagaattcgtgattgacacaccctgcgagaatgcagagaagatgtacattgggaacgccatgtacgggaactacgccgcagtgttcgcccagctcatcattgatggcaggagtcagggtccgcattgctttattgttcctgtgagagatgaaaatgggagcctctaccccggagtcactgctatcgatatgatgtacaaggaggggctacatggagttgataatggcatccttatcttcgacaaggtgcgcattcctagagaaaacctcctggataaattcgggagcgtggctcccgacgggcaatatcactcccccatccggaacaaatctgccagattcaacgccatgctcgccgcactcacccctagcaggctggctgtggccttccaggcaatgggtgctatgaagctgggcctgactatagctatcaggtatagccacagtagacgccagttcggacccaagactaaagaagaggtaaagatcattgagcatcagacccagactctgagactgatgccacatctggcgaccgccctggccctgactttcgtttctcgctatgcaggcgcattgctcgacgaggacgtgttccagggcaaggaactcgtcaattcccgctcactgcaggcactggtggccggactgaaagcttacagcacttgggagaatattagatgcctgcaggactgcagagagtgcaccggcggaatggtggtggggagagagctcttggcccagtataccaagcagtacgaagagaaaccgttatttgggctgctacagaattgggctgagtctgtgggtgataaacttcggacttcattcctggcattcaacatggatacagtggacgacctcgccttccttcttaaagccgttaagttcagggagagagtgctgcaaagaggactcgtggcaaggatctactataaggttaagactaaaaaagaggacttttttcatgcctggaacagctgcttgcaccatgtcgcttccttatccctcgctcacactcaccgggtgactctggagcagttcagcctggcggtgaaatcttgtcccgaccaggaggatcagacactacttatgaagttttgtttgctgtacggaaccaagttggtctttcaggagagagcatggtatctcgaacataaatacctgacacccatggcgagtactcgcataaggaaccagctgctggatttgtgtgactccgtgaaggacgatgctcgaagggtgatctccacgtttaatatcccacatacatatctgcacgcaccaatcgctggcatttcaaatccccgagcagcatgggccttttacccagcaccactccagccccgaccaagagaagaagccagatctagaagaccgaaactgggcgctaaactttag

SEQ ID NO: 30369 - DNA, 561 bp, Artificial Sequence
  Description of Artificial Sequence: Synthetic coding sequence
atgggagtgaatcagtccgtgggttttcctccagtcaccgggcctcacctcgtggggtgcggggatgtgatggagggccagaatttgcaggggagcttcttccgactgttctacccgtgtcagaaagctgaagaaacaatggagcagccgctgtggattccacggtatgagtattgtaccgggctcgcggagtacctgcagttcaacaagcgttgcggtggtctcttgttcaatttggcagtcggtagctgtcgcctccccgtgtcttggaacggacccttcaaaaccaaagattcagggtaccctttaattattttctctcatggtctcggcgctttcagaaccctttattccgccttctgtatggagttagcatcccggggattcgtggtcgccgtgcccgagcatagatgtgtgtactttagggacagatcagcagccacaacatatttctgtaagcaggctcctgaggagaaccaacccactaacgaaagcctccaggaggagtggatacccttccggagggtggaggagggagaaaaggagtttcatgtccgctag

SEQ ID NO: 30370 - DNA, 1620 bp, Artificial Sequence
  Description of Artificial Sequence: Synthetic coding sequence
atggccacctctgccccactcagatctctggaggaggaggtaacctgctccatctgcttagactatcttagagacccagtcaccatcgactgtgggcacgtgttctgtaggtcctgtacaactgacgttaggcccatttctggcagccgaccggtgtgcccgctatgcaaaaagccctttaagaaggagaatatccggcctgtgtggcagcttgcatcgctggtcgaaaacattgaacgtctcaaggtggacaagggtcgccaacccggagaagttacccgggagcagcaggacgccaaactttgcgaacgccatcgagagaaactgcactattactgtgaagatgatggtaaactcctctgcgttatgtgcagagaatccagagagcacaggccacacaccgctgtcctgatggagaaagctgctcagcctcacagagaaaagattttaaaccacctctctaccctgagacgcgatagagataagattcagggcttccaggcaaaaggtgaggctgacatcctggctgccctcaaaaagctgcaagatcagagacagtacatcgtagccgagtttgagcaggggcatcagttcctgagggaacgtgaggaacacctccttgaacaacttgccaagctggagcaagaactgacagaaggacgggaaaagttcaaatctaggggagtcggtgagctagcaagactcgccctcgtcatcagtgagctcgagggcaaagcccaacagcctgccgcagagctcatgcaggacacgagagatttcttgaaccgctaccctaggaagaaattttgggtaggcaaacccattgcgcgtgtagtgaagaagaagacaggggagttttcagataaactgctgagccttcagagaggactgagggagttccagggtaagcttctgcgcgatctcgaatataagaccgttagcgtgacattagatccacagagcgcatccggctatctgcagctttcggaggactggaagtgtgtgacctatacatctttgtataaatctgcttatctgcacccacagcagtttgattgcgagccgggagtcttgggcagcaaaggcttcacatggggaaaagtgtattgggaggtggaggtggagagggaggggtggtctgaagacgaggaagaaggcgacgaagaggaggagggagaagaggaggaggaagaagaagaagctggatacggggacgggtacgatgactgggagacagatgaggatgaggagagtctgggtgacgaagaagaggaggaagaagaggaagaggaagaggtcctggagtcctgtatggtgggcgtcgccagggatagcgttaagcgaaaaggtgacctctccctgcgaccggaggacggcgtgtgggcacttaggctgagttcttccgggatctgggcaaatactagccctgaagcagagctgttcccagcactgcgtccgcgacgggtgggcatcgcactggattacgagggtggcacggtgaccttcacaaatgccgagagccaggagttgatctacacctttacggccaccttcacacggcgtctggtcccatttctatggctgaagtggcccggtacgagactcctcctacgcccttag

SEQ ID NO: 30371 - DNA, 2613 bp, Artificial Sequence
  Description of Artificial Sequence: Synthetic coding sequence
atgagcaggaaccctagctctaatagtccagaagaggataccgtccccgtgcccaaaggatctgtccccgctgccagaccaagccgcggaggcatgagtgtcgtcggtatagatttaggcttcttgaactgttatatcgccgtggcccgtagcggtggaattgaaacaatagccaacgagtattccgataggtgtacacccgcttgtatttctcttggaagtaggacccgtgccatcgggaacgccgcaaagtctcagatagtaaccaacgttaggaataccatacatggcttcaagaaactccacggaagatcatttgacgacccaatcgttcaaactgagcgaattcggcttccatatgaactccagaaaatgcccaacggaagcgcaggagtgaaggtgcgctacctggaagaagaaaggcctttcgccatagaacaggtaactggcatgctgctcgccaaactgaaagagacatccgagaatgccctgaagaaaccggttgccgattgtgtgatttcgatcccctcgtttttcacggacgctgaaaggcgttcagtgatggctgcggcacaagtggctggactgaactgcctccggcttatgaatgagactaccgcagtggccctggcttacgggatctataaacaagatttgcccccacttgatgagaagcctagaaatgtggtgtttatcgatatgggccacagcgcctaccaggtgctggtctgcgctttcaacaaaggcaaactcaaggttcttgcgaccacgtttgacccttacctcggcggtaggaactttgacgaagcgctggtcgattacttttgtgacgagtttaaaaccaagtataagattaacgtgaaggagaattcaagggcattgttaaggctgtatcaagagtgcgaaaagttgaaaaaacttatgagcgcaaacgcaagcgacttaccgttaaacatagaatgcttcatgaatgaccttgatgtgagctcgaagatgaatcgggctcaatttgagcagttgtgtgctagcttgctggcacgggtggagcctcctctaaaggctgttatggaacaagcgaatctgcaacgcgaagacatctcctctatcgagatagtcggcggagccacaaggatacccgctgtgaaggaacaaatcacaaagttttttttgaaggacatctctactacactgaacgccgacgaagccgtggctcggggatgtgcactccagtgtgcaattctgagccccgcattcaaggttagagaatttagcatcactgacctggtgccttactccatcactttgcggtggaagacctcattcgaggatgggtccggggagtgcgaggtgttctgtaagaaccaccccgctccgttctccaaggtaattacattccataagaaggagcccttcgaacttgaggccttttacacaaacctgcacgaggtgccataccctgatgcaaggatagggtcctttactattcagaacgtcttcccgcagagcgacggcgattcctctaaagtgaaggtgaaagtacgggtgaatatccacgggattttctccgtagcgagtgcgtccgtcatcgaaaagcagaacctggaaggcgaccacagcgacgcacccatggagaccgaaactagttttaaaaatgaaaacaaagataatatggacaagatgcaagtggaccaggaggagggacaccaaaaatgtcatgctgagcacacacccgaggaggagattgaccacaccggcgcaaaaaccaagtccgcggtttccgacaagcaggatcgtctgaaccagaccctgaagaaagggaaagtcaaatctattgacctgccaattcagtcctccctctgtcgacagctgggtcaggatcttctgaattcctatattgaaaatgaaggtaagatgatcatgcaagacaagttggagaaggaacgaaacgacgccaaaaacgctgtggaggagtacgtgtatgacttccgtgatcgactggggaccgtttatgagaagttcattactcctgaagacttgtccaagctctcagccgtgctggaggacaccgagaactggttatatgaagacggcgaagatcaacctaagcaagtgtatgtggataagctgcaggagctgaagaagtatgggcagccgattcagatgaaatacatggaacacgaagagcggccaaaagctctgaacgacctaggcaagaagatccagctcgtgatgaaggtgattgaggcataccgcaacaaagacgaaagatatgaccatctggaccccaccgagatggaaaaagttgaaaagtgcatcagtgacgcaatgtcctggcttaatagcaaaatgaacgcacagaacaaactgtctctgacccaagacccagtcgtaaaggtgagcgaaattgtagccaaaagcaaggagcttgataatttttgtaatcctatcatatacaagcctaagccgaaggcggaggttccggaagacaaacctaaggccaatagtgagcacaacggacccatggacgggcagtcaggtacagaaaccaagagcgatagtactaaggatagtagtcagcacacaaagtcgtctggcgagatggaggtggattag

SEQ ID NO: 30372 - DNA, 5462 bp, Artificial Sequence
  Description of Artificial Sequence: Synthetic coding sequence
atggagccgcctcaggaaaccaaccgacccttctccacacttgacaacaggtccggccaggtccaggttttgtctgctactcctcttttgcagaggaacccctacagcagccctgatattatgcacataaaaggtagtgaagccagtagtgtgccatacgcacttaaccagggaaccactgcactaccaaagaataagaaccaggaggggactggacaccgtcttcttaacatgttgcgcaagactctcaaagaatctgactctgaggaattagaaatcacgcaggagacgcctaacctggttcccttcggagatgtagtcgggtgcctggggattcacatcaaaaactgcaggcactttatgcccaagattagcttacagcactacgccaacctattcatcaggatatctattaataaagctgtgaaatgcaccaaaatgtgcagtttgttgtcaaagaacgatgaaaaaaatacggtgatcaaatttgacgaagtgaagtattttagcgtccaggtgccacgcagatatgacgacaagcgtaacaatattctccttgagctgatccagtacgataatagagagaaaagagccttcctgttagggagtgttcagatccacctgtacgaagtgattcagaaggggtgctttatcgaggaagttcaagtcttacatggcaacatcttcgtatgtcggttagaggtcgaatttatgtttagctacggcaactttggctacggcttttcccatcaactgaagcccctgcagaagattaccgaacccagcatgttcatgaacctggcgccaccacccgaaaggaccgatcccgtcaccaaagtcatcaccccacagacagtggaatacccagcattcctgtcaccagacctgaacgtcacagtcgggactccggcagtccagagctcgaaccagcctagcgtagtgaggctcgagaagctgcagcaacaacccagagaaagactggagaagatgaaaaaggagtataggaacctcaatacttggatcgacaaagcgaactacctggagtccattctgatgccaaaactggagcataaggacagtgaagagactaacattgatgaggcatccgagaatacaaaatcgaaccatcccgaggaagaactggagaacattgttggagtagatatccctctcgttaacgaagaggctgagaccactgctaatgagctgttagataacgactccgagaagggtttgacaatccccacgcttaaccagagtgatcaggataattctaccgctgacgccagcaaaaatgacgagtctacccccagtcccaccgaggtccacagcctctgtaccatctccaatcaggaaacaatcaaggccggacgtattcccccactgggggagaggcagtccgagtccatgcccgatcggaagatgaaaaacgttttctttcctttagaagtgaagctgaaagataactacccctctatcttgaaggcagattcaagcctctcagaagtcgcattttctccgaaggagtacaactccccatccttccgccctgaatatatcgaattcaagccaaaatttcaattccagaaatttaataaaaatggctttgaccccttcctcagaaatatcaataaaatgtctgtaaggaagagaaaggatcaggatatctataaatatcggaacatcctcggcgcagaggtgattgagcacgaagaccaggaccccccatatcctgctcagtcaaagacagcagggcctgccaatactacatgggcccatgatcctaacatctttactactaaaatgcttgagacagaaaacaagctcgctcccgatcctacgataaatacaatcaagggcttagacaccaaaaattctctgaaggaaaaccttcccaacgtctccctgcctagcatcaaaggtgagagctctcgggcagggaacgtgcaggcaaacacatgtcacctctccaagtcactcaactttacccctcacattgaatatctaaaacagtcaatgattctaaaatcaattctttccgagaacctccaggacctgagcgataaattgttttccaagcctgaagtctccatgaactcagaggcgagagagaaatcgtcctccccattactctcgattcacgacaaatcttccagcagtatggaggataacgtgctagagaagaagcaagacttaaacaactggcttagcgaaaaggatattctgaattcgaaaaccacactgtctcagattataaagaatatacccgcagatagtttcagcgaaggtagccaaattatcgagaatattccagcggactccctattggaagggggtcaggtgatcaaaaacatccctgaatatagcctcagcgaaggaggccagatcattaagaatatccctgccgactccttcctcgagtccggtcccggacagagtcctgaagtggaagaacacgtctccaaaaaacactttgaggccgatgagagggatttccccattaagaagaacagctccaccaagaagaaacacttgatttctgaggtgcccaactcgaaatctgggagctccggcacagtgcacgactacatcatgcggcagatcttcactgcccctattttctcagagctcgaaattgaggtgaaagagccttccgaaacacctatgaacttggagaaccagcttcccacgccttggaagaggtccttatcttctcacattctcttccatgaggaaaacgcggacgagattgagttgcctcagccccgtagcgcaacttcacagatcatccaagcatttccgatcgatactctactggaatcagggatcatcaaagtgattgaattagacaaggaacaccacaagtcctcgttgctgggtaccggtatcacttcaccaaaaggcaacctgaaggattctcaggaatactacagtgaaattcgaagtgagacagaaccgttatcagagcagagcattcccattattccgaaagacacgacatccgtgtctcgcgcagaattcattcaggaagaccagaacatgttcccccaagatagcagctattactcaatagccaataaggagctttacctgcctagaaacgggcagcgcctttgcaaggacaagaacgacctgagcagtacattggagtccctcacgaacagtctgatggacaaactcagtgagagcgacgagattatgttaaaatcttttctgaagaacatcttcaatgtgttcttcaagtacaaccactccgaaagacgagggcagcccgaaaaagaactcgagcgtttgatacagccttctttcacctccgacacagaacacctggaggaactgcaggaggatttcgacaaggccgataagttggaccgcaagcccatcttatcgcctaagctgagagttttcctggaagagctgagtgaatctgaagtcaaacacctgaagagcgaactgagcaagcagattcagcactatttggtagaacgcttatctgagtccggacacatcaccaaggaggatctgcccaagatctaccagaacctctacctgatgaatgaaaaagctgaacagaaggggcctaacagtttccagggtaagtattctgagactgtcaaagagataatgtccttcgtgaacaattttaatcaccactttatcgataagcacctagaaattaaattgagatcttttctcaaggaaatcttgcagaattacttcctgaaaaacatctctgagagcagcttatttaacgaaactgcatccgagaccatctatcccaacatctcttcactgcggacaaaatccgtgagcatctcattccacgaactcgaacaggacatatcaaagggcagtttcggtcgcagatttgagatcaacatgaagtacccactgtctaagtctcttcaaaactaccttatcgcactttccgagaacgagttgttacacctcaaggccgacctgagcaagcacctgcagtccctttttatcgagaagctgagtaagagcggactcatgaccaagaagcagctggaagggattaaccaacacataaacctcttgaattccagttccattcccctgaaatacattaaaacacatctgccctttcgggacgactgtcacttcgttgagaagcacagcgaaaagcagaataagtattcacggatagtgcagcagacgaccctccagacggtctctgaggacaaacttagagaggccgagcttattagagaaaaagagaagaaatactttcccctccaaaatctgaagggcaactctagcctgatcaaagaacagaaatcatattatactaaagaggaagcaaaaaccccctcactaatcaaggtccagccaagctccaatgaaaacattcaggcctcccccttatcaaagtcttcagaaattctgacggacattttgcttaagaagctccggaaggaacacgtattcacccagttaccccaagccgagaatagtgtgcacaaaactgaaatccaggatccatactcctggggaggcaagagtaagatcactcaaagtaaggcttggtgtgagaagaccctgaagatgaagagtctggaccggaaagaacatgttaacatctataaatggactgtacaagaaaagcccgaggccgtgctgacctcatatccgcgaatcccaaatgcgcgaatgcccagggaagacgagtatctgaataggattacatttccgagctggcagagctctacacttacccatttcaacaccgaaacgggagaaaaatccaagctcgaagaccagtactgccaaaccctgaaagggaacaataataacaacaagaaacacctggtgaccttcgcccagtataagaaggagattcagaccctgtacattaaaccggatgagatctgctctgaaaaatgtgccaaatttcccgagatacagtcgtttcaatacaaagtcgtggaggacgagaagaacttgaaacctcatttgtttccggagctttttaagattgaagacctgaaacccaaagtgcgtaaagagagagatcgggtcgcacagcccaagaaatcatttaataagatagtcagaattcttccaacaacactccctacaactaggattcacctgaagaagtctgttcctcgcacactcttgcactggaccgcaagacgtaccatccacgactgttcagacaagtttgaagaccttcatgatatgacgtcttttacccacctcaagaaagtgaaatcaagatcacggcttctgggtaagtcctcagacgacattcacaaccatgcacgccatagcgcccgaccttacactgcccctgaggtgaataaacaaagagagtcttactccggcaaatttaccagtagacgcatggtttcctctggacttgtccacatcaacgataagacaagtgattatgaaatgcataagatgcggcctaaaaagataaagaggggttacta

SEQ ID NO: 30373 - DNA, 498 bp, Artificial Sequence
  Description of Artificial Sequence: Synthetic coding sequence
atggagccgactcgcgactgccccctctttgggggtgcattcagcgctatcctcccgatgggagctattgacgtgtcagacctgcggccagtgcctgacaaccaagaggtattctgccaccccgtcaccgaccagagcttgatcgtggagctcctggagctacaggctcatgtccgtggcgaggctgcagcgaggtatcactttgaggacgtggggggtgtgcagggagccagggccgtccatgtagagtccgtccagccactatcgctcgaaaatctggctttgcgtgggaggtgccaggaggcttgggtgttaagcggtaagcaacagatcgcaaaggagaatcaacaggtcagagccagggagtgcgtgatgagttggaagggtggcagcggcgacgcggaaattcaggtttctatcttgaccttgatccctcttggttccaaggggagggatacctctagcggtttggccgaggctgcacccgtgccagattag

SEQ ID NO: 30374 - DNA, 4482 bp, Artificial Sequence
  Description of Artificial Sequence: Synthetic coding sequence
atggcctccataacacagctattcgatgacctatgtgaggcgctgttacccgcagccaaaacccacctgggtcaacgctccgtgaatcgcaagcgggctaagcggagtctgaagaaagtagcgtataacgccctcttcactaacctgtttcaggacgagacccagcagctacaacccgacatgagcaaactcccggctagaaacaagatcctcatgctgtcattcgacctgagggtagggggactgggcccaaaggcagaccggctcgaagaactggttgaagaactggaggcagcaccctgctgtcctttacttgaggtaggctccgtccttgatctgttggtgcagctggcaggttctggtcctccccaggtcctgccccgaaagcgcgattactttctcaacaacaagcacgtgggacggaacgttccatatagtggatatgactgtgatgacctgtcagtatttgaaatggacgtgcagagcctcatcagtcgggaagaatgcctgtgccactccatgatccaagagacccttcaggtgatggaggccgctccagggacaggattacctacagtcggattgtttagctttggggatccatgtggtgatcggttcgagagagatactagagtttctttgttcggcgcactcgtgcactcaaggacctacgacatggatgtgcgcctcggtctcccacccgtcccagacaatgctgacctcagcggactcgccatcaaggtcccaccttctgtggaccaatgggaggatgagggttttcagagcgcctctaatttaacacctgactcacagtcagagcctagtgtcaccccagatgtggatctatgggaagcggcactcacctatgaggctagcaaaaggcgttgctgggaaagagtggggtgtcctccaggccacagagaggaaccatacctgacagaggctggcagagatgccttcgataaattctgtaggttgcaccagggcgagctgcagctcctcgcaggcggagtgctgcaggcaccccaacccgtactcgtgaaggagtgcgagctggtcaaggatgtgcttaatgtgctaattggtgtggtttccgctactttctccttgtgccagccagcacaggcctttgtagttaagagaggcgtgcacgtaagcggcgcttctcccgaaagcatcagcagccttcttagcgaagtagctgagtacggcacatgttatacacggttgtcccatttttctcttcagccggtgctggactcactatactctaagggactggtgtttcaggcctttacctcaggtctccggcgttatcttcagtattaccgcgcatgtgttctcagcacccctcccaccctgagcctgctgactatcggttttctttttaaaaagcttggaagacagctccgatacctcgccgagctgtgcggggtgggcgctgtgctacccggaacctgtggaggcggacccagagcagctttcccaactggtgtcaagctgctttcttacttataccaggaagcgctccataactgttcaaacgaacactaccctgtactgctcagcctgctgaagaccagctgcgagccctatactcgtttcattcatgactgggtgtatagcggagtatttagggacgcatatggtgagtttatgattcaggtgaaccatgagtatctgtccttccgcgataagctgtactggacccacggctacgttttgattagcaaggaagtggaggactgcgttcctgtgttcttgaagcacattgctcacgatatttacgtgtgtggcaaaacaatcaaccttctgaaattatgttgtccacgccattacctttgctggtctgacgtgcctgtgcccagaataagcgtcattttttctctcgaggaactcaaggagatcgagaaggattgcgcggtgtatgttggcaggatggaaagggttgccaggcacagcagcgtgagtaaggaggaaaaggagctgaggatggagatcgctaagcaagagttaattgcccacgctcgtgaggcggcaagccgcgtcctgtcagccctctccgaccgccagatgtctgaacgtatggccctggacgcaaggaagcgggagcaatttcagagactcaaagaacagtttgtaaaagaccaggaacgccgacaagcagctaggcaggaggagctcgacgatgactttagttatgccagagagttgagggacagagagcgtcgcctgaagagcctggaagaagagctcgaacggaaagctcgccaggctcttgtcgatcactattctaaattgtctgcagaagctgccaggcgtgagcagaaggcattgtggcgtatccagcggcatagattggagagtgccagactccgcttcttgttggaggacgagaagcatatccaagagatgctgaaggctgtttctgaggcccaccaaccccaggaaccacctgacgtcctgctctcagtccatccccaggtgacaagtcccggacccgaacacccagagggtggtcaaggctgtgattcgggatcagcagagcagcattccccagcatgggacggttggaaccggcctggcctcctgaccccgcagcctttgaaaccattggcagtcggtgccggaggtcggggactgcaacaagctgagggtgccagacccttctcagactccctgagtatcggagacttcttacctgtgggacctggcgcagagcccagcgtgcagaccggcatggtgccccttctggaagtggctcttcaaactatcaaccttgatctgccaccgagtgcccctggggaggcacccgctgccgcttctactcagccttcaagaccacaggagtacgacttttccacagtgctgaggcccgctgtggcaaccagcccagccccaggccctttgcaggcggctgagtgttccctgggaagctcaggcctccaactgtgggaggattcttgtggaaaaatggacgcatgtggctccgcatcccgggagacgctccttccctctcacccccctcgaagagccgcactcgaggagggttcatcgcaacccaccgagcgcttgttcggccaggtgtccggcggaggcctcccaaccggcgattatgcctccgagatcgcccctacccggccacgatggaatacccacggccacgtatcagacgcttctatcagagtcggcgagaatgtcagcgacgtcgctcctacccagcctagatggaacacacacggacacgtcagcaacgcatccattagcctgggcgagtctgtgtccgacgtcgcccctaccagacctcgctggaatattcacggtcatgtgagcaatgcgtccatcagggtcggtgaaaacgtatctgatgtggcgcctactcggccacgatggaatacgcacggacatgtttcaaacgcatctattagagtcggcgagaacgtgtccgacgtagccccaactcggccacggtggaatacccatggccacgtgagtgatgcttcgatctcccttggagagagtgtgagcgacatggctcccgctcgccctcgttggaacacgcacgggcatgtctctgacgcctccatcagcctcggcgagtctgtgtccgatatggcacccacaagaccaagatggaatacccacggccatgtgtcagacacttcaatccgagtgggggagaatgtatcagacgtcgctcccatccgcagtcgctgtaatacccacggccacgttagtgatgccagcatcagtttaggtgaacccgtatcggacgttgttagcacgagacctcggtggaatacccacgtgcccattcctccgcctcacatggtgttaggcgctctgtcccctgaggcagaaccaaacaccccacgtccacagcaatcaccccctggacatactagtcagtccgccctttctctgggtgctcaatcaaccgtgttggattgtggccctcgccttccagtcgaggtaggaccatccttgtcatccccttcttctgggtgcggcgagggttcgatctctgtcggggagaatgtttctgacgttgctcccacacagccttggtggcctaatacaccaggagatagcgtctcggaggaactgggtcagagtagagtcgctggcggacaggaatgggattgtggtacccaccgcgcttgggaagccctggggggagctgggacattaaggacctccttgcagatcggactgtccacacacaggaagacccagctccccagagctgcacaggctgtcgttagacggcgtcgccaccgacggagaaggctgcgggtcggttcccgccctacttggcaggcgtggcagggctcaactacctggtccggaactagaaccgtgacaagcccttgcccaagccgccctcttctgattttttgtgcgccttgcttccccggtccgagcccaagcccatggaccccaagatcgtccctccccctgatgcgactgctctgcagctag

SEQ ID NO: 30375 - DNA, 1077 bp, Artificial Sequence
  Description of Artificial Sequence: Synthetic coding sequence
atggcccctcagaacctgagcacattctgcctgctacttctctatctcattggcgcagtcatagccggtcgggacttctacaaaatcttaggcgtgccccgttctgctagcataaaggacatcaagaaggcctataggaagctcgcgcttcagcttcatccggacagaaaccctgacgatccgcaggcccaagaaaaattccaggatctgggcgcagcatatgaggtgctctctgactctgaaaagaggaagcagtacgatacatacggtgaggaggggttgaaagacggccatcaaagcagtcacggggatatcttttcacactttttcggcgactttgggtttatgtttgggggtactccacgccagcaggaccgcaatattccaaggggcagtgacattattgtggatctagaagtgactttggaagaagtgtacgcgggaaatttcgtggaggtcgtccggaacaaaccagttgctagacaggcccctggcaaacgcaaatgtaattgtcgccaggagatgcgcaccacccagttagggcctggacgattccagatgacccaggaagtagtttgcgacgagtgccctaatgtgaagcttgtcaacgaagaacgaactctggaagtggagattgagcctggagtccgggatggcatggaatatcccttcattggagagggcgagccccacgtggatggtgagcccggtgacctccgcttcaggattaaggtggttaagcatcctatattcgaacggcgaggtgacgatctctataccaacgtgacgatcagccttgtggagtctctggtgggcttcgagatggacatcacccatttggatgggcacaaagtgcacattagcagagacaaaattactcgccctggtgccaagctgtggaagaagggtgaaggtctccctaattttgacaacaacaatatcaagggatcactgattattacattcgatgtggattttcccaaggagcagctcacagaagaggctcgtgagggcatcaagcagcttctgaagcaaggttccgtgcagaaagtttataatggccttcagggctactag

SEQ ID NO: 30376 - DNA, 2757 bp, Artificial Sequence
  Description of Artificial Sequence: Synthetic coding sequence
atggcttctctgagtcgggctctgagggtggctgcagctcatcccagacagagtcctacacggggaatggggccatgcaacctgagtagtgctgccggtcccacagccgagaagtccgtgccctaccaacgaaccctgaaggaaggtcaaggcacgtctgtggttgcgcagggcccttcccgtcccctgcccagtaccgctaacgttgtcgtcattggcggtggcagcttgggatgtcagaccctgtaccatctggcaaagctgggtatgtctggggcagtcctcctagagagggaaaggctgacttctggcacaacatggcataccgccggactgctatggcagttaaggccatccgatgtggaagtagagctcctcgctcataccaggagagtagtgtcacgggaactcgaggaggaaaccgggctgcacacggggtggattcagaacgggggactgtttatcgcatctaataggcagcgcttagacgaatacaagagattgatgtcactcgggaaagcctacggggtggaaagccatgtgctgtcacctgccgaaacaaagaccctttaccccctgatgaatgtcgacgatctctatggcaccctgtacgtcccccatgacggcacgatggatccggctggcacgtgcacaaccctggctagggctgcctccgccagaggggctcaagtgattgagaattgccccgtaactggtatccgagtctggacagacgacttcggggtgaggcgtgtagcaggggtggagacacagcatgggtctatacaaaccccctgcgtcgtgaattgtgcaggtgtctgggcttccgccgtaggccgaatggcaggcgtcaaggtgccactggtagcaatgcaccatgcctacgtggtcacggaaagaatcgaaggcatccaaaatatgccgaatgtgcgcgatcacgacgcttccgtctatctccgcctccagggggacgccctgtccgttggcggatatgaagcaaaccccatcttttgggaggaagtgagtgataagttcgcattcggactcttcgaccttgactgggaagtatttactcaacatatagagggtgctatcaaccgagtgcccgtcctcgagaaaacagggattaagagcaccgtatgtggcccagaaagctttactccagaccacaagcccctcatgggtgaagcacccgagctcagaggcttttttctgggctgtggcttcaattcagccggaatgatgcttggtgggggatgtggccaagaactagcccactggataatacatggccgacctgaaaaagatatgcacggttacgacataagacggtttcatcattctctcaccgaccacccaagatggatccgagagcggtctcatgaatcttacgctaagaactactctgtagttttcccacatgacgagcccctggctgggagaaacatgcgacgcgatccacttcatgaggagctactcgggcaaggttgtgtttttcaggagcgccacggctgggagagacctgggtggtttcatccccgaggacctgcccctgtgttagaatatgattactacggagcctacggaagccgtgcccatgaagattatgcctatagaaggctgctggccgacgaatataccttcgcatttccaccccatcacgacactattaagaaagaatgtctggcatgcagaggggctgcagccgtgttcgatatgagctacttcggcaagttttaccttgtaggactcgatgcacggaaagccgctgattggttgttttccgctgacgtgtctcgccctcccggatcaacagtgtatacatgcatgctaaatcacagaggtggtaccgaaagcgatcttacagtttctaggctggctccatcacaccaggcgtctccactggcccctgcgtttgagggcgacggatattacctggcaatgggcggtgccgtcgcgcagcataactggagccacattaccacagttctccaggatcagaaaagccagtgtcagctgatcgattcatccgaggatttagggatgatcagtattcagggacctgcctctagggcaatcctgcaggaggttctcgacgcagatttaagcaatgaggctttccccttctctacacacaagctgctgagagcagccggacacctagtgcgtgctatgcgcctgtctttcgtcggagaactcggctgggaactgcatataccaaaagcctcctgtgtgcccgtatatagggccgtgatggcagctggggctaaacatggtctcatcaatgccggttatagagctatagatagcttaagcattgaaaagggctataggcattggcatgccgatctgagaccagatgacagccccctggaagctggactagccttcacctgcaagttaaagagccctgtgcctttcctcggacgggaagcacttgagcagcagcgagcggcaggactgcggagaaggctggtctgctttacgatggaggacaaagtgcccatgtttggactcgaggcgatctggagaaatggacaggttgtgggacatgtgcgacgcgctgactttgggttcgcaattgacaaaacgatcgcatacggttacattcacgacccgtccggcggaccagtatctttggacttcgtcaagagcggcgactatgccctggaacgtatgggcgtcacgtacggagctcaagcccatctgaaaagtccctttgatccaaacaataagcgagtaaagggcatttattag

SEQ ID NO: 30377 - DNA, 222 bp, Artificial Sequence
  Description of Artificial Sequence: Synthetic coding sequence
atgtcctatcagcagcagcaatgtaagcagccatgtcagccgcctccacccgtgtgccgactgcccaagcgtccagaaccatgtccaccactcaagtgtccggagccatgcccacctcctaagtgcccccagccttgtcccccacaacagtgtcagcaaaagtaccccttagtgacacctagtcccccatgtcagcccaaatgtcccccaaaatccaagtag

SEQ ID NO: 30378 - DNA, 576 bp, Artificial Sequence
  Description of Artificial Sequence: Synthetic coding sequence
atggggaagaaaaccaagagaaccgcagattctagctcctctgaagacgaggaggagtatgttgtcgaaaaggtgctggatagaagggttgtaaagggacaggtggagtatctcttgaagtggaaggggtttagcgaggagcacaacacgtgggagccagaaaaaaatctagattgccccgaactgatttcagagtttatgaaaaagtataaaaaaatgaaggagggcgaaaacaacaagcccagagagaagagtgaatcaaataaaagaaaatcaaactttagcaacagtgctgacgatatcaagtccaaaaaaaagcgggagcagagcaatgacatcgcaagaggcttcgagcgcggacttgagcctgagaaaattataggcgctaccgattcatgcggcgatctgatgtttctgatgaagtggaaagatacagacgaagccgatcttgtgctggccaaggaagctaacgtgaaatgcccgcaaatagtgatcgctttttacgaggaacgactgacttggcacgcttatccggaggacgcagaaaacaaagagaaggaaaccgctaagtcatag

SEQ ID NO: 30379 - DNA, 60 bp, Artificial Sequence
  Description of Artificial Sequence: Synthetic coding sequence
atgctgaagaataagggacactcctcaaagaaggataatctggccgtaaatgccgtgtag

SEQ ID NO: 30380 - DNA, 1026 bp, Artificial Sequence
  Description of Artificial Sequence: Synthetic coding sequence
atggaaagcaatttcaaccaggaaggagttcctagacccagttacgttttcagcgctgatccaatcgcaagacccagcgaaatcaattttgatggcattaagcttgatctgtctcatgaattttctctggtggctccaaacaccgaggccaactctttcgagtcaaaggattatctgcaggtttgtttgcgcataagacctttcacccaaagtgaaaaggaattggaaagcgaaggatgcgtacatattctggactcccagacagtagtactgaaagaaccacagtgtattcttggtagacttagcgaaaagtcttcagggcagatggcacagaaattcagcttctccaaggtctttggcccagccacaacgcaaaaggagttcttccaaggatgcatcatgcagccggtcaaggatctgctgaaagggcagtcccgcttaatcttcacgtatggcttgactaattctggaaaaacatatacattccaaggcaccgaagagaacattgggatcttgccacgcacactgaatgtgctatttgactccctgcaggagaggctttataccaagatgaaccttaaaccccacaggtcacgagaatatttacggctgtcctcggaacaggaaaaggaagagatagcttctaaaagtgctctcctccggcagatcaaggaagtgactgtacacaacgactccgacgacacactgtatggcagccttactaactcgttgaatatcagtgagtttgaggagagcatcaaagattacgagcaagccaaccttaatatggctaatagcattaaattttccgtgtgggtgagcttctttgagatttacaacgagtacatctacgacttgtttgtgccagagctggcgaaaacaaagggagaactgatcaagactaaggaggagctgaagaagcgtgagaatgagtctgattctctgatccaagaattagaaacgtccaacaagaagatcattactcagaatcagcgcattaaggaactgataaatatcatcgactag

SEQ ID NO: 30381 - DNA, 27 bp, Artificial Sequence
  Description of Artificial Sequence: Synthetic coding sequence
atggctgacacagacctgttcatgtag

SEQ ID NO: 30382 - DNA, 2628 bp, Artificial Sequence
  Description of Artificial Sequence: Synthetic coding sequence
atgatgtacacagtgctcccggatggttcgcccgttcctcaggggatggcattgtacgccccacctccccctttaccaaacaattcccggccactgactccaggtaccgtggtgtacggccctccgccagccggagcccctatggtctatggcccaccccctcccaatttttctattccgttcattcctatgggcgtcctacactgtaacgttcccgaacatcacaatttagagaatgaggtcagtaggctggaggacattatgcagcacctgaaaagtaaaaaacgggaggagaggtggatgagagcctctaaaagacagtccgaaaaggaaatggaagagctgcaccataacatagatgatctgctccaagagaagaagagccttgagtgcgaggtcgaggagctgcatcggactgtgcagaagcgccaacaacagaaggattttatcgacggaaacgtggagagcttgatgactgaactggaaattgagaagagcttgaagcaccacgaggatattgtggatgaaattgaatgtatagaaaaaacactcttgaaaagacggagcgagcttcgcgaggccgatcgactgctcgcagaggcggagagtgaactaagctgtactaaagagaagaccaagaatgccgtggagaaattcaccgatgctaaacggtccctactacagactgaatctgacgccgaggagctcgagagaagggcccaggagaccgcagtgaatcttgtgaaagccgaccaacaactgagaagcctccaggccgacgcgaaggatctagaacagcataagataaaacaggaagagatactgaaagagataaacaagatagtggccgctaaagattccgactttcagtgtctgtctaagaaaaaggagaagcttactgaggaactgcagaagttacaaaaagacatcgaaatggccgagcggaacgaagaccaccatcttcaagtgctgaaagagtctgaggtgctattacaggcgaagcgagcggagctggagaagctgaagtctcaggtcacctctcaacagcaggagatggccgtgctggataggcagttgggacataagaaagaagagttgcaccttcttcagggtagcatggtgcaagcaaaagcagacctgcaggaggcactgcggctcggggaaaccgaagtgactgaaaagtgtaaccacatccgcgaagtcaaatctctgcttgaggaattaagctttcagaaaggagaactgaacgtgcaaattagtgagcggaagacccagctcacgttaattaaacaggaaatagagaaagaagaagaaaatctgcaggtggtcctgcggcaaatgtcgaaacacaagactgaactgaaaaacattttggatatgcttcaactggagaaccacgagctgcagggcctgaaactgcagcacgatcagagggttagcgagttggagaagactcaggtggcagtacttgaggaaaagctcgagctggagaatcttcagcagatatcccagcagcagaagggcgagatcgaatggcaaaaacagcttctggagagagataagcgcgaaatcgaacggatgaccgcggaaagcagggctctgcaatcatgtgtggagtgtttgagtaaagagaaggaggatctgcaggagaaatgtgatatttgggaaaagaaacttgctcagaccaaaagagtcctggccgctgctgaagaaaatagtaaaatggaacagagtaacttggaaaagctggagctgaacgtgcgcaaacttcaacaggagctggaccaactcaaccgcgataagctctccctccataatgacatcagcgccatgcagcaacagttgcaagagaagcgagaagcggtgaactcactgcaggaggagctggcgaacgttcaggatcacctgaacctcgctaaacaggacttgctgcatactactaagcaccaggacgtgcttctgtcagaacagacccgcctgcaaaaagacatttctgagtgggccaacaggttcgaagactgccagaaggaggaggaaactaaacagcaacagctccaagtgctgcagaatgagatcgaagaaaataagctgaagttggtgcaacaggagatgatgttccaaagactccaaaaggaaagagagtcagaagaaagtaaactggagacaagtaaggtaacgctcaaggagcagcagcatcaattggagaaagagttgactgaccagaaaagcaagctggaccaggtactgtccaaggtacttgcggcagaagaacgtgtcagaaccctgcaagaagaagagagatggtgcgagtctctcgagaagaccctgtctcagactaagcgacagctgagcgaacgcgagcagcagcttgtagagaagagcggagagctgctggctcttcaaaaggaggctgactccatgagagcagatttcagtctccttcgcaaccagtttctcactgaacggaaaaaggcagagaagcaggtggccagcttgaaggaggccctgaaaatccagcgctcacaactcgagaagaatcttctgaccgcccgtgaggccgaggctcagaaactgaagaagcaggtgtgtgcgcaaaaggcacagctggcaagtttaggccgtgaatag

SEQ ID NO: 30383 - DNA, 1188 bp, Artificial Sequence
  Description of Artificial Sequence: Synthetic coding sequence
atggaacccccacaggagaccaaccgaccattctccacactggacaacaggtcgggtcaggtccaggttctatctgccacgcctctattacagcgaaacccttacagctccccggatataatgcacatcaagggatctgaagcatccagcgtgccttacgctctcaatcagggaacgacagcgctgcccaaaaataagaaccaggaaggcacaggacatcggcttctgaatatgctgcggaagacgctgaaagagagtgatagcgaagaactcgaaattacccaggagacccccaatctcgttccattcggagatgtggtagggtgtctgggcatccacataaaaaattgccggcactttatgcccaagatctctctgcaacactatgctaacttgttcatccggatttctataaataaggcagttaagtgcaccaaaatgtgtagcctgcttagtaaaaatgacgagaagaacactgtgattaaattcgatgaggtaaagtacttctccgtacaggtgcccaggcgatatgatgacaaacggaacaacattctccttgaactgatccagtacgataaccgcgagaagcgtgcattcctattgggcagtgtacagatacacctttatgaggtcattcagaagggctgctttatcgaggaagtccaggtgttgcacgggaacatcttcgtttgccggctggaagtggaattcatgttctcatatggaaattttggttatggattttcacaccaactcaagcctctccagaagattacagagccatccatgttcatgaatttggccccacctccggaaagaaccgacccggtgaccaaggtgattactcctcagacagttgagtatcccgcattcttgtctcctgatctcaacgtgaccgtgggaacacccgcagtgcagtcctcaaatcaaccatccgtcgtgaggctcgagaagctacagcagcaacccagagaaaggctggagaaaatgaagaaagagtaccgaaatctgaacacatggattgataaggcaaactaccttgaatctattctcatgcccaagctcgagcacaaggactcggaggagacaaatattgacgaggcatcagaaaataccaagagcaaccatcctgaagaggagctggagaatatagttggcgttgggggatttttcactaagaggatatag

SEQ ID NO: 30384 - DNA, 282 bp, Artificial Sequence
  Description of Artificial Sequence: Synthetic coding sequence
atgtcttactatcaacgtcccttctcaccatctgcgtactcactgccagcgtccctcaatagctccatcgtcatgcagcacggaacttcgctggactctactgacacttatccccaacacgcgcagtctctggacggcacaacatctagcagcatccctctttacagatcctcagaggaggaaaaacgtgtcacagtcatcaaagcaccccattatcctggaatcggacctgttgatgaatccggaatcccaactgctatccgtacgactgttgatcgatag

SEQ ID NO: 30385 - DNA, 558 bp, Artificial Sequence
  Description of Artificial Sequence: Synthetic coding sequence
atggccgctagtgtggaacagcgcgaagggaccatccaggtccagggtcaggccctgttttttagggaagcactgcccggttcaggccaagctagattcagcgtcctgctacttcatggaataaggttttctagcgagacatggcagaacttagggacattacatcgattggcacaggctggttatagggcggtggccattgaccttcctgggcttggtcattctaaggaggctgctgccccagctcctataggcgagctggcccctggttcatttctcgcagccgtggtggacgctctggagttaggccctcctgttgtgcctgtcgcgcctatctgcactgacaaaatcaatgccgctaattacgctagtgttaaaactccagccctgatcgtgtacggcgaccaggaccccatgggacagacatcatttgaacatctcaaacaactgccaaaccacagagtgctcatcatgaagggagctggtcatccgtgctacctcgataagcccgaggaatggcatacaggacttctcgacttcctgcagggcctacaatag

SEQ ID NO: 30386 - DNA, 1443 bp, Artificial Sequence
  Description of Artificial Sequence: Synthetic coding sequence
atgctcgagagacctcccgctttagccatgccaatgccaaccgagggcacacccccacctcttagtggaacgcccattccagtgcccgcttatttcagacacgccgaacccggtttctccctgaagcgcccacgcggactgtcacggagcctaccgcctccccctcccgctaaagggagcatccctatttcaaggctgtttccaccaagaacaccaggctggcaccagctgcagccaaggagggttagttttcgcggagaagcatccgaaaccctccagtctccaggatatgatccatcacggccagagtcatttttccagcagagcttccagaggctttctagactgggccatggcagctacggcgaagtcttcaaggtgagaagtaaagaggatggcagactttacgcagtgaaacgaagtatgagccccttccggggtcccaaagacagagccagaaaactggccgaagtcggaagtcacgaaaaggttggccagcatccttgttgtgtgcgcttggaacaggcatgggaggagggcggaattctgtatctgcagaccgagctgtgcgggccatctttgcagcagcactgtgaggcttggggggcttcgctgccagaggcccaggtctggggctacctacgcgatacgttgctggccctggcacatcttcactcccagggtcttgtccacctggacgtgaagccagccaatattttcctgggccctagggggaggtgtaagcttggcgacttcggactgttggtggagctgggcactgcaggcgctggcgaggtacaagagggggacccacgctacatggctcctgaacttctccaggggtcatacggaacagctgccgatgtgttttctctggggcttacgattttagaagtcgcctgtaatatggaactcccgcacgggggagaagggtggcaacagctgcgccaggggtacctgccccctgaatttactgcaggactgagtagtgagttacgatctgtgttggtcatgatgttagagcccgatccgaagctgcgggcaactgctgaggcgttgctggcacttcctgtactgagacagcccagagcttggggcgtgctctggtgtatggctgccgaggccctgtctagaggctgggccttgtggcaggctctcctcgcactcctatgttggctctggcatgggctggcacatcccgctagttggctacaacccctcggtccacccgctactccgcctggaagccctccatgcagtttactcctagatagctccttgagtagcaattgggacgatgacagcctgggtcccggtcacccgccttgcctcgcttgtccccctgcaggactgcactcacctctcaggcttagctggcccggactgtggggggcaccacctcctccaggagctggagcacacccaggtatgccttggacctag

SEQ ID NO: 30387 - DNA, 1740 bp, Artificial Sequence
  Description of Artificial Sequence: Synthetic coding sequence
atgtcagctgctaatcctgagacgcccaacagcacaatttctcgggaagcttccacacaaagttccagcgccgctgcttctcagggctgggtcctgcctgagggaaagatcgtgccaaacacagttttcgtcggtgggatcgacgcaaggatggacgaaactgagatcggatcctgtttcgggaggtatggctccgtcaaggaggtgaagatcatcactaaccgaaccggagtcagcaaagggtatggctttgtgtccttcgtcaacgacgtggacgttcagaaaatagtggggtctcaaattcatttccacgggaaaaaactgaagctcggccctgcaattcgcaagcagaagctgtgcgctagacatgttcaaccgaggcctctcgtagtgaatcccccacctccccctcagttccagaacgtttggagaaatccaaacacagagacttatctgcagcctcagattacacctaaccctgtaacacagcatgtccaatctgccgctaatcccgaaacccccaattctaccatctctcgcgaggcaagcacccaatcttcaagcgctgcagccagccagggctgggtgctccctgaaggtaagatcgtgccgaacaccgttttcgtagggggaattgatgccaggatggatgagaccgaaatcggaagctgtttcgggagatatggtagcgtgaaggaggttaaaatcattactaatcgtaccggcgtcagcaagggttacggttttgtatccttcgtcaatgatgttgatgtgcagaagattgtcggatctcagattcacttccacggaaaaaagctcaagctggggcctgctattcgcaagcaaaaactttgtgcccgtcacgtccagccacgcccactcgtagtgaacccccctccccctccacaattccagaatgtttggagaaaccccaacacagaaacctacctgcagccacagattacacccaaccctgtgacacagcacgtgcaggcctacagcgcgtaccctcactctcccggacaggtgataaccgggtgtcagttactggtatataactaccaagaatatccgacctatccagacagtgcctttcaggttactacgggataccaactgccagtgtataactaccagccattcccggcttacccgaggtcccccttccaggtgactgctggctatcagctccctgtgtataactatcaggctttccctgcatacccaaacagtcccttccaggtcgctactggataccagtttccggtttacaattaccaaccgttccctgcgtacccatcgtcgcctttccaggtgaccgcgggttaccaactgcctgtgtacaattatcaagccttccctgcctatccaaattcccctttccaggtggcgactggttaccagtttccagtgtacaactaccaggctttcccagcgtacccaaattcacccgtccaggtgactaccggctaccaactgcctgtttataactaccaggcttttcctgcctatccgtcgtcacctttccaggtgactacaggttaccagctccccgtgtataactaccaggccttccccgcttacccaaactctgctgtgcaggtaactacaggttatcaattccatgtgtacaattaccagatgccccctcagtgtccagttggagagcaaagaagaaatctctggactgaggcatataaatggtggtatctggtctgcttgatccagaggcgcgattag

SEQ ID NO: 30388 - DNA, 975 bp, Artificial Sequence
  Description of Artificial Sequence: Synthetic coding sequence
atggaggctctggggcctgggggagaccgggcttcgcctgcaagtagcacatcctctctggatttgtggcacctttctatgcgcgcagattctgcgtattcctccttctccgctgcatcagggggaccagaacctagaacccagtcccctggtaccgaccttttaccatacctggactgggactacgttcgtgtagtctggggcggtcccggacccgctcccccagatgctgcactttgtacctcaccacggcctcggcctgcagtggccgcacgctccggccctcagccaactgaggtgccgggaacacccggacctttgaatcgccaggcaacacctttgctgtacgccctggcagctgaggccgaagctgccgctcaagctgctgaacccccttcccctccagctagccgcgcagcttacaggcaaagattgcagggagctcaacggagggttttgagggaaactagctttcagcgtaaagagcttcgcatgtctttgccggcaaggctgagaccaaccgtgcctgcaagaccgcctgccacacacccacggtccgcatcgttgtctcacccgggaggagagggtgagcccgctcgatcgcgagccccagctcccggtacagcaggcagagggcctcttgccaaccagcagaggaaatggtgcttttcggaacccggtaagctggatagagtgggaagaggaggcggacctgcacgggaatgtttgggtgaagcctgcagctcgtccggcctgcctggcccagaaccacttgaattccagcatcctgcattggcaaaattcgaggaccatgaggtcggctggttgcctgagacacaaccacaaggctccatgaatctggatagtgggtcacttaaactgggtgatgccttccggcctgcctcaaggtcgcgttccgccagcggggaggtgttaggctcatggggtgggagcggcggaactatccccatttag

SEQ ID NO: 30389 - DNA, 780 bp, Artificial Sequence
  Description of Artificial Sequence: Synthetic coding sequence
atgcccagagccagatcaggtcggagatcccggggagcgggaggccgagaggagacgtttctgcgggtgcgcgcaaatcggcaaacgagactgaacgctcggatcgggaagatgaagagaagaaaacaggacgaaggtcagcgtgagggcagctgcatggctgaggatgatgccgtggatatcgaacacgagaacaacaataggtttgaagaatatgagtggtgtggccagaagcgcatcagagcaacaacgttgctggaaggaggcttccgtggcagcgggtttattatgtgcagcggtaaagaaaatcccgactcagacgccgaccttgatgtcgatggcgacgatactctagaatacggaaagcctcagtacactgaggccgacgtgatcccctgtacaggagaggagccaggagaagctaaagaacgggaagcgctacggggagctgtactgaacgggggaccccctagcactcggatcacccctgagttctctaaatgggcttcagatgaaatgccttccaccagtaatggtgagtcctccaagcaggaggctatgcaaaagacttgcaagaattcggatatcgagaagatcacggaagactcagcagtgacaacatttgaagccctgaaggcgagggtccgcgagcttgaacgacaactgagcaggggtgacaggtacaagtgtcttatttgtatggactcttactccatgcccttgacatctatccaatgctggcatgtccactgcgaggagtgctggttgaggaccctgtag

SEQ ID NO: 30390 - DNA, 369 bp, Artificial Sequence
  Description of Artificial Sequence: Synthetic coding sequence
atggccacaagtgccccactgcggtccttggaagaggaggtgacctgtagtatctgcctggattacctccgggaccccgtcacaattgattgtggccacgtcttttgccggtcttgtaccaccgatgttcgtcctatatctgggtctcggccagtgtgtcctttgtgtaagaagccgttcaaaaaagagaatatacggccagtttggcaattagcctccctggtggagaatatcgagcgactgaaggtggacaagggcaggcagcctggcgaggtgactcgcgagcagcaagatgccaaattatgcgaacggcatcgcgagaagcttcactactactgcgaagacgatggcaaattgctgtgcgtctag

SEQ ID NO: 30391 - DNA, 984 bp, Artificial Sequence
  Description of Artificial Sequence: Synthetic coding sequence
atggcgtcattccttaagggcgcacacgtcacaattaatgccagggctgaagaggatgtcgaaccagagtgtatcatggaaaaggtggcaaaggcctccggggcaaattacagttttcataaggagtctgggcgttttcaggatgttggtccgcaagcccctgtgggatctgtctaccaaaagactaacgctgtgtctgaaattaagagagtaggcaaagattccttttgggccaaggccgaaaaggaagaggagaacaggcggttggaggaaaaacggagagccgaggaggcccaaagacaactggagcaggagcggagagaaagggaactgcgcgaagcggctcggagagagcagaggtatcaggaacaagggggtgaggcaagcccccagcggacgtgggagcagcagcaggaagtcgtctctcgtaatcggaacgagcaggagagcgccgtccacccgagggagattttcaagcagaaggagagagctatgtccacaacgtctatatcttcgccacagcccggaaaacttagatcccctttccttcaaaagcagctgacccagcccgagacccactttggtagagaacccgcagctgcaatttcccggccacgcgctgacctacctgctgaggaacccgctccaagtacacctccctgtctggttcaagccgaggaggaggcagtctacgaagagccacctgaacaggagacattttatgagcagccgcctttggttcagcagcagggcgcaggtagcgaacatattgatcaccacatacaggggcaggggctatccggacaagggctgtgtgcccgtgctttgtatgattatcaggcggcagacgacacagagatcagctttgacccagaaaacttgatcactgggatcgaagttattgatgagggatggtggcggggttatggcccagatggtcactttgggatgttccctgctaactatgtcgaactgattgagtag

SEQ ID NO: 30392 - DNA, 438 bp, Artificial Sequence
  Description of Artificial Sequence: Synthetic coding sequence
atgcagggacgtattaccaaagtgctgaatatgaaacctcctgagatcctgtcaatgatagaagaagccgcaggcacaagaatgtatgagtataagaaaatagctgcacagaaaaccattgagaagaaggaagccaagctgaaagagatcaaaacgattctcgaggaggaaataactcccactatccaaaagcttaaggaggaaaggtctagctacctggagtatcaaaaggtgatgagggagattgagcacctttcacgtctgtacatcgcctatcagttcttgttggccgaagatacaaaagtacgtagcgctgaagaactgaaagagatgcaggacaaagtgatcaagttacaagaggaattgtctgagaacgataagaagatcaaagctctgaatcacgagatcgaagagctggaaaagagaaaagataagtag

SEQ ID NO: 30393 - DNA, 816 bp, Artificial Sequence
  Description of Artificial Sequence: Synthetic coding sequence
atggagaaggagactggtattagtcagcagcgcaactactattttacccaatcaaagggagagccccttcagatcgaccacctcgtgttcgtagtacacggtatcggtccggcatgtgatctcagatttcgtagtattgtacagtgtgtgaacgatttccggtctgtctcactgaatctgttgcagacccactttaagaaagcccaggaaaaccagcaaattggacgcgttgagtttctccccgtgaattggcactctccactccattctactggcgtcgatgtagacctgcagcgaatcactctgccatctatcaataggctgaggcattttaccaacgacaccatccttgatgtcttcttctacaattcaccgacatattgccagaccatagtggatacagttgcatccgaaatgaaccggatctatactttattccttcagcggaacccagatttcaaggggggagtttccatcgctggacattcgctcggatccctcattttgtttgatattctcacgaaccagaaggattctctgggggacatcgactctgagaaggactcgctgaacattgttatggaccaaggtgatacacctaccctagaggaagacctgaaaaaactccaattgtccgaattttttgatattttcgaaaaagaaaaagtggacaaggaggcacttgccctttgtaccgatcgcgacctgcaagagatcggaattcctctggggccacgcaagaatctctcaagtgcagtggccgtaattttagagatggtgaccatctggatgctcgccttagggcgttgcctctag

SEQ ID NO: 30394 - DNA, 1818 bp, Artificial Sequence
  Description of Artificial Sequence: Synthetic coding sequence
atgggcggatgtttctccaagcccaagcccgtggagctgaaaattgaggtcgtgttgcccgaaaaagagcgcggtaaagaggaattatctgcctccggaaagggcagccctcgggcatatcaggggaacgggacggccagacacttccacactgaagaaagactcagcaccccacatccatacccctccccccaggattgtgttgaggcagcagtgtgtcatgtgaaggatctcgagaatgggcagatgcgggaggttgagttaggttgggggaaagtcctgctggtgaaagataatggggagtttcatgccttagggcataagtgtccacattacggagccccactcgtgaagggcgtgctgagtagaggtagggttagatgtccatggcacggtgcatgtttcaacatctccaccggggaccttgaggactttcccggtcttgacagcctccacaagttccaggtgaaaattgagaaggagaaggtttacgtgcgcgcttcaaagcaagcattgcagctccagcgcaggactaaagtcatggctaagtgcatctcaccatccgctggatactcgtcatcaacgaatgtcctgatcgttggcgcaggagctgcaggtttggtgtgcgcagaaactctcaggcaggagggtttttctgatcgcattgtcctgtgtaccctcgacagacacctgccatatgaccggccaaaactctctaaatcactggacacccagcccgaacagctggccctccgccctaaagagttctttagagcatacggtatcgaagtgctgactgaagcacaggtcgtgactgtcgacgtacgcacaaaaaaagtggtgtttaaagatggttttaagctcgaatactctaaactcctgctggcccctggttcttcacctaagacactctcatgcaaaggaaaggaagtggaaaacgtcttcaccattcgcaccccagaagatgctaatcgcgtcgttcgtctcgccagggggaggaacgtggtggttgtcggagctggcttcctaggtatggaggtggccgcatatttaactgagaaagcacactctgtttccgtggtcgagctggaagagacccccttccgcaggttcctgggagagagagttggccgagccctgatgaaaatgttcgaaaataaccgagttaagttttacatgcagactgaggtatccgagcttcggggacaggaggggaagttgaaggaggtggtccttaaaagctctaaagtggtgagggccgatgtgtgtgtagtgggcattggagctgtccctgctaccgggttcctccgtcagagcggcatcgggcttgattcccgcggtttcatccctgtcaataaaatgatgcagacaaatgtcccaggagtgttcgctgcaggagatgctgtcacgttccctcttgcttggagaaataacaggaaagtgaacattccacattggcaaatggcccacgcccagggcagagtggcagctcagaacatgctggcccaggaagccgaaatgtctacagtaccttacctttggaccgcaatgttcgggaagtcccttagatacgccggatacggggagggcttcgatgacgtgatcattcagggcgacttggaggaactaaaatttgttgcattttacaccaagggagatgaagtgatcgcagtggctagcatgaactacgatccaattgtgagtaaggtcgcagaggtcctggcttcaggacgcgctattcgaaagcgcgaggttgaactctttgtgttgcacagtaagacaggggacatgtcttggctaactggcaaggggagctag

SEQ ID NO: 30395 - DNA, 294 bp, Artificial Sequence
  Description of Artificial Sequence: Synthetic coding sequence
atgcagacctcaagctcccgctctgtccatctctccgagtggcagaaaaattactttgccatcacaagcggcatttgcaccggaccgaaagcggacgcctaccgggctcagattctgagaatacaatatgcctgggcaaactccgagatatcacaggtgtgcgctaccaaactgtttaagaaatacgctgaaaagtactcagccattatcgacagcgacaacgtcgaatctgggctgaataattatgcagagaacattttgacactggccggttcccagcaaacagactcttag

SEQ ID NO: 30396 - DNA, 333 bp, Artificial Sequence
  Description of Artificial Sequence: Synthetic coding sequence
atggaagagatccctgcccaggaggccgcaggctcaccacgagttcagttccagtctctggaaacccagtccgagtgcctgtcccccgagccccagttcgttcaagataccgacatggaacagggtctcacaggcggaatcctgctgcgacttccaactacccggatccactcagtcaactcgtgtccagcactgtctcacacccaggctagcgcattctccggagagactctcgccgtgctgacagctggaatctctaaaaggtggcccaaatataggctcccaatcgacatcgcaaggccctgctcggaaacgcccttcccccgattgtag

SEQ ID NO: 30397 - DNA, 627 bp, Artificial Sequence
  Description of Artificial Sequence: Synthetic coding sequence
atggagccaccgatggagccatcaggtggagaacaggagcccggtgccgttcgctttctggatctgccatgggaggatgtgctgcttccgcatgtgctcaatcgagtgccactgcggcagctcctgaggctacagagggtcagcagagcctttcgatcgctggtgcaactccatctggccggtctgagacgatttgacgccgctcaggtcggtccccaaataccccgtgctgccttagctcgtctgttacgcgacgctgaggggctgcaggagctcgccttggcaccgtgccatgagtggctctcggacgaagacttggtcccagtcctggcaagaaatccccagctgcgttctgtagcgttgggcggatgcggacaactcagccgaagggcccttggggctctggccgagggatgtcccagactccagcggctctcccttgcccactgcgactgggtcgacggcttggccctgaggggactagcagatagatgccctgcactggaagaactggatctgactgcgtgcagacagcttaaggacgaggcgattgtttacctggcccaaagaaggggcgcaggccttaggagtctgtcgctggcagtcaatgctaacgtgggcgactag

SEQ ID NO: 30398 - DNA, 1419 bp, Artificial Sequence
  Description of Artificial Sequence: Synthetic coding sequence
gtgacacactacaaacagtatcctcccaatacatctaaggtgtacagctacttcgaatgcagggaaaagaagaccgagaattcaaagttaagaaaggtgaagtacgaggagaccgtcttctacggccttcagtatatattaaacaaatacctcaaggggaaggtggtcacaaaggaaaaaatccaggaggcaaaagacgtctataaggagcactttcaggatgacgtggttaatgagaaaggctggaactacatcctggaaaaatacgacggacacctccctatcgagatcaaagctgttcccgagggttttgtgattcccagagggaatgttctttttaccgttgagaacacggaccctgaatgctattggctcacgaactggatcgagaccattttagtgcagagctggtacccaatcaccgttgccaccaattctcgcgaacaaaaaaaaatcctggccaagtatctgctggagacttctggcaatctagacggactggagtacaagctgcacgattttggataccggggagtgtcgagccaggaaaccgccggtatcggcgcttcagcccacctggtcaattttaagggtacagacacggtcgctggcctcgctctcaacaagaaatattacggcaccaaggaccctgttcctggatatagcgtgcccgctgcagaacactcaactattactgcgtggggtaaagatcatgaaaaagatgccttcgagcacattgtaactcagttcagcagcgttcccgtctcagtcgtgtcgaattcctacgacatctacaatgcttgtgagaagatatggggagaggacctgcgccatctgatcgtgtcccgaagtacgcaagccccactgattatcaggcccgactccgggaatcccctggacacggtgctcaaggttctagagattctaggtaagaaatttccggtgacagaaaacagcaaaggctataagctacttccaccgtatttgagagtcatacagggcgacggtgtggacattaacacccttcaggagatcgtcgaaggaatgaagcaaaagatgtggtccatcgaaaatattgcattcggctccggtggcggactccttcagaaacttactagagacttgctcaactgcagttttaaatgcagttatgtagtgaccaatgggctgggcattaatgtcttcaaggaccccgtggcggatccaaataaacgcagcaagaagggtaggttgtccctccatcggaccccggctgggaattttgtgactctggaagaaggaaaaggagacctggaagagtatgggcaagatctgttacacaccgtttttaaaaacggtaaagtaactaagagctatagttttgatgagatccgcaagaacgctcagttgaatatcgagctggaggcagcgcaccattag

SEQ ID NO: 30399 - DNA, 519 bp, Artificial Sequence
  Description of Artificial Sequence: Synthetic coding sequence
tgcaagcaatccacgaagaccgaggaaaagcttagaccaactcggacctcatctgaatctatatatagcagacccggtagctccatccccggaagtccagggcacactatttatgcgaaagtggataatgagatactggattataaggacctggcagccatccctaaggtaaaggccatatacgacatcgagcggcctgatctgatcacctatgagcccttttatacctccggctacgatgataagcaagaacgccagtctcttggagaaagtccgagaactctttccccaactccaagtgcagaaggctaccaggacgtgcgggataggatgatccaccggtcaacatctcaggggtctattaattcacccgtctactcacgccatagttatacacctacaacatcaagatcccctcagcactttcatagacccgatcagggaattaacatatacagaaagcctcccatatacaaacagcacgtgctattcgaagtgatcctgctcttgctaatttag

SEQ ID NO: 30400 - DNA, 2445 bp, Artificial Sequence
  Description of Artificial Sequence: Synthetic coding sequence
atgagactgctggatggcaagcagacgagccgctacagcgagaatgcttgcgagaagaaaatcttcagcatatacggacattacccggttgtcagggctgccctgcggagaaaaggttgggtggaaaagaagttccattttctcccaaaggtgattcccgacgtggaggacgaaggcgcacgggtcaacgacgatacatgtgccaaagtaaaggagaatcaggaaatggccctcgaaaagactgataatatacatgacgtgatgagcaggcttgtgaaaaatgagatgccctacctcctgtggacaatcaagcgcgatatcatcgactatcactccttgacctacgatcagatgttaaatcactacgccaagactgcctcttttaccaccaagatcgggctctgtgttaacatgcggagccttccttggtacgtccctgccaaccccgattccttctttcccagatgctatagcctgtgtacagaatctgaacaacaggagttcctggaggacttccgtaggacgatggcctcatctatcctgaaatgggttgtgtctcatcagtcatgttctcgatcctctcgtagcaaaccacgagaccagcgcgaagaagcaggctcgtcagatttaagctctaggcaggatgctgaaaacgcggaagcgaaactgaggggtttacccggacagctggtagacatagcttgcaaggtgtgtcaggcgtatctagggcagctggagcatgaggacattgatacatcagccgacgcagtggaagaccttacggaggccgaatgggaggacctaacacaacagtactacagcttggtgcacggcgacgctttcatcagtaatagtcgcaactatttttcacaatgccaagctctcctaaaccggattacaagcgtgaatcctcaaaccgatattgacggtctgcggaatatttggatcatcaagcccgcagcgaagagccgtggacgggacatagtgtgtatggatcgggtagaagagatcctggaactggcagctgcggatcacccactctcaagagataacaagtgggtcgttcagaagtatattgagactccactcctcatttgcgatactaagttcgatatccgtcaatggtttctggtgacagactggaaccccctaacaatctggttctacaaggagtcctacttgcgcttcagtacgcagcgtttcagcctggataagctggacagcgccatacacctctgtaacaacgccgttcaaaaatatctcaaaaatgatgtcggcaggtccccgttgctcccggctcacaatatgtggacgtctactcggttccaggagtacctgcaacggcagggacgcggagccgtgtgggggtccgtcatctatccctctatgaaaaaggctatagcccatgcaatgaaggtggcgcaggaccatgttgagccaaggaagaattcctttgaactgtatggagcagactttgtgctaggaagagacttcagaccatggctcattgagatcaatagcagtccaacaatgcatccttccactcctgtcacggctcagctctgtgcccaggttcaggaggacaccataaaggtggcggtggacaggtcctgcgacatcggaaatttcgaattattatggagacagccagttgtggagcctccacccttcagcgggtccgatttgtgcgtggctggggtttccgtgaggcgagcacgcagacaggttcttccggtatgcaacctcaaagcatcagctagcctactcgatgcccaacccctgaaagcacggggaccctccgcaatgcccgatcccgctcagggacctccatcccctgctttacaaagagatcttgggttgaaagaggaaaagggactcccactcgcactgctggcacccttgagaggagccgcagaatctggcggagctgcccagccaacaagaactaaagctgctggcaaggtggaactgccagcctgtccatgccgccatgtcgactctcaagctcccaataccggtgttcctgttgcccagcccgctaaaagctgggatcctaatcagcttaatgcccatccgctggaacctgtcttacgcggactcaaaactgcggagggagccctgcgaccccctcccggagggaagggagagggaaccgtgtgctcgaggctgccccatcacgggcaccacgttgctgcctgccagacgacaggcaccacctgggatggagggccaggcgtgtgtttcctccgccaactcttggcatctgaactacccatgggacctgggttaccaagggatccaagggcgcctccatgtctcgtttgccgcggtttgctacctcccgcaggcccttgcaagcgctgtcgaagtttttgcgctgcagttttgcagggggcttctttcgttaggttgggtggacggagttgctcaccacggacgccctag

SEQ ID NO: 30401 - DNA, 318 bp, Artificial Sequence
  Description of Artificial Sequence: Synthetic coding sequence
atggataaaaacatcggtgaacagttaaacaaagcttacgaagccttccgtcaagcttgcatggatcgcgacagtgccgtgaaggaactacaacagaagactgaaaactatgagcagaggataagggagcagcaagaacagctctcactgcagcaaaccatcatagataaactgaaaagtcaactcctcctggtgaacagtacccaggataataattatggttgcgtgccccttctcgaggattctgagacacgcaaaaataatctgacactggaccaaccacaggacaaggtgatttccggcattgcccgagagtag

SEQ ID NO: 30402 - DNA, 816 bp, Artificial Sequence
  Description of Artificial Sequence: Synthetic coding sequence
atggcgcctgtgggggtcgagaagaagcttcttttggggccaaacggccctgccgtggctgccgcaggtgatctgacctctgaagaggaggagggccagtccctgtggagcagcatactctcagaagtcagcactagggccaggagcaaattgcctagcggtaaaaacattctggtgttcgatcacacccggtgtaatgtgtggatcctggatggagacctgtatcacaaggggcttttaaaattcgcagtgtctgcagagtctctgccagaaactctggtgatctttgtggcagatatgtcccggccttggactgtgatggaaagtctccagaagtgggcctcagtactccgggagcatattgacaaaatgaaaatcccacccgagaagatgagggaactggagcgtaagttcgtgaaagatttccaggactatatggagcctgaagaggggtgtcaaggctcaccccagcgccgagggcctctgactagtggaagcgatgaagaaaatgtagcccttcctctgggtgacaacgtcctcactcacaacctagggatacccgttctagtcgtgtgtactaaatgtgacgcagtatccgtcctggagaaggaacacgattacagggacgagcatctagacttcattcagtcacacttaaggcggttctgcctgcaatatggtgccgctttgatctatacctcggtaaaggaggaaaaaaatctggatctgctgtacaaatatattgtgcataagacttacggctttcattttactacacccgctttggtggtcgaaaaggacgcagtatttatgtag

SEQ ID NO: 30403 - DNA, 522 bp, Artificial Sequence
  Description of Artificial Sequence: Synthetic coding sequence
atggcggatcgcatgcagattgtcgttattctgtcagagttttttaatactacttggcaggaagctaattgcgcgaactgcctgacaaataatagtgaggagttgtcaaacagcacagtatatttcctgaatcttttcaatcacaccctaacatgctttgaacataatcttcagggcaatgcccactcactgctgcaaacaaaaaactactcagaagtctgcaaaaattgccgggaggcttacaagacactgtcctccctttattccgagatgcagaagatgaatgagctcgagaacaaagcagaacccggtactcacctctgcatcgacgtcgaagatgccatgaacattacaaggaagctgtggagccgcactttcaactgttccgtcccttgctccgacacagtgcccgttatagccgtcagcgtgttcatcctcttcttaccagttgtgttttatctgtcttccttcttacatagcgagcaaaaaaaacgaaagctgatcctgcccaagcgcctttag

SEQ ID NO: 30404 - DNA, 435 bp, Artificial Sequence
  Description of Artificial Sequence: Synthetic coding sequence
taattcattcactgtacggacgactctccagacccctgcatcgagtatgagctcgtgctgcggaagtggtgtgagctcatccccggtgccgagttccggtgcttcgttaaggagaacaagctcatagggatcagccaacgagattacacacagtattacgatcatatttcgaaacagaaagaagaaatacggcgatgcatccaggactttttcaaaaagcacatacagtataagtttttagatgaggacttcgtgtttgacatctaccgggacagtagaggtaaagtgtggctcatcgactttaaccctttcggcgaagtaacagactctcttttatttacctgggaagagctgatttctgagaataatctgaatggagactttagcgaggtggacgcccaagaacagaagcgtaatcagcaggaggatgactag

SEQ ID NO: 30405 - DNA, 978 bp, Artificial Sequence
  Description of Artificial Sequence: Synthetic coding sequence
tagattcagggtgaggcgtcccgcagagccgctggtgagcccgaggctggctccgattacgtcaaatttagcaaagaaaaatatatcctcgacagctcccctgagaagctccataaagaattggaagaagagctgaagctctccagcaccgacctccggagtcacgcttggtaccatggacggatacctagagaagtgtctgagaccttggtacagagaaatggcgacttcctgatcagagattctttgacgtcgctgggagattacgtccttacctgtagatggaggaatcaggcacttcacttcaaaatcaataaggtggtagtgaaagcgggagagagctacacccacatccagtacctcttcgagcaggagagttttgatcatgttccggcattggttagataccacgttgggtctaggaaggcagtgtctgagcagtccggggcaatcatctactgccctgtcaaccggacattcccactcaggtatctggaggccagctacgggctcggccaaggcagctctaagcccgcaagcccagtttcaccaagcggacccaagggtagccacatgaaaaggcggtcagtgactatgacagacggcctcactgctgataaagtgactcgtagcgatggttgccccacgagtacttccttgccccgtccaagagattctatcaggtcctgcgccctctcgatggaccagatccctgacttgcatagccccatgtcgcccatttctgaatctccctcttctcctgcctattcgacagtgactagagtccacgcagcaccagcagccccttctgctaccgccctgcctgctagtccagtggcccgtcgctcaagcgagccacagctgtgcccaggttctgcccctaagacacacggagagtctgataaggggccacacaccagtcccagccatacactgggcaaggcctctccttcaccgagtctatcatcatactcatag

SEQ ID NO: 30406 - DNA, 330 bp, Artificial Sequence
  Description of Artificial Sequence: Synthetic coding sequence
atgtctagtaaggggtcttcgaccgacggccgaacggacctggccaatgggagcctctcctctagtccagaggagatgtcaggcgctgaggaaggcagggagacgtcttctggtatcgaggttgaggcttctgacctttcattgagcctgacgggagacgacggcggacccaaccgcacgagcacggaaagcaggggcaccgataccgagagtagtggtgaggataaagattctgatagcatggaggacaccggacactacagcattaacgacgaaaatagggtacacgaccgatcagaagaggaagaagaagaggaggaagaggaatag

SEQ ID NO: 30407 - DNA, 1638 bp, Artificial Sequence
  Description of Artificial Sequence: Synthetic coding sequence
gccgctggagcacctaggcttcttgggccaggcgctgttcggggacctgctggcgtggggcgagtggctgctggagccatggagggggtgctgtataagtggaccaattacttatctggctggcagcccagatggtttctgctttgcggcggaattctctcctactatgatagccccgaggacgcctggaaagggtgcaagggctcaatccagatggccgtttgcgagatccaggttcactcagttgacaacacacggatggacctgattatccctggggaacagtatttctatttaaaggccaggagcgtggcagaaagacaacgatggcttgtcgctctggggagcgccaaagcctgtctgaccgacagcagaacccaaaaggaaaaagagtttgccgaaaacaccgagaacctcaagaccaaaatgtctgaacttagactctactgcgacttactggttcagcaggtcgacaagactaaagaggtaactaccaccggagtgtcgaactctgaggagggcatagacgtgggtacccttttgaaaagtacgtgcaacacctttctcaaaacattggaggaatgcatgcagattgcaaacgcagcttttacctctgagctgctgtataggacccctccagggtcccctcaacttgccatgctcaagagctcgaagatgaaacaccctattatcccaattcacaatagcttagaacgccagatggaattaagcacctgcgaaaatggttctttgaacatggaaatcaacggtgaggaggagattctgatgaagaataaaaatagcctctacctcaagtcagccgaaatcgattgttcaatttcctctgaggaaaatacggacgacaacatcactgtccagggcgagatccgaaaggaagatgggatggagaacttaaagaaccacgacaataacctgactcaatccggatctgactccagctgctcgccagagtgcttgtgggaagaaggcaaagaagttatccccacctttttctccactatgaatacttctttttcagatattgaactgctggaggatagcggtataccaactgaagccttcttggcatcttgctatgctgtggttcctgtgttagacaaactcgggccaacggtgtttgcacctgtgaaaatggacctggtcggaaacattaagaaagtgaatcagaagtacattactaacaaggaggagtttactaccctgcagaagatcgtcctgcacgaggtcgaggctgacgtagcgcaggtgcggaatagcgccaccgaggcactcctgtggttgaaaaggggactcaagtttctgaagggctttttgaccgaggttaagaatggcgaaaaggatatccagacagccttaaacaacgcatacggcaaaacacttaggcagcaccacggttgggtagtccggggagttttcgctctcgccctacgggcagccccatcctatgaggattttgtcgccgcactgacagtcaaagaaggcgaccaccagaaagaagctttcagcataggcatgcaaagggatttgagcctgtacctgccagcgatggagaagcagctggccatcctggacacgttatacgaagtacatggcttagagtctgacgaggtggtttag

SEQ ID NO: 30408 - DNA, 522 bp, Artificial Sequence
  Description of Artificial Sequence: Synthetic coding sequence
atgtataccctgctgtcaggactttataagtacatgtttcagaaagatgaatattgcatcctcatcctgggcctggacaatgctggaaagacgacatttctggaacagtccaaaactcggtttaataagaattataaagggatgtccttatccaaaatcaccaccaccgttgggcttaacatagggacagtcgacgtaggaaaggcaagactgatgttttgggatctgggcggacaagaggaactgcagtctctgtgggataagtactatgcagaatgccacggcgttatatacgtgatcgacagcaccgacgaggagcgactcgcagaaagcaagcaggcctttgagaaagtcgtcacctctgaagcactctgtggcgtgccagtcctcgtcctcgctaataagcaggatgtggagacatgcctgtccatacccgatattaaaaccgccttttctgactgcacttccaaaattggccgtagggattgcctcactcaggcttgttctgccctgaccggctag

SEQ ID NO: 30409 - DNA, 729 bp, Artificial Sequence
  Description of Artificial Sequence: Synthetic coding sequence
atgggactcgtgtgtgtgctcggtgacggtaaaaccgagcagaagggtggggacaaaaagcgcggagttaagaggccaagggaggaccatggcagaggatatttcgaatacattgaagagaataagtatagccgcgctaagagtccacagccacctgtcgaggaggaggatgagcatttcgacgacacagttgtctgcttggatacttataattgcgatctccacttcaaaattagtagggaccgcctatccgcctcgtctctcacaatggagtcattcgccttcctctgggctggagggagagctagctacggcgtttcaaagggcaaggtgtgttttgagatgaaagtcaccgaaaagattcccgtaaggcacctgtatacgaaggatatcgacatccacgaggttcgcatcgggtggtccctcaccactagcgggatgcttctaggtgaggaggaattctcttacggatactcactgaagggtataaaaacatgcaactgcgagaccgaggattatggggagaagttcgacgaaaatgacgtgatcacatgttttgcgaacttcgagtcggacgaagtggaattgagctatgccaagaatggccaggacttgggagtggcatttaaaatcagcaaggaggtgctggccggtcggcctctcttccctcatgtgctgtgtcacaattgcgccgtcgagtttaacttcggacaaaaggagaagccctag

SEQ ID NO: 30410 - DNA, 2922 bp, Artificial Sequence
  Description of Artificial Sequence: Synthetic coding sequence
tcaagtagtgataaggagtccattctcacgattctaaaagtgcttggcgatcttttgtcagtggggactgatcgcaggatccattatatgatatctaaagggggttctgaagccctcctgcagacgctggttgacaccgcaaggacagcaccacctgactatgatattctgctgcccctgttcagactgctggccaaggtagggcttcgcgataagaagatcggtcggaaggccctcgagcttgaagctctggatgtcaccctaatcctggcaagaaaaaacctgagtcacggacaaaacctactacattgtctctgggccctccgggttttcgctagctcggtatctatgggcgctatgctaggtattaacggagctatggagctcttgtttaaggttataactccatataccagaaagagaacacaggcaatccgggcagccaccgaagtgctggcagccttgcttaagtccaagagcaacggcagacgagctgtgaaccgcggatatgtgacctcgcttctgggcctgcaccaggattggcatagtcacgataccgctaacgcttacgtccagatacgaaggggcctgttgctctgcttacgtcacatagcagcgttgcggtcggggcgagaggcttttctggccgctcagggcatggaaatcctattctctacgacccagaactgccttgacgacaagtcgatggagcctgtaatctccgtggtactgcagattcttcgccagtgttaccctaccagccccctgccactagtgacagccagttccgcgtatgcttttccagtgccaggttgcatcaccactgagccaccacacgatttgccggaggaggacttcgaggatgacggggacgacgaggttgataaggatagcgacacagaagatggcaaggtagaagacgatgacttggagaccgacgtaaataaactaagtagtaagccaggccttgataggcctgaggaagagttaatgcaatacgaggtgatgtgcctggagctgtcgtattcatttgaagagcttcagtcgaagctgggggacgacctcaactctgaaaagacccagtacgcaaaccatcatcatattcctgccgctgcctctagcaagcagcactgttactccaaagatcagtctagctgtggccaggagcgcgaatatgccgtacagacaagccttctgtgcagagtgaagacagggagatcaactgtgcatctcggatcaaagaagaacccaggcgtgaatctttaccagaacgtgcagagcaattcactgcggcgagacagctcggaaagcgaaatacctgatatccaggccagccctaaggcagatgcttgggatgtagacgccattttctgtccgcgtatgtctgcctccttctccaattccacccgaacacgtgaggtggtaaaggtcattgataaactgctacagactcacctgaagcgagtgccttttcacgacccttacctgtacatggctaaagccaggagaaccagttcggtggttgactttaagatgatggcattccctgacgtgtgggggcactgccctccgcctaccacccagcccatgctggagcgcaaatgtggtgtccagcgtatccgcatcttcgaggacatccggcgattgatccagccttctgacgttatcaataaggtggtgtttagcctcgatgagccatggcctttgcaggataatgcctctaactgtctgcgcttcttctcgaaattcgagtccgggaatctccgcaaggctattcaggtacgggagttcgaatacgatttgttagtgaacgcagatgtaaatagcacacagcaccaacagtggttctactttaaggtgagcggcatgcaggctgcgatcccctaccacttcaacattatcaattgtgagaaaccaaacagccagttcaactatggtatgcagcctactctgtatagcgtgaaggaagcgttgctcggaaagccaacgtggatccgtacggggcatgaaatctgctattataaaaatcactaccggcaatctactgccgtggcgggaggggcttccgggaagtgctattacactctgacattcgctgtgaccttcccacacagcgaggacgtgtgttatttagcctaccattacccttatacctacactgctctgatgacacacctggacatcctagagaaaagtgtgaatttgaaagaggtgtatttccgtcaggacgtcctgtgtcagaccctggggggtaacccgtgtcccctggttaccatcacggcaatgcctgagagtaactccgacgaacatttggagcagtttaggcaccgaccttatcaggtaatcacagcccgtgtgcaccctggtgagtctaacgcctcctgggtcatgaagggaaccttagagtttctggtctcatctgaccccgtggccagattactgcgcgagaattttatctttaagattattcccatgctcaaccctgacggtgtcatcaacggcaatcacaggtgttccctgtctggtgaggatctcaatcgccagtggctgagtccaagtgcacatttacagcccactatctaccacgccaaaggactgctgtaccacctgagttcaatcgggagatcccccgtcgttagtcacttcctccttgtcttctgcgattttcacggccatagtcagaaaaaaaatgtgtttctatacgggtgtagtatcaaggaaacactctggcaggcggcttgcactgtgggaaccagcaccattctggaggaggtcaactatcgcactctgccaaaaatcctcgacaaattggcaccggctttcaccatgtcttcctgcagtttcctggtagaaaagagccgtgcatccaccgccagggttgtagtgtggagggaaatgggggttagccggtcatacacatag

SEQ ID NO: 30411 - DNA, 7751 bp, Artificial Sequence
  Description of Artificial Sequence: Synthetic coding sequence
tagtcaagcataaccttctctgtgaaggttgagggtcgtcctgtgccaactgttcactggctacgggaggaagctgagcggggtgtgctatggattggccctgacacacctgggtacacggtggcttcatctgcccagcaacatagcttagtgcttctggacgtcgggaggcaacaccagggaacttatacatgcatagcatccaatgctgccggtcaggccctttgctccgccagtctgcacgtctccggcctccctaaagtcgaggagcaggagaaggtcaaagaagcacttatctccaccttcctccaggggactacccaggccatctctgcacagggcttagagacagcctcgtttgccgaccttggtggccagcggaaagaggaaccactcgctgccaaggaggccttgggacacctctctctggcagaagtcggcaccgaggaattcctgcagaaactgacatctcaaatcactgagatggtgtccgctaagatcacccaagcgaaattgcaggtccctggaggggacagcgacgaggatagtaagacgccaagcgcttcgcccaggcatggcagatcccgcccttccagcagcatacaggagtctagcagcgaatctgaggacggtgacgcccgaggtgaaatcttcgacatttatgttgtgaccgccgattatttgcccctgggggctgagcaagatgctatcacgcttcgggagggccagtatgttgaggtgctagatgccgcacacccgctcagatggctggtgaggacaaaacctactaaatctagcccttccagacaggggtgggtgtcacccgcatatctggacaggagactgaagttgtcccccgaatggggcgctgccgaggcccctgaattccccggagaggcggtgagcgaggacgagtacaaggcgagactctcttcagtgattcaggagctgcttagttcggagcaagctttcgtcgaagagttgcagttcctgcaatcacaccacctgcaacatttggagaggtgtcctcacgtacctatagctgtggctggacagaaggcagtgatatttcgaaatgtcagagatatagggaggtttcactcgagctcttttttgcaagaacttcagcagtgtgatacagatgacgatgtcgctatgtgcttcattaaaaaccaggctgcgttcgagcaatatctcgagttcttggttggaagagtgcaggcagaaagcgtggtggtttccaccgcaatacaggagttttacaagaagtatgccgaagaagctttgctggcgggagatccctcacagccgccaccgcctcctctgcagcattacctagagcagcctgtggagcgtgtgcagagataccaggcactgctcaaggaactgatccgcaacaaggctagaaacagacagaactgcgctctgttagagcaggcttacgcagtggtcagtgcgctgcctcagcgcgctgagaataagctgcatgtatccttgatggagaattacccaggtaccctccaggccctgggggagcctatcaggcagggccactttattgtctgggagggcgctcccggtgcacggatgccatggaaaggtcacaaccgtcacgtcttcctgtttcggaaccatttggtcatctgtaaaccgagaagggattcgcggaccgatactgtgtcctacgtgtttcggaatatgatgaaactgtccagtatagatctaaatgaccaggtggaaggcgatgatagagcctttgaggtctggcaggaacgggaagacagcgtccgaaaatacctgctccaagctagaacggcgattattaaaagcagctgggtgaaggaaatatgcggtatccagcagcgacttgcgttgccggtgtggcggccacccgacttcgaggaggagctagccgactgtactgcagagctaggggagacagtcaagctggcctgcagggttactgggaccccgaaacccgtaatcagttggtacaaagatgggaaggccgttcaggtcgatccacatcacatcttgatcgaggatccagatggatcttgcgcacttattctggattccctaaccggcgtagactccgggcaatatatgtgttttgccgctagtgccgcaggtaactgtagcactctcggtaaaatccttgtgcaagtgcccccacgattcgtaaacaaagtgcgcgcatccccttttgtcgaaggggaggacgcccagttcacatgcactatcgaaggcgcaccatatccgcagatccggtggtataaggacggtgctctcctcactacgggaaataagttccagactctgtctgaacctagaagcggactccttgtgttggtcatacgtgctgcaagtaaggaggatctgggactgtacgagtgcgagctggtcaaccggcttgggagcgctcgcgcttccgcggagctacggatccagtcacctatgctgcaggcccaagagcaatgtcacagagagcaactggttgcagccgtggaggataccacactggagcgggctgaccaggaagtaacatcagtcctgaaaagactgctcggaccgaaggcccctggcccatccactggggatctgacaggtccaggcccatgtccaagaggagcacctgccctgcaggaaacaggaagtcaaccgcctgtgactggtaccagtgaggctcctgccgtgccaccacgcgtcccccagccactactccacgaggggccagaacaggagccagaggcgatcgctagggcacaggaatggacagttcctatacgaatggaaggagccgcttggcccggtgccggaaccggagaactgctgtgggatgtccactctcacgtggtaagagagactacacaacgcacatacacttaccaagccatagatacacacacagctcggccaccaagcatgcaggttaccatcgaagatgtgcaggctcagaccggcggaaccgcgcagtttgaggctattattgaaggagacccacagccttctgtgacttggtacaaggactccgttcagttggttgattccactagactctcgcaacaacaggagggcaccacttactcattagtactgaggcatgttgcctctaaagacgccggagtctatacctgcctggcacagaataccggaggccaggtgctgtgcaaggctgaactccttgtgcttggcggtgacaacgaaccagactctgaaaagcaatcacaccgcagaaagttgcactccttctatgaggtaaaggaggagatcggtcgcggtgttttcggcttcgtgaagagggtgcagcataagggtaacaagatcctgtgtgccgctaaatttatccctctgagatctagaacgcgggctcaggcctacagagagagagacattctcgctgcgctgtctcaccctctggtgactggtctgttggaccaatttgaaactcgaaagactctgattctgatcctggagctgtgctcgagcgaggaacttctggacagactgtatcggaaaggtgtggttactgaagcagaagtgaaggtatatatccagcagttggtggaaggcttacattatctgcatagccacggcgtgttgcatctggacatcaaaccctcgaacatactcatggttcatccagcgagggaggatatcaagatatgcgattttggctttgcacagaacatcacaccagcagagctccagttttcgcagtatggttctcctgaatttgtctcacctgagattatccagcaaaaccctgtcagcgaggcctcagatatctgggctatgggagttattagctacctgagcctaacgtgcagtagcccctttgccggtgaatccgatcgagccacattattgaacgtgctagagggaagagtgtcttggtcctcccccatggccgcacatttgtctgaggatgccaaggacttcataaaggcaacactccagagagctccccaggctcgtcctagcgccgcacagtgcctgtcccacccttggttcctaaagtcaatgcccgcagaggaagcacacttcatcaacacgaagcagcttaagttcctgctggcaagatcgcgatggcagagatcactaatgagctacaaatctatactagttatgcggtcaatcccagagctactgcgcggaccccctgacagtccatcgttgggggtcgcacggcacctgtgccgggacaccggaggctcctcttcctcaagttcatctagcgataatgaactcgctccgtttgcacgcgctaagagtctccccccaagtcctgtaacacatagcccgctattgcatccccgaggcttcctgcgacctagcgcaagcctgccggaagaagccgaggcaagcgagcgaagcacggaggctcctgccccaccggctagcccagagggggctggcccaccagcagctcaggggtgcgtacctagacattcggtcatccggagcttgttctaccaccaggctggggaaagtccagaacacggggcactggcgcctggatctcgccgtcaccccgcacgacgccgacatttgctgaaaggcggatacatcgctggcgctctgcccggattgcgggaacccctgatggagcacagagtgttggaggaggaggccgcaagagaggaacaggccacactgctggccaaagcaccctccttcgagaccgctcttagactcccagcgtctggcactcacctcgccccaggccacagccactcccttgagcatgacagccccagcacaccaaggccgtcgtcagaagcgtgtggagaggcgcagagattgccctctgctccctccgggggagcccctattagagacatgggacacccccagggaagcaagcagctgccctccacagggggtcaccctggtacagctcagcccgaacgaccctcacctgattcaccttgggggcagcctgctccgttctgtcacccgaagcagggcagcgcccctcaggagggatgctcccctcatccagctgttgcgccatgcccccctgggtcgttccccccaggatcctgtaaggaggcgcctctagttcccagttcaccctttctagggcagccacaggcgcctcccgctccagcaaaggcttcaccgccactggatagcaagatgggacctggtgacatttctctgcctggacgtccaaagcccggaccttgttcctccccagggtccgcttcccaggcatccagttctcaagttagctctctccgggtgggtagctcccaggtggggactgaacccggaccgagcctcgacgctgaggggtggactcaggaggcagaggacttgtccgattctacccctactctgcagcgcccacaagaacaagctaccatgcggaaattttccctgggagggagaggtggctatgctggtgtggctggatacgggacgttcgctttcggtggtgatgccggaggcatgctgggtcaagggccaatgtgggcaagaatcgcttgggccgttagccaatcagaagaggaagaacaggaggaggctagggcagagagtcagagtgaagaacagcaggaggctagagccgaatcccctctgccacaggtttctgcgagacctgtgcccgaggtcggtagggcacctaccagaagctcccccgagcctaccccctgggaagacatcggccaggtgtccctggtgcagatacgagacctgagcggcgatgcagaagcagccgacacaattagcctggatataagcgaagtggaccctgcttatctgaatcttagcgacctctacgatataaagtatttgccttttgagttcatgattttcagaaaggttcccaaaagtgcacaacccgaaccacccagtcccatggccgaggaggaattagccgagttccccgaaccaacttggccctggccaggggagttgggaccccacgcgggattagaaataaccgaggaatctgaggatgttgacgcactgctggcagaagccgctgttgggcgaaagcggaagtggagcagtccgtcccggagtttgtttcactttcccggaaggcacttgccacttgacgaacccgcagaactcgggctgcgcgaacgcgtcaaagctagtgtcgaacatatctctcgcattctgaagggacgcccagagggtcttgagaaggaaggtcccccacggaagaagccaggactggccagctttagattatccggtctcaagtcctgggaccgagcccctactttcctgcgagaactcagtgatgaaacagtcgtcctgggccaatctgtcacccttgcatgccaggtttctgcccagcccgctgctcaggccacatggagtaaagacggagccccactggagagcagttcgcgcgtgctcatcagcgctactctcaagaattttcaactattgaccattctggttgtggtggccgaagatctcggagtgtatacctgttccgttagtaatgcacttgggacagtgacaaccacaggagtactccggaaggcagagagaccctcatcatccccctgtcctgacatcggggaggtctacgctgatggagttctgctggtctggaagcctgttgaatcttatggcccagtgacctatattgtacagtgtagtctggaggggggatcctggactacgttagcttcagatatttttgactgctgctacctcacgtctaaactgagtagaggaggcacctacacctttagaactgcttgtgtatccaaggctggcatgggaccatattccagtccaagtgaacaggtgcttctgggtggaccctcccatctagcctccgaagaggagtcccaggggcgatcggctcaacccctaccttcaacgaagacatttgcctttcaaacacagatccagagaggcaggttttctgtcgtcagacagtgctgggaaaaagcatctgggagggcattggccgcaaaaatcattccatatcatcccaaggataaaaccgctgtgcttagagagtacgaggccctcaaaggtctcaggcacccccacctagctcaactccacgccgcatacttgagtccccgacatctggttcttatcttggaactgtgttcaggccctgaactgctaccatgtcttgcggagagggcatcctactctgaatccgaggtgaaagactacttgtggcagatgctttcagctacccaatatttgcataaccagcacatcttacacctcgaccttagatcagagaacatgataattactgaatataacctgctgaaagtcgttgatctgggtaacgcacagtctttgtcccaggagaaagttctgccaagcgataaatttaaggactatcttgaaacgatggagctactcgaaggacagggggctgtccctcagacagacatctgggcaatcggtgtcaccgcctttatcatgttgagtgccgaatacccagtgtcaagcgagggagcacgagacttgcagcgagggcttcggaagggtctagtgaggttaagccgatgctacgcgggtttgtctggtggtgctgtggctttccttaggtcaaccctgtgtgcgcagccatggggcaggccatgcgccagctcctgtctgcagtgcccctggctcacggaagagggaccagcctgtagtcgcccagctcctgtcacatttccaactgcaaggctgagagtttttgtcaggaaccgggagaagcgccgagccctcctgtacaaacgtcacaaccttgcccaggttcggta

SEQ ID NO: 30412 - DNA, 1749 bp, Artificial Sequence
  Description of Artificial Sequence: Synthetic coding sequence
atggagaaagcggtgaacgacggctctcatagcgaggagttattctgtcacttgaaaaccatttccgagaaagaggacctgcccaggtgtacttccgagagtcatctgtcatgtcttaagcaggatatcctgaacgagaagacggagctcgaggctaccctgaaagaagctgaactggtgacacatagtgtggaactgctgcttcccctgttcaaggacacaatcgagaagatcaacttcgagaacgccaatttaagcgctcttaacctgaagattagcgagcagaaggagatcctgataaaagaactggacacctttaaaagtgttaagctggcactcgagcatctgctccggaaacgggactacaaacaaactggagacaatctgtcttccatgctgctggagaacctgacggacaatgaatctgaaaacaccaacctgaagaagaaagtgttcgagaaagaagcccacatccaagagctctcatgtctgttccagagcgagaaagcgaatacacttaaagcgaatcggtttagccagtccgtgaaggtcgtgcacgagcgtctgcagattcagatccacaagagggaagcggagaatgacaaacttaaggaatacgtgaaatccctagagacaaagattgctaagtggaatctgcagagccggatgaacaaaaacgaggctatagtcatgaaggaggcctcgaggcagaagacggtggctttgaagaaggcttctaaggtttataaacaacggctggaccactttacgggtgccatcgagaaactcacgtcacagattagagatcaggaagcgaagctaagcgagactataagcgccagtaacgcttggaaatctcattatgagaaaattgtgatcgagaaaaccgaactggaagtccagattgagaccatgaagaagcagattataaatctgctggaggatcttaaaaaaatggaagaccatggcaagaattcctgcgaagaaatacttagaaaggtccattctatcgagtacgaaaacgagaccctcaacctcgagaacacgaaacttaagacaactctggctgcacttaaggatgaagttgtatcagtcgaaaacgaattgagtgagctgcaggaagtggagaaaaaacaaaaaaccctaattgaaatgtacaagacacaagttcagaagctccaagaagccgctgaaatagtgaaaagccgatgcgagaatctgctgcacaagaacaatcaaatcacaaaaactaagaataagaacgtggaaaaaatgagagggcagatggagtcgcatctaaaggagctcgaaagggtgtgcgacagtctgacagcagcagagaggcgactacacgaatgccaggttgacggtaatcataacctgctcaccaaactgtctctggaggaggagaattgcttaatccagctcaagtgtgagaacctccagcagaagctggagcagatggacgccgaaaacaaggaactggagaaaaagctcgccaaccaagaagaatgtctaaaacactcgaacttaaagtttaaggagaaatccgcagagtataccgcgctggcccgacaacttgaggctgcactggaggaaggaaggcagaaagtagctgaggagattgagaaaatgtcaagccgggagtctgctttgcagatcaagatcctcgacctcgaaacggagctcaggaaaaagaacgaggagcaaaaccaactcgtgtgcaaaatgaatagtacgaatgggtag

SEQ ID NO: 30413 - DNA, 384 bp, Artificial Sequence
  Description of Artificial Sequence: Synthetic coding sequence
atggtcagcagcgggaggcggtggttgagagagcagcaacacagaaggtggcggctgcattgcctgaagttacagcccctgagtccggtgccctccgatatcgaaatctcaagaggtcaaactccgaaggccgtcgacgtcctcgctaaggaaattggattgcttgctgacgaaattgagatctacggcaagtctaaagccaaggtccggctcagcgtcctcgagcgactgaaggaccaggccgacggcaaatacgttcttgtcgccggaataacccctacgcccctgggcgaggggaaatcaacggtgaccattgggcttgtgcaggccttgactgcgcatctcaatgtgaattcatttgcatgtctgcgtcagcccagctag

SEQ ID NO: 30414 - DNA, 1929 bp, Artificial Sequence
  Description of Artificial Sequence: Synthetic coding sequence
atgaagattttttgttccagggccaatcctacaaccggctccgtggagtggctggaggaagatgagcattatgactaccaccaggaaatcgccagatcatcctacgcagacatgcttcacgataaggatcgggtgttcaagccgatggcagacgccgcagtgaagatcgtggagaagaatggattttcggataaaattaaggtgattaacaagcactctaccgaggtcactgttggcccagaaggcgacatgccttgcagggctaatatactggtgactgagttgtttgacaccgagctcatcggggaaggcgcactgccaagctacgagcacgcacacagacatttagtggaggagaactgcgaagcagttcctcaccgcgcaacggtctacgctcagctggtggagtctggcagaatgtggtcttggaacaaactgttcccgatccacgtgcagacctcactgggagagcaagttattgtacctcccgtggacgttgaaagctgtcccggagcgccaagtgtttgtgatatccagctgaatcaagtgagtccagccgattttactgtgctgtccgatgtcttacccatgtttagcattgattttagcaagcaggtgagctcctccgccgcttgccattcacgcagatttgaaccgctgactagcggacgggctcaggtcgtacttagctggtgggacattgagatggaccctgagggaaagattaaatgcaccatggcccctttctgggcccacagcgatcctgaggagatgcagtggcgagaccactggatgcagtgtgtgtattttttgccgcaagaggagccagttgtgcaggggtcagcattatacctggttgctcatcacgatgattattgcgtgtggtattcactccaaagaacaagccccgagaaaaacgaaagggtgcgccagatgcgccctgtgtgcgattgccaagcacaccttctctggaatcgcccacgcttcggggagatcaacgaccaggataggaccgatcgatatgtgcaagctctccggacagtactgaaacccgatagtgtgtgcctgtgtgtctctgacggatcccttttgtctgtgttagctcaccacctgggcgtcgaacaggtttttacagtcgaaagtagtgcggcttctcacaaattgctgcgtaaaattttcaaggcgaatcatctggaagataaaattaacattatagagaaaagacccgagctcctgacaaacgaggacctgcaggggaggaaggtatcactgctcttgggtgagccctttttcactacctcactcctgccttggcacaatttgtacttctggtatgtccgcactgctgtcgaccagcatctcgggccaggagcaatggtgatgcctcaggccgctagcctgcacgcagtggtggtggagtttcgtgacttatggaggatccgttctccatgtggcgactgcgagggattcgacgtgcacataatggacgacatgataaaacgggctctcgactttagggagtccagagaggccgagccacatcccctgtgggaatatccctgccgctccctgagcgaaccctggcaaattctgacatttgatttccagcagcccgtccctttgcagcccctgtgtgccgaaggtacagtggagttgcggcgtcctgggcagtcccatgctgccgtgctctggatggaataccatttgacgccagagtgtaccctctcaacaggcttgttggagcctgcagatccggagggcggatgctgctggaacccacactgtaagcaagctgtgtacttcttctctcctgcacctgatcctcgcgcactgttgggcggtccacggactgtctcttatgccgtggagtttcatcctgacactggcgatatcatcatggaattccggcacgctgatacccctgattag

SEQ ID NO: 30415 - DNA, 300 bp, Artificial Sequence
  Description of Artificial Sequence: Synthetic coding sequence
atggttgtgaagctgctttccaacaaaaggagccaagcggttgggattcttatgagctccctgcatcttgacatgaaagatattcagcacgcggtcgttaatttggacaattcagtcgtagatttagaaaccctgcaggcattgtatgagaaccgggcacagtctgacgaactggaaaagattgaaaaacacggcagatcatcaaaagacaaagagaatgctaagagtctcgataagcccgaacagtttttgtatgaacttagcttaatccctaatttctccgagcgcgtcttttgttag

SEQ ID NO: 30416 - DNA, 390 bp, Artificial Sequence
  Description of Artificial Sequence: Synthetic coding sequence
atgggcggatgcttttcaaagcccaagcccgttgaactcaaaatcgaggtggtgctgcccgaaaaagaacgaggaaaagaggaactttccgcctccggcaagggatctccccgagcctatcaggggaacgggactgcaaggcattttcacacagaagagcggctttcaacacctcacccttacccaagcccccaggactgcgtggaagccgctgtgtgccacgttaaggacttggagaatggacagatgcgcgaggtggagctgggctggggcaaggttctcctggtgaaggacaatggggaattccatgccctgggccacaagtgtccgcattatggggcaccgctcgtgaagggagtcctctcccggggtagagtccgttgtccctag

SEQ ID NO: 30417 - DNA, 453 bp, Artificial Sequence
  Description of Artificial Sequence: Synthetic coding sequence
atgaatctagccgagatctgcgataatgccaaaaaaggcagagagtacgcactgctaggaaattacgactccagcatggtctattatcaaggggttatgcagcagatccagagacactgccaatccgtccgggacccagcgatcaagggaaagtggcaacaggtacggcaggagctgctggaggagtacgagcaggtaaaaagtatcgtcagcaccctcgaaagcttcaaaattgacaaaccccctgactttcccgtctcatgccaggacgaacccttcagggacccagcggtctggccccctccggtgcccgctgagcacagagcccctccccagattcgtcgaccaaacagagaggtgagacccctccggaaggagatggcaggcgtcggggcaagaggaccagtcggacgagcccatccaatttccaagtctgagaaaccgtccacttag

SEQ ID NO: 30418 - DNA, 498 bp, Artificial Sequence
  Description of Artificial Sequence: Synthetic coding sequence
atgggagtgaaccagagcgttgggtttcctccagtcacaggcccacatctggtgggctgtggggatgtcatggaggggcagaacctgcaggggtccttctttcggctgttctacccgtgccagaaggcggaagaaaccatggagcagcccttatggatccctagatacgaatattgcaccgggcttgccgagtacctgcaatttaataagagatgcggcggtcttctgttcaatcttgctgtcggcagttgccgactgcccgtgagctggaacggcccattcaagaccaaagactcagggtaccccttgattatattctctcacgggcttggggcttttaggacactttatagcgccttctgtatggaactagcctcacgaggattcgtcgtggcggtgccagaacacagagatcggagcgctgcaaccacatatttctgcaaacaggcccctgaggagaatcagcctacgaatgagagtctgcaggaagaatggtag

SEQ ID NO: 30419 - DNA, 270 bp, Artificial Sequence
  Description of Artificial Sequence: Synthetic coding sequence
atgtccgagcagggggacctaaaccaggcgatcgctgaagaaggaggaacggaacaggagacggcgacaccggaaaacgggatagtcaagtcggagagcttagatgaggaggaaaagctggaactccagcgcaggctcgaagctcagaatcaagaacgacggaaaagcaagagcggcgctggaaaggggaaattaaccagaagtttggctgtgtgtgaggagtcttccgctcgcccaggtggcgagtccctgcaagatcagaccctctag

SEQ ID NO: 30420 - DNA, 6008 bp, Artificial Sequence
  Description of Artificial Sequence: Synthetic coding sequence
atggaggagcgtaagcacgaaacgatgaacccggctcacgtgctgttcgatcggtttgtgcaggctacaacgtgtaagggcaccctcaaggcattccaggagttgtgcgaccacctggaattgaagcccaaagattatcgctcattctatcacaaactcaagtccaaactgaactactggaaggctaaggctctgtgggccaagctagacaagagaggtagccacaaagattacaagaaagggaaagcctgtaccaacactaaatgcttgatcattggagccggtccttgtgggctgcgaactgccattgacctgtcattactgggtgctaaagtggtagtgatagagaagcgggacgcattttctaggaataacgtgctgcacctttggcctttcacgattcatgatttacggggactgggcgcaaagaagttttatgggaagttctgtgctggggctatagatcacatctccatccgacaactccagctgatcctgctgaaagtggctctcattctgggtatagaaattcacgtgaacgtagagtttcagggtctgattcagcccccagaagaccaagaaaatgagcgaattggttggagggcactggtgcatccaaaaacacatccagtttccgagtacgagttcgaggtaatcataggtggcgacgggaggaggaacacactagaggggttccgacggaaggagttccgcggaaaactggccatagccattaccgcaaattttatcaatcggaacacaacagcggaagcaaaggtagaagagattagcggcgtggctttcatctttaatcagaaattctttcaggagctcagagaggccaccggtatcgacctcgagaatattgtctattataaggatgacactcattatttcgtaatgaccgctaaaaagcaatcactgctcgacaagggggtgatcctccacgactatgccgataccgaactgttattgtcccgggaaaatgtcgaccaggaggccctgctctcctacgctagagaagccgctgacttcagtacgcagcagcagttaccaagcttagactttgctatcaaccactacgggcagccagacgttgccatgtttgattttacctgcatgtacgcgtcagagaatgccgctcttgtcagggaacagaacggccatcagctactggtggcgctagtgggagattcacttctggaacctttttggcctatgggcaccggaatcgcgagagggttcttggcagcgatggattccgcctggatggtgagaagctggtccctcggtacaagccccctggaggtgctggcggagagagagtctatttatagactgcttcctcagacaactccagagaatgtctctaaaaatttctctcagtactctatcgaccctgtaacccggtaccctaatattaacgtaaacttcctgaggccttcccaggtcagacatctgtatgataccggtgaaacaaaagacatacatctcgaaatggagtcactggtcaattcccgtaccactcctaagctcacacggaatgagtctgtggccaggtctagcaagctgcttgggtggtgtcagaggcaaacagacggctatgccggtgttaacgtgacggacctgactatgtcctggaagtcaggccttgccttatgcgccattattcaccgctacagacctgacctgatcgatttcgactcgctggacgagcagaacgtcgagaaaaataaccaacttgccttcgacattgccgaaaaagagttaggcattagccccattatgactggtaaagagatggcctccgtgggtgagcctgataagctctctatggttatgtatctaacccagttctacgagatgtttaaggattctctgcccagtagtgatacactcgacctgaacgccgaggaaaaggccgttctgattgccagcacccgctctccaatctcctttttatcaaagctgggccagacaatttcccgcaagcggtcacctaaggacaagaaggagaaggacctggatggagccggaaagcgaagaaaaacgtcacaaagcgaggaggaggaggcgccacgcggtcacagaggcgaaagacctaccctggtctccacattgactgacaggcgaatggacgtggccgttggcaaccagaataaggtaaagtatatggccacacagctgctggctaagtttgaagagaacgcgccagcacagagcatcggaatccgacgtcagggatctatgaaaaaggagtttccgcagaacctcggcggaagtgatacatgctacttttgccagaagagagtgtacgtgatggaaaggctgtcagctgagggaaaattcttccatagaagctgcttcaagtgcgagtattgcgccaccacactcaggttgagtgcttacgcatacgacattgaggacgggaagttttactgtaagcctcactactgttaccggctgagcggatacgcccaaaggaagcggccagctgtggctcctcttagcggtaaagaggctaaaggtccactgcaggacggcgcaacaaccgatgccaacggcagagcgaatgcagtagcaagttcaaccgagagaacccccggatctggtgtgaacggtcttgaagaaccaagtatagcaaagcgacttcggggtacccctgaaaggatcgagcttgaaaattaccgactgtccctgagacaagctgaggccctgcaggaagtgcctgaggagacccaagctgagcataacttgtcaagcgtgctggatacaggagcagaggaggacgtggcatccagttcctccgagagcgagatggaggaggaaggcgaagaggaggaagaagaacctagactgccaccgagcgaccttggtggagtcccttggaaggaagcggtgaggatacatgctctgctgaagggaaagtccgaggaagaactggaggcaagcaaatcattcggtccaggtaacgaagaggaggaagaagaagaggaagaatatgaagaggaggaggaagaagactatgatgaggaagaagaagaaagctccgaggcaggaaaccaaagactccagcaggttatgcacgcggctgaccctctggaaattcaggccgacgttcactggacccatattcgggaacgagaggaagaagaacggatggctcctgcaagtgaaagctcagcatcgggggctccgcttgacgaaaacgatctggaagaggatgtagatagcgagcccgcagagattgagggagaggccgctgaggatggcgatccaggggacaccggggctgagttggatgacgaccagcactggtcggactccccgtcagacgcagaccgggagcttcggcttccatgcccagcggagggcgaagcggagctggagttgagggtgtccgaagatgaggaaaagcttccagcgtctcctaagcaccaggagaggggaccttctcaggctacctcccccatacgaagtccacaggaatcagctcttctgttcatccccgttcacagccctagcacagagggcccacagctccccccagtgccggctgccacacaggaaaaaagcccagaggagaggctattccccgagcctcttttgcccaaggagaagccaaaagccgacgctcccagcgatctcaaggcggtgcacagccccattcgttcccagcccgtgaccttgcccgaagcaagaaccccagtgtcccccggatccccccaaccccagcctcctgtagcggcaagcacaccccctccctccccactgccaatctgctctcagcctcagccttctacagaagccactgtcccttctccaacacagagcccaatccggtttcagcctgcccctgcaaaaacttctactcctctcgccccactgcccgtccagagccagagcgataccaaagatcgcctaggcagcccactggccgtcgatgaggcccttagacggagcgaccttgtggaagagttttggatgaaaagtgccgaaattcgcaggtcactcgggctaacccctgtggacaggagcaaaggccctgagcccagtttccccacgcccgctttccgtcctgtaagcctcaaatcctactcggtggagaagtccccacaggatgagggcctgcacttattgaaacccctgtcaattcccaagcgcttgggcctaccgaagcctgaaggggaacctctatcacttcctacccctcgctctcccagcgatcgggagctcagatcagctcaggaggaacggagggagctatcttcttctagtggactgggacttcatggtagctccagtaacatgaagactctgggtagtcagagctttaatacaagcgactccgccatgctgacgccaccttccagtccccctccccctccaccacccggtgaggaaccggcaacgctcaggcgaaagctccgagaggccgaaccaaatgcatctgtagttccccctcctttaccagccacttggatgcggccacccagagagcccgctcagccacccagggaggaagtccggaagtccttcgtggaaagcgtggaagagattcccttcgcggacgacgtggaggacacgtacgacgacaagacagaagactcatctctccaggagaaattcttcacgccccctagctgctggccaaggcccgaaaaaccgagacacccccctcttgcaaaggagaacggacggctccccgctctcgaaggtacactgcagccccagaaaagaggtctccctctcgtttccgcggaggccaaggagctcgcagaggagagaatgcgggctcgcgaaaagtccgtgaagagtcaggcactaagagacgcaatggccaggcagctgtctcggatgcagcagatggagctcgcaagtggcgcaccccgacctcgaaaagcatcgtccgcccctagtcagggcaaggagcgcagacccgatagccctacccgcccaactttacgaggaagtgaggagccaactcttaaacacgaggccactagcgaagaagtgttgagccctccctcagatagcggcggacctgacgggtccttcacttcctccgagggttctagtggcaagtcgaaaaagcgatccagcctgtttagcccacggcgtaataaaaaggagaagaagagtaagggcgagggcaggccaccagagaaacccagctcgaatctgttggaggaagccgctgcgaagcccaagtccttatggaagagcgtgttttccggatacaagaaggataaaaagaagaaggcagacgataaatcatgccctagcactcctagttccggagccactgttgacagtggcaagcatagggtgctccctgtggtgagggctgaactacagctcagaagacagctgtcattctctgaagattctgacttgagcagtgacgatgtgttggagaagtcgtcacagaaatcccgcagagaaccgcgaacctataccgaggaagaactgaacgcgaagcttacacggagggtgcagaaggccgctaggagacaggcaaagcaagaagagctgaagcgcctgcatcgggcacagatcattcagcgccagctgcagcaggtggaggagcgccagcgcaggctcgaggagagaggagttgccgttgagaaagccctgcgaggagaggctgggatgggcaagaaggacgatccaaagctgatgcaggaatggtttaagctggtgcaagaaaagaacgcaatggtccgatacgagtctgaattgatgattttcgctagggagctggaactcgaggacagacagtctaggctgcagcaggagcttcgcgagaggatggctgtagaggaccacctgaagaccgaggaggaactgtccgaggagaaacaaattttgaacgaaatgctcgaagtggtcgaacagcgtgactctttggtagctctcctcgaagaacaacggctccgggaaagggaggaagataaagatctggaagccgctatgctttcaaaaggcttttccctcaattggtcgta

SEQ ID NO: 30421 - DNA, 540 bp, Artificial Sequence
  Description of Artificial Sequence: Synthetic coding sequence
atgagctcaaacgagtgttttaagtgcgggagaagtggtcactgggcgcgagaatgccccacgggcggaggacgcggacggggtatgagaagccgagggagaggaggtttcacctccgaccgcggatttcagtttgtctcctcaagcctgccagatatttgctatcgatgtggcgagtctggtcatctcgctaaggattgcgatctacaagaggacgttgaggcttgctacaattgtggaagagggggtcatattgccaaggactgcaaggaaccaaagcgcgaacgtgaacagtgttgttataattgcgggaaaccgggacacctcgctagagactgcgaccacgccgacgaacagaaatgctacagttgtggggaatttggacatatccaaaaggactgtacgaaggtcaaatgctatcggtgcggcgagaccggccacgtggccatcaattgcagcaaaacatcagaggtgaactgttaccgctgcggtgagtctggccatctcgctagagaatgcactatcgaggccactgcatag

SEQ ID NO: 30422 - DNA, 1140 bp, Artificial Sequence
  Description of Artificial Sequence: Synthetic coding sequence
gctagagcagttccagtggggtccggtctgaggggactgcaaaggacgctgccactcgtggtgattctgggagctactggcactggtaagtctacattagctctgcaattgggacagcgtctcggaggtgagatcgtttccgccgactccatgcaaccccaagaaatggggacagaaaaagtgatcgataggaaagtcgaactcgaaaaggaggatggcctggtacttcacaaacgtctgtcacaggtggatcctgaaatggccgctaaactgcaccctcacgataaacgtaaggtggccaggagtctgcaagtgttcgaagaaacaggcatatcacattcagagttcctccacaggcaacacaccgaggagggtggcggaccgttaggcggacccttgaagtttagtaatccctgcatactttggctgcatgcagatcaggccgatgaaagactggacaagcgggttgacgatatgctggcagccggactgctcgaagagcttcgggatttccatcgcaggtataaccagaaaaatgtatcggagaattcccaagattaccagcacggaatattccagagtatcgggttcaaagagtttcatgagtacctgatcactgaaggcaaatgcaccctggagacttccaatcaactgctgaagaaaggcattgaggcacttaagcaggtgacaaagcgatatgcacggaagcagaacagatgggtgaaaaatagatttctgtcccgccctggcccaatcgtacccccagtgtatggccttgaggtgtctgatgtctccaagtgggaggaaagtgtcctagagcctgcgctggaaatagtccagtcttttattcaggggcacaagccgacagctacacccatcaagatgccctacaacgaggctgagaataagagaagttaccacctctgcgatctctgtgatcgaattatcatcggggacagggagtgggctgcccacatcaagagcaagtcacatttgaaccagttaaaaaaaagacggaggttggacagcgacgcagtcaacacaatcgagtcccagtcagtgtctcctgatcacaataaagagcccaaggagaaggggtccccaggccagaatgatcaagagctcaagtgttccgtgtag

SEQ ID NO: 30423 - DNA, 483 bp, Artificial Sequence
  Description of Artificial Sequence: Synthetic coding sequence
atggaagcagaaagaccccaggaagaagaagatggggaacagggtccccctcaagatgaggagggctggcctccccctaatagcaccacacgtccttggcggtccgctcctcctagccctcctccacctggaaccagacacaccgcccttggaccccgatccgcaagtcttttgtcgctccagaccgaattgctgctggacctagtggctgaggctcagagtagacgactggaggagcaacgggcaaccttctacacacctcagaatcctagttcccttgcccctgctccactccggccactcgaagacagggagcagttgtactcgaccatcctgtcccaccagtgccagaggatggaggcccaaaggagtgaaccccctcttcctcctggtggacaggagctgctagagctcttgttacgagtgcagggcggtggtcggatggaagaacagagatcacgaccacccacacacacatgctag

SEQ ID NO: 30424 - DNA, 816 bp, Artificial Sequence
  Description of Artificial Sequence: Synthetic coding sequence
atgaacctggagaagcttagcaagccggaacttctgacgctgttttccatccttgagggggagctggaagctcgggacctggtcatcgaggcactcaaagcgcaacacagggacacatttattgaggagaggtatggtaagtacaacatttccgatcctctaatggcactacagcgagattttgagacactgaaagaaaagaatgatggagagaagcagcctgtttgcacaaaccctctcagtatcctgaaggttgttatgaagcaatgcaaaaacatgcaggaacgcatgctatcacagctggcggctgcagagtctcgacacagaaaggttattctggatctggaggaagagcgtcaacggcacgcccaggacacggcggaaggcgacgatgtcacttatatgctcgaaaaggagagggaaagactcacgcagcagctcgagttcgagaagtcgcaggtgaagaagttcgagaaagagcagaaaaagctgagttctcaactggaggaggaaaggagcaggcataagcagcttagcagcatgttagtcctcgagtgtaagaaggctacaaacaaggctgcggaagaaggtcaaaaagcaggagagctgtctctgaaactcgaaaaagaaaagtctagagtctcgaagttggaagaggaactggcagctgagcgtaaaaggggcctgcagaccgaggctcaagtggagaagcagctgagcgagtttgatatcgagagagagcaactgagagccaagctgaacagagaggaaaacaggacaaagacattaaaagaagaaatggaaagtctgaaatag

SEQ ID NO: 30425 - DNA, 1482 bp, Artificial Sequence
  Description of Artificial Sequence: Synthetic coding sequence
atggatcaagattacgaacgcaggctgttgaggcagattgtgatccagaacgaaaatacaatgcctcgcgtcaccgaaatgcgcagaaccttgactcctgcttcctcacccgtttcaagtcccagtaaacacggggataggtttatcccctcaagggctggcgcaaactggagcgttaatttccacagaataaatgagaatgagaaatcgccaagccaaaatagaaaggccaaggatgcgacatctgacaacggaaaggatggccttgcgtattcagcactgctgaagaacgaactgctgggtgctggtatcgaaaaggtgcaggatccacagacagaagaccgccgactccagccctccacaccagagaagaagggcctgttcacttactccctatctaccaaaaggagctcacctgacgacgggaacgatgtctccccttattctctgagtcctgtgagcaacaaatcccagaaactgctgaggtccccacggaagccaacacgaaaaatttctaagatcccgttcaaggtgctagatgctcccgaactccaggacgatttttacctgaacttagtagattggtcctctctgaatgtgctgagcgtcggactcggaacatgcgtgtatctctggagcgcctgcacaagtcaggtcacacggctttgcgatctgtccgtggagggagacagtgtcacgagtgtgggttggagcgaaagagggaacctagtggcagtgggcacgcacaaaggctttgtccagatctgggacgctgccgcaggaaagaaattgtctatgctggaaggtcataccgccagagttggcgctctggcctggaatgctgaacaactgagctctgggagtcgcgaccgcatgattctgcagagagatattcgcaccccacctcttcaatccgaaagaagactgcagggtcatcggcaagaggtgtgcggactcaagtggtctacagaccaccagttgttggcttccggagggaatgacaacaaactcctggtgtggaatcactctagccttagtccagtgcaacagtataccgagcacctagcagcagtcaaagctatcgcatggtcaccccatcagcacggcctcctcgcatccggagggggtacagcagatagatgtatacgattttggaataccctgaccggccagccattacaatgcatcgatacaggaagtcaggtttgtaatctcgcatggtcaaaacatgctaacgaattggtctccacccacggatacagccagaaccagatcctggtgtggaagtacccatcccttacccaagtggccaagcttactggtcattcgtaccgggtgttgtatcttgctatgtcaccagacggggaggcaattgtcacaggcgctggagacgaaaccttgcgcttctggaacgtgttcagtaagacccggtccacaaaggagtccgtgtccgttctcaatctgttcacccggatacgatag

SEQ ID NO: 30426 - DNA, 552 bp, Artificial Sequence
  Description of Artificial Sequence: Synthetic coding sequence
atgaagaaggaacatgtgctccactgccagtttagtgcatggtaccctttcttccgaggtgtcactataaagagtgtgatcctcccactgccccagaacgtcaaggactatttactcgatgatggcactctggtggtgtcaggtcgtgatgacccaccgacacactcacaaccagactctgatgatgaagccgaggagatccagtggtctgacgacgagaacactgccaccttgaccgacgcttactggatcgcaatgaatagtagcctcaaatgtaagaccctcagcgacatctttctgctattcaagtcctctgatttcataactcgggatttcacacagcccttcatacactgcaccgacgactcgccggacccctgtatagagtatgaactggtcctgcgtaaatggtgtgagctgatccctggcgctgaattccgctgttttgtcaaagaaaataagttaattgggatctcacagcgcgattatacacagtactacgatcacatctcaaaacagaaggaggagattcgcaggtgcattcaggattag

SEQ ID NO: 30427 - DNA, 672 bp, Artificial Sequence
  Description of Artificial Sequence: Synthetic coding sequence
atggaagacgtgaagctggagttcccttccttacctcagtgcaaagaagatgctgaagagtggacctaccccatgagacgagagatgcaggaaatccttcccggtttgtttcttggtccctactcctccgctatgaagtctaagctcccagtactccaaaaacacgggataacacacattatttgcatccggcagaacatagaggctaattttattaagcccaatttccagcagctattcaggtacctggtcctggatattgcagacaacccagtggaaaatataattaggttttttccaatgaccaaggagttcattgacgggagcctgcagatgggaggtaaggtgctggttcatggtaacgccggtattagccgctccgccgcattcgtgatagcatacatcatggagactttcggcatgaagtatagagatgccttcgcctacgtacaggaaagaagattctgtatcaaccctaacgcaggctttgtgcaccagctccaggagtacgaggccatatatcttgctaaactgacaatccagatgatgtcccccctgcaaattgagcggtccctgtccgtgcactctggcacgacaggttcactgaaaaggacgcacgaagaggaagatgacttcggcaccatgcaggtggccactgctcaaaatgggtag

SEQ ID NO: 30428 - DNA, 348 bp, Artificial Sequence
  Description of Artificial Sequence: Synthetic coding sequence
atgcccatcctgctgtttctaatcgataccagcgcaagtatgaaccagcggtcacacctcggcactacatatctggacaccgccaagggcgcagtcgagactttcatgaagctgcgcgctcgcgatcctgcttctcggggagacaggtacatgcttgtcacctttgaggagccaccctacgcaatcaaagccggttggaaggaaaaccacgccacattcatgaacgagttaaaaaatctccaagcagagggactgactaccttaggacaatctctgaggactgccttcgatctgctgaacctgaatcgtttagtaactggtattgacaactatggacaggtggggtag

SEQ ID NO: 30429 - DNA, 390 bp, Artificial Sequence
  Description of Artificial Sequence: Synthetic coding sequence
atggccgaactgatccagaaaaagttgcagggcgaagtggagaaatatcagcagctgcagaaagatttatcaaaatctatgagtggaaggcaaaaattagaagcccagctaacagagaacaatattgtaaaggaagagcttgccctgcttgacgggagtaacgtggttttcaaattactggggccagtgcttgtgaagcaagagctgggggaggcccgtgcaaccgtgggaaaacgcctggattatatcacagctgagattaaaagatatgagagtcaactccgcgacctggagcgccaatctgagcagcagcgagagacactggcccaactgcaacaggagttccagcgcgctcaggctgcgaaggccggagcgccagggaaggcttag

SEQ ID NO: 30430 - DNA, 2676 bp, Artificial Sequence
  Description of Artificial Sequence: Synthetic coding sequence
atggtagcaccagtgctggaaacttcccacgttttttgttgccccaatcgtgttagaggggttttaaactggtcctctggcccacggggtctgctggctttcggcaccagctgctctgtggtgctgtacgatcccctgaagcgcgtggtagtcactaacctgaatgggcacaccgcccgtgtaaactgtatccagtggatttgcaagcaagatgggtctccgtcaacagagttggtgagcggaggctcagataaccaggtcatccactgggaaatcgaggataatcagctcctgaaggccgtacacctccaagggcacgagggcccagtctatgctgtgcacgctgtgtaccagagacgaacttctgatcccgctttatgcaccctgatcgtgtctgccgctgccgattctgcagtacgtctgtggagcaaaaagggccctgaggtaatgtgtcttcagactcttaatttcgggaacggattcgcactggcactttgcctcagttttttgcctaacactgacgtaacctggaaaaccggacaggtggagcgagggagagcttggaagcctccggcttctcttgccctgtgttcgcgcagttgcgattctatggtgtcttgctatgcaagcattctgtgtaaggcactgtggaaggagaaactgcataccttctggcatcataacagaatcagcttcctaccgagtgcatttcgaccgattcccattttagcttgtggaaatgacgattgtcgcatacacattttcgcacagcaaaatgatcagttccaaaaagtgctgagtctctgcgggcatgaagattggatcagaggcgtggagtgggccgcattcggacgtgatctgttcctcgcgtcgtgctcccaggattgcctaatccgaatttggaaactgtatatcaagtcaactagcctggagacccaagacgatgacaacattcgcctgaaggaaaacacctttaccatagagaacgagtctgtcaagatcgcgttcgcagtgacacttgagactgtccttgccggtcacgaaaattgggtcaacgcggtgcattggcaaccggtcttttacaaggatggagtgctgcaacagcctgtgaggcttctcagcgcctccatggacaagactatgatcctgtgggccccagacgaggaatcaggggtttggttggaacaggtgcgtgtgggggaggtgggtggtaatactctcggtttctatgactgtcagttcaacgaagatggcagtatgattatcgcccacgctttccacggggcactgcatctatggaagcagaatacagttaatccccgtgagtggacccccgaaatcgtgatatcaggccatttcgacggtgtacaagatcttgtctgggatccagagggagagtttattatcacagtaggaactgaccagactactcggttgttcgcaccatggaaacgtaaggaccagagccaggttacatggcatgagattgccagaccacagatccacggctatgacctgaagtgccttgccatgatcaataggttccaatttgtttccggggcagacgagaaggtgctgagagtatttagcgccccaagaaatttcgtagaaaacttttgtgcgattaccgggcagagtctgaatcatgtgctgtgcaaccaggattctgacctccccgagggcgcaactgtgcctgcgctgggactaagcaacaaggcagtgttccagggagatatcgcttcgcagccatcagacgaggaggagctgttaacatcaactggctttgagtatcagcaggtggcgttccagccatccatccttactgaaccaccaacagaggatcaccttctgcagaacacgctctggcccgaagtccagaagttgtatggccacggctacgagattttctgcgtgacctgtaatagcagcaaaactctgctcgcatccgcctgcaaggcagcgaagaaggagcatgctgccatcattctatggaacacaactagttggaagcaggttcagaatctggtgtttcactccttaacagttacccaaatggctttcagccctaacgaaaagttcctgctggccgtgtccagagataggacatggtcactgtggaagaaacaggataccatctccccagaatttgagccggtcttctcattgtttgctttcacaaataaaatcacttctgtacactcccgaatcatttggagttgtgattggtcccccgatagtaagtacttcttcaccggcagtagagacaaaaaggtagtagtgtggggagagtgcgactctacagacgactgtatcgagcacaatattggcccttgctctagtgttttagatgttgggggtgcagtaacggccgtgtctgtatgccctgtactccaccctagccagaggtacgtggtcgcagtaggcctcgagtgcgggaagatatgcctgtatacttggaagaagactgatcaggttcctgagatcaatgactggacccattgtgtagagacaagtcaatcacagtcccataccctggccattcgcaagctgtgctggaagaattgttccgggaagactgagcagaaggaggccgagggggcagagtggcttcacttcgcatcctgcggtgaggaccacactgttaaaattcaccgcgtgaacaagtgcgcactgtag

SEQ ID NO: 30431 - DNA, 573 bp, Artificial Sequence
  Description of Artificial Sequence: Synthetic coding sequence
atgggcccactgccccgaaccgtggaacttttttatgacgtgctgagcccatattcatggcttggctttgagatactttgcagatatcagaatatctggaacatcaatctgcaactgcggccttcacttatcacgggtatcatgaaggactcaggcaataagcctcccggtctgcttcccaggaagggcctctatatggctaacgatttgaaactgctgagacatcatctccaaatccctattcacttcccaaaggactttctttctgttatgctggagaagggttctctatccgcaatgcggtttttgaccgccgtcaacctcgagcatcctgagatgctggagaaagcttcccgggagctatggatgcgcgtgtggagcaggaacgaggatattactgaacctcagtctatcctcgctgcagcagagaaggctggaatgagtgctgaacaggcccagggtcttctcgagaagattgctacccctaaggtcaagaatcagttgaaagaaaccacagaagccgcatgcaggtacggcgagagaagtggatgggcattgtaccttcaaccgtag

SEQ ID NO: 30432 - DNA, 1482 bp, Artificial Sequence
  Description of Artificial Sequence: Synthetic coding sequence
atgatgaaaagacagctgcataggatgaggcaactcgcacagacgggctcccttggccgtacacctgagactgccgagttcctgggggaagatctactccaagtggaacaacggttagagccggctaaaagagcagcccacaatatccataagcgactccaggcctgtctccagggtcagagcggagcggacatggacaaaagagtgaagaagctcccattgatggccctgtcaactactatggcggagtcattcaaggagctggacccggatagttccatgggcaaagcactggagatgtcctgtgctattcagaatcaattagcccgtatcctcgctgaatttgagatgaccctggaaagagatgtcctgcagcctctttcacggctctccgaggaagaactccctgctatcttaaagcacaagaagtctctccagaaacttgtatccgattggaacaccctcaagagcagactcagccaggcgacgaaaaatagcgggtcctctcaaggtctgggtggatcacctggatctcacagtcataccacaatggccaacaaagtggaaacgcttaaggaggaagaggaagaactgaaaaggaaagttgaacaatgccgagacgaatatcttgccgacctctaccatttcgtgaccaaggaagacagctatgccaactacttcatccgtctgcttgaaatccaggcggactatcaccgcagaagtctgagcagcttggataccgcccttgctgagctacgcgagaatcacgggcaggctgatcacagtccttcaatgactgcaacgcacttcccacgggtgtatggggtgtcactggcaacccatcttcaggaactgggtagagagattgcactgccaatcgaagcctgcgtgatgatgctgttgtctgaaggaatgaaggaggaaggtctattccgcctggcagccggagcatcagtcttaaaaagactgaagcagacgatggcgagtgacccccactccttagaggaattctgtagcgatccgcacgccgtggctggagcccttaaatcatatctccgggaactgccagagcccctgatgactttcgatctttatgatgattggatgcgggcagcctcgctgaaggaacctggtgccaggctgcaggctctccaggaagtgtgcagtcgtctgccgccagagaacctctctaatctgaggtatctgatgaagttcttagccaggctcgcagaggaacaggaagtaaacaaaatgactccatctaacatcgcgatcgtactgggtccaaacctgctctggccaccggagaaagagggtttggagtattccggtgccatcagtgcacactgcaacctacgactgcccggatcctctgacagctcagcttctgcatgccaagtggcagggactaccggaacccggccttcttggatgcagccgccatgcctcccaagtagatggtgggcttcttccaggaggtag

SEQ ID NO: 30433 - DNA, 45 bp, Artificial Sequence
  Description of Artificial Sequence: Synthetic coding sequence
atggctatggctccttcgccttcattggtgcaggtctatacctag

SEQ ID NO: 30434 - DNA, 828 bp, Artificial Sequence
  Description of Artificial Sequence: Synthetic coding sequence
atgtctgccgaagtgaaagtgaccggccaaaaccaggaacagtttctgctgctagcaaaatccgctaaaggcgctgctttagcaacactgattcaccaggtcctcgaggcccctggcgtgtatgtgttcggagaattattagatatgcccaatgtgagagagctggctgaatcggacttcgcttccacattccggttgctgaccgtgtttgcatatgggacgtacgctgattacttggctgaagcccgaaacttgcctcccttgactgaagcccaaaaaaataagctgagacacttgtctgtggtcacactggcggcaaaggtcaaatgtattccatatgctgtgttgctggaggccctagcgttgagaaatgtgagacagcttgaggacctagtaatcgaggctgtgtatgcggacgtgttgagggggtctttggaccagcgcaatcagaggctggaagtcgactacagcattggcagagatattcaaagacaggatctcagtgccatcgcaagaaccctccaggaatggtgtgtcgggtgcgaggtggtcttgtctggtatcgaggagcaggtttcacgggctaaccagcacaaagaacagcagctgggtctcaagcaacagattgaatctgaggttgctaatttgaaaaagacaattaaagtgacgaccgcagccgctgccgcagccacgagtcaggatcctgaacagcacttgaccgagctccgggaacccgctcccggaacgaatcagagacagccctctaagaaagctagcaagggtaaaggcctaagaggcagtgccaaaatttggtcgaagagtaactag

SEQ ID NO: 30435 - DNA, 1506 bp, Artificial Sequence
  Description of Artificial Sequence: Synthetic coding sequence
atggccgctcccgaaccggctccaaggcgggctagagagagggagcgcgaacgagaagacgaatcagaagacgagtcagatatcctcgaggagagtccttgtggtcgctggcagaaaagacgggaacaagtgaatcagggaaatatgcccggtctccagtccacctttctggccatggacacagaggaaggagttgaggtcgtctggaacgagctacactttggcgacaggaaagccttcgctgctcacgaagaaaaaatacaaaccgtgtttgagcaactcgtgctggtcgatcatcctaacatcgttaaactgcataaatattggcttgatacttctgaagcttgtgctcgggtcatttttatcaccgaatatgtatcctccgggagcctgaagcaatttctgaaaaagaccaaaaagaatcacaaggcaatgaatgcgagggcatggaaacggtggtgtacccagattttatctgccctctccttcttgcacgcgtgttcaccccctatcattcacggtaatcttaccagcgatacaatctttatccagcacaacggtctgatcaagataggctcagtgtggcaccgcatattctctaacgcacttccagacgatctgaggtctccaataagagccgagagagaggagttgaggaatctccacttcttcccaccagaatatggcgaagtggccgatggaactgctgtggacattttcagctttgggatgtgcgctctggagatggcggtgctggagattcaaactaacggcgacactcgcgtcacagaagaagccatcgcacgagcacgccattcgctgagtgacccaaatatgcgagaatttatcctgtgttgcctggcgcgagatcccgcacggaggccgagcgcacattctctgctgtttcacagagtgctgtttgaagtgcactccctaaagttactcgcagcgcactgcttcattcaacaccagtacctcatgccagaaaacgtagtcgaagaaaagaccaaagctatggacctacatgccgtgttagccgagctgccgaggcctaggcggcctccactgcaatggcggtacagcgaagttagctttatggagctggacaagttccttgaggatgtgaggaatgggatttaccccctaatgaactttgcggctactagacccttagggctgccacgggttttagccccacctcctgaggaagtccagaaagctaaaaccccaacgcccgaaccattcgatagcgaaacgcgaaaggttattcagatgcagtgtaacctcgaaaggtcagaagacaaggcacgatggcatttaactctcctgctggtcctcgaggacagactccacagacagctgacctatgacctgctgcctaccgactcggctcaagatctcgcatcagagctggttcattacgggtttctccatgaagacgataggatgaagttggccgcatttctcgagtctaccttcttgaagtatagagggacccaggcatag

SEQ ID NO: 30436 - DNA, 36 bp, Artificial Sequence
  Description of Artificial Sequence: Synthetic coding sequence
atgactgcaccttcctgtgccttcccagtacaatag

SEQ ID NO: 30437 - DNA, 534 bp, Artificial Sequence
  Description of Artificial Sequence: Synthetic coding sequence
atgcttttggacaagaatgtccccaatccaaggataaagttaatcgacttcggaatcgcccacaagatcgaggctggaaacgagtttaagaatatcttcggcacaccagaatttgtggcacccgagatagtcaattacgaaccgctcggtctagaagccgacatgtggagcattggggttatcacttatatattgttatcaggggcatccccctttcttggcgagaccaagcaggaaactctaaccaacatctccgccgtaaactatgatttcgacgaggaatatttcagtaacacctcggaacttgcaaaggactttattcgcaggctgctcgtaaaggacccgaagcgcaggatgaccatcgctcagtcgttggagcacagttggatcaaggccatcaggaggcggaacgtcagaggggaggattctgggaggaagcccgaaagacgcaggctgaagactacaagattgaaagagtacacaattaagtctcactcgtcagcctcacccattgtggcccctgtggatgcttag

SEQ ID NO: 30438 - DNA, 615 bp, Artificial Sequence
  Description of Artificial Sequence: Synthetic coding sequence
atgggcgacaagaagtctccaactaggcctaagaggcagcctaagccttcgtccgatgaagggtattgggattgcagtgtgtgtacctttcggaatagtgccgaagcatttaagtgcatgatgtgtgatgtgagaaaggggacttccaccagatcaactttgtttgaagtcattgtcagcgcaagccgaacaaaggaacctctgaaatttcccataagtggacgcaaacccaggcccgtttcccagttggtggcacaacaggttacacagcagtttgtacctcctacacagtcaaagaaggaaaagaaggataaagttgaaaaagaaaaatccgagaaggaaaccacaagtaaaaaaaattcgcacaaaaagacacgacccagactcaaaaacgtggatagatctagtgcacagcacctcgaagtgacggtgggggatcttaccgtcatcatcaccgattttaaggagaaaacgaagtctcctccggcatccagtgccgcaagcgcggaccagcacagccaatccggatcttcaagtgacaatactgagcggggtatgagccggtctagttctccgagaggcgaagccagcagtttgaatggtgagagccactag

SEQ ID NO: 30439 - DNA, 1350 bp, Artificial Sequence
  Description of Artificial Sequence: Synthetic coding sequence
atgatgcttggaaccgaagggggtgaagggtttgtggtgaaagtcagaggtctgccctggagctgctccgcggacgaggttcagcgatttttttcggattgcaaaattcagaacggcgctcagggcattaggttcatttatactagggaaggaaggccaagcggcgaagcctttgtcgaactggaatcggaggatgaagtcaaactggcccttaaaaaggacagggaaacaatgggacacaggtatgttgaggtgttcaaaagcaacaatgtggagatggattgggttctgaaacatacaggccctaatagccctgatacggctaacgacgggtttgtgcgactgaggggtttgccgttcgggtgttcaaaagaagaaatagtgcagtttttcagtggcctcgagatcgtcccgaatggcattacgctacccgtggattttcagggcaggtccaccggggaagccttcgttcaattcgcctctcaggaaattgctgaaaaggccctgaagaagcacaaggagagaatcggccatcggtacatcgaaatatttaaaagtagcagggctgaagttcgcactcactatgacccaccaaggaaactcatggctatgcagagacccggtccatacgaccgtccaggggctggccgaggatataatagtatcggtcgcggtgctgggttcgagcgtatgcggagaggcgcttacgggggaggatatgggggatatgacgactacaatgggtataatgatgggtacggttttggatcggatcggtttggtagggacctgaactactgcttttctggcatgtcagaccatagatacggagacggaggatcgacctttcagtcaactaccgggcactgcgtccatatgagaggactgccttatagagccaccgagaacgacatttataacttcttcagccctctgaacccagttcgagtgcacatcgaaattggaccggacggacgggtgactggagaggcagacgttgagtttgcgacacacgaagatgccgtagcggctatgtctaaagataaagctaatatgcagcatcgctacgttgagctgttcctgaactcaaccgccggagccagcggcggagcatatgaacaccgctacgtggaactttttctgaactcaactgctggagccagtggcggagcttatggaagccagatgatggggggtatgggcctgagcaatcagagcagttatggtgggccagccagccagcaactgtcaggcggttatgggggagggtacggcggacagtctagtatgagcggatacgaccaggtactgcaggagaattccagcgatttccagtccaatattgcctag

SEQ ID NO: 30440 - DNA, 153 bp, Artificial Sequence
  Description of Artificial Sequence: Synthetic coding sequence
aaaacaggactgacaggcagcccttcttccctgtgggatctgctgagagaaatgttcgttgtctgctccaaggagcagctacagtccggcggaaagtacagccatcaggtttgggcgcctttttcgcccttggccagcggcgcagctttttag

SEQ ID NO: 30441 - DNA, 4386 bp, Artificial Sequence
  Description of Artificial Sequence: Synthetic coding sequence
atgcagcgagagttagtgtacgcacgcggagatgggcctggcgctcccaggccagggtcaacagctcatcctccccacgccatccctaactcgcccccatccacccccgtaccccatagtatgccgccatctccctctcggatcccctacggtggcaccagatctatggtggtccctggtaacgccacaatcccacgcgacaggatctcttctttgcccgttagcagaccaatctcgcccagcccttcggcaattcttgaacgccgtgacgtcaagccagacgaggatatgtccggaaagaatatagcaatgtacagaaacgaagggttttatgccgacccttacctctaccacgaggggagaatgtcgattgcctcatcgcacgggggacaccctcttgatgtgccagatcatattatcgcatatcaccgcaccgcaattagaagtgcttctgcatactgtaaccctagcatgcaagccgagatgcatatggagcagtcactgtataggcaaaaatccagaaagtacccagacagtcacctgccaaccctgggctcaaagaccccacccgctagtccacacagagttagtgatttgcggatgattgacatgcacgctcactataatgctcacgggccaccccacactatgcaacctgatcgcgcttctccttcgaggcaggcgttcaagaaggagcccggaactctcgtgtacattgagaaacctcgatccgccgctggtctctccagcctggtcgacctgggtcctccactgatggagaagcaagtgttcgcgtattctaccgctactatcccaaaggacagagaaaccagtgagaagatgatgaaaactaccgccaaccggaaccacacagacagcgcgggtactcctcatgtttctggagggaaaatgctttctgcactcgagagcaccgtccccccttcgcagccgccaccagttgggactagcgcaattcacatgagtctgctcgaaatgcgtagatctgttgccgaacttagactgcagctccaacagatgaggcagctgcaattacagaatcaggagctgctccgtgcgatgatgaagaaagccgagttagaaatttcaggaaaggtgatggaaaccatgaagaggctagaagatcccgttcaaaggcagagggtcctcgttgagcaggagcgacagaagtacctccatgaggaagagaagatcgttaagaagctctgcgaactggaggacttcgttgaagatcttaaaaaagatagtacggctgccagccggttggttacgcttaaggatgttgaggacggtgcctttctccttcgacaagtgggggaagccgtggctacactcaagggggagttccccactctccagaacaaaatgagagcgattctcaggatagaggttgaggccgtaagatttttgaaggaagaaccccataagctcgactccctgcttaaacgcgtcaggtccatgaccgacgtgctgacaatgctgcgcaggcatgtaactgacggactcttgaaaggaaccgacgctgctcaggccgctcaatatatggccatggagaaagcaaccgccgctgaggttctaaagagtcaggaggaggcagctcatactagcggtcagccattccactccacaggcgcacctggcgacgctaaaagcgaggtggtccccctcagtggcatgatggtgagacatgctcagtcctcccctgtggtgatccagccctcacagcatagtgtggctcttttgaatcctgcccaaaacttaccccacgtggccagttcacccgctgtgccccaagaggcaaccagcactctccaaatgtcacaggctccacagagcccacaaatacccatgaacggtagcgccatgcagagcctattcatcgaggaaattcattccgtctctgctaaaaatcgtgccgtctccatcgaaaaggcagagaaaaagtgggaggaaaaacgccagaaccttgaccactataacgggaaagaattcgagaaactgcttgaggaggctcaggctaacatcatgaagagcattccaaatctggagatgccacccgctacgggccctcttcctagaggcgatgcgcctgtcgacaaagtcgagttgagtgaagacagtccaaattcagaacaggaccttgagaagctgggaggcaaatccccacctcccccacctccacctccccgacggagttacctgcccggttctggactgaccaccacgaggtccggcgatgtcgtgtacaccgggcgtaaggaaaacattaccgcaaaggcctccagtgaagacgccggacccagcccccaaaccagagccacgaaatatcctgccgaggagccagcctctgcctggacgccctcaccaccaccagtgactacctcatcctctaaggatgaggaagaagaagaagaagagggtgataagataatggcagagctgcaggcatttcagaaatgttcattcatggacgtgaactcgaatagccacgccgaaccctctcgcgcagactctcacgtgaaagacacgcgtagtggagcaaccgtgccccctaaggagaagaaaaacctggagttctttcatgaagacgtgagaaaatccgacgttgaatacgagaacggcccacagatggagtttcagaaggtaaccacaggggcagtcaggccgagtgaccctcccaagtgggaaagggggatggagaacagtatttccgacgcatctagaacatccgaatataagaccgagattatcatgaaagagaactctatttcaaacatgagcctcctgcgggattccaggaattacagtcaagagaccgtacctaaagcttcgttcggcttttccggaatctcaccactggaggacgagatcaacaaaggcagcaagattagcggtcttcagtactcgattccagatacagaaaaccagacactcaattatggaaaaaccaaggagatggagaagcagaacacagataaatgccacgtgagctcccatacccgcctaacagagagctcagtgcacgacttcaaaactgaggatcaggaggtcataactacagacttcgggcaggtagtgcttcgaccaaaagaagcgcgacacgcaaatgtgaaccccaatgaagacggagaaagctcctcgagttcccccaccgaggagaacgctgccaccgacaacatagcttttatgatcacagagacgaccgtgcaggtgctgagttccggcgaggtgcatgatattgtaagccagaaaggggaagacatccaaaccgtgaatattgacgctaggaaggagatgacaccacgacaggaggggaccgacaatgaagacccagtcgtgtgcctggataagaagcctgtgatcatcatctttgacgaaccaatggatatccggagcgcttacaaacggctctcaacaatttttgaagagtgtgacgaagagcttgagaggatgatgatggaggaaaagattgaagaggaagaagaggaggagaacggagacagtgtggtccagaacaacaatacctctcagatgtctcacaagaaagtcgccccaggcaaccttcgtacgggtcagcaggtcgaaactaaatcccagcctcacagcttggccacagaaacccgcaatccaggaggtcaagagatgaaccggactgaactgaacaagttcagccacgtggatagtcccaatagcgaatgtaagggcgaagatgccacagacgaccagtttgagtcaccgaaaaaaaaatttaagtttaaatttccaaaaaagcagttggccgcactcacccaggccattagaactggcaccaagacaggaaagaaaaccttgcaggttgtggtctatgaggaggaagaagaggacggcacgttgaaacagcacaaggaagccaaacgctttgagattgccagatctcaacccgaggatacccctgagaacaccgtgcgcagacaagaacagccatcaattgagtcaaccagcccgattagtagaacagatgaaatccgaaaaaacacgtaccgcacactagattctttagaacagaccatcaagcagctcgagaatacgatcagtgagatgtccccaaaagctctggtcgatactagctgcagctcaaatagggattcagttgcatcctcttcccatattgctcaggaagcctcgccccgacccttacttgttccggacgaggggccaacagcactcgaacctccaacaagcatcccttccgcatcaaggaaagggtcctcaggcgcaccacagacatcccgaatgcccgtacctatgagcgcaaaaaacaggcctggtactcttgacaagcctgggaagcagagcaaacttcaggatcctcgccagtatcgccagtag

SEQ ID NO: 30442 - DNA, 2118 bp, Artificial Sequence
  Description of Artificial Sequence: Synthetic coding sequence
atgctaaccctactggctgaagatcgggctgtgccaagcgccccaaccggaccagggcctctgcttgagtttgctttgcatgaagatctcctgacccgcgttttaacgtggcagctgcaatgggatgaactaggtgatggagttgaggagcgtcgggcagagcaactcaaactcttcgaaatgctagtctctgaagcccgtcagccgctgctccgtcatggccctgtgcgtgaggcactgctgacactattggacgcatgcgggagaccggtgccctcttctccggcactggacgagggcctcgtgctgttgctcagccaactgtgcgtgtgcgtcgctcaggagcccagtcttctggaatttttcctacaaccgcctccagagcctggtgccgcaccacggctgctattattctctagactcgtcccattcgtacatagggaagggactctcgggcagcaagctagagacgcactgctgttattaatggctctgagtgcaggaagtcccaccgtaggacggtacatcgcagaccattcctatttctgccctgtcctggctacgggtctttccgccttgtattcaagcctcccaaggaaaatagaggtgccaggtgatgactggcactgccttaggagagaagattggctgggagttcccgcactggccctcttcatgagctccttggagttctgcaacgctgtcattcaggtcgcacaccccctcgtgcagaagcagctggttgattatatccataacggtttccttgtccccgtcatgggtccggctctccacaagaccagtgtggaagaaatgatcgctagtaccgcctacctagagcttttcctccgctccatttcggaaccagccttgttgcggactttcttgaggttccttttgctgcatcgacacgacacacacactatcctcgacactctcgtggcgagaattggatctaacagcaggttgtgcatggtgtcactgtccctgttcagaacgctattgaacctaagctgcgaggacgtgttgctccaactggtgctccgctatctcgtgccatgtaaccatgtgatgttaagccagaagcctgccgttagagatgttgatctgtacggcagggcagctgataaatttctcagtctgattccaaggtgctgtagacaccatgcgccttcgccccctagaccagagcatgccagttgggcccgtggtccgggtagcccatccgtcgacagctcgtcggtcacaaccgtcccacgacccagcacaccaagccgactggcattgtttcttcgacagcaaagcctcgggggatcagagtcacctggaccagccccatgttcacccggtctgtcagcaagcccagcctcttcaccagggaggcgcccaacccctgccgaagagcctggcgagctggaggacaattacctcgagtacttgagagaggccaggcgtggagttgaccgttgcgtcagagcttgcaggacgtggtctgctccatacgacggggagaggcccagtccagagccttctcccttcggttcacgaactaagaagcggtctctactgcctgaagaggatagaaataacgtgggtgaaggggaagaggaggagcttgggaggagaggtcgggctggcggtgctggcgagggacccggtcatctgccacctccacagctcaacggcgtccccggaagttggccggagggggctaaaaaagtgagactggtgcctaaagagggcgctggagaactgctggagggcatctccgagggcatggccggactagaaggcttcggacaagaattgagagagctggaagtagctctttctaacggcggaaccggctccgagtcacccctcgagcccccactccctctggaagaggaagaagcctatgaatccttcacttgtcctccagaaccccctggcccattcttgtcttcaccgctgaggactctcaaccagctcccaagccagccattcaccggacctttcatggccgtgctgtttgcaaagctggaaaatatgctccagaacagcgccctcagctgcagtacaccgacatggagtagctccccagtttcttccccttgctgcagatgttgggcactgtag

SEQ ID NO: 30443 - DNA, 804 bp, Artificial Sequence
  Description of Artificial Sequence: Synthetic coding sequence
atgatgaggggatatattaaaaaggtccttaaaaatacctcctatcatgtaaatcaatacctgttcatacaacacgggtggtccgggtctggagaccagtctgtcttgtactcttgcaacctcatgcggatggtcacccggaccaaaaaaatttttgtcgggggactgtccgcaaacacggtggtggaggacgtaaagcagtattttgagcagtttggcaaggtggaggatgctatgctcatgttcgataagaccacaaatagacaccggggatttggcttcgtgactttcgaaaacgaagatgtcgtggaaaaggtctgcgagattcatttccatgaaatcaacaataagatggtcgagtgtaagaaggctcaacccaaggaagtaatgtttcctccaggtaccagaggtagggccagaggtctaccatataccatggacgcctttatgctgggtatggggatgctgggataccccaactttgtcgctacatacgggagaggctacccaggattcgcccctagctacgggtaccaatttcctggcttccctgctgccgcttatgggcctgtggccgcagccgctgttgcggctgccagagggagcgggtctaatcccgctcgccctggcggttttcctggcgctaattcgccgggtccagttgcagatctgtacgggcctgcttcccaagatagtggggtgggaaattatatatctgcagcaagccctcagcctggaagtgggttcggacacggtatcgccggaccactcattgctacagccttcacgaacggctaccattag

SEQ ID NO: 30444 - DNA, 483 bp, Artificial Sequence
  Description of Artificial Sequence: Synthetic coding sequence
atgtcttctccattggcctccctgagtaaaacgcgtaaggtgccactacccagcgagcctatgaatccaggacgtagagggattagaatttacggggatgtacccgcatcccacgactctgaacttatggcattcatgacccgtaagctgtgggatttggagcaacaggtgaaagcccagaccgatgaaatcttaagtaaggatcagaagattgcagcactggaagatctggtgcaaaccctgaggccacatccggctgaagcgactttacagcgtcaggaggagctggaaaccatgtgcgtgcagctacagcgccaggttcgggagatggaacggttcctttccgattacggcctgcagtgggtgggtgagccaatggatcaggaggatagcgagagcaagactgttagcgagcatggcgagcgagattggatgacagctaagaaattctggaagcctggtgggctcatcggggcaccttag

SEQ ID NO: 30445 - DNA, 462 bp, Artificial Sequence
  Description of Artificial Sequence: Synthetic coding sequence
tgaagcgtccagtcccccgctcagcagcaggtacctgccagacccggtgctccctcagtgcaagtgccgtcaccttttttattgcagaaccagtacgaaccagtgcagcctcactggttttactgtaaagaggtggagtataagcaactgtggatgcccttcagtgtattcgattcattgaacctggaagaaatatacaacagcgtccagcctgacccggagtctgttgtgctgggcactgatggcggaaggtacgatgtgtacctgtacgatagaattaggaaagctgcatattgggaggaggagcccgctgaggttcggagatgtacgtggttttacaagggagacaccgattccagatttataccatatacggaggaattttctgaaaagctcgaggttcgggtgctgtacttcttcatgagcttcttcaagaagtgccgatcctatatccattggtag

SEQ ID NO: 30446 - DNA, 1062 bp, Artificial Sequence
  Description of Artificial Sequence: Synthetic coding sequence
atggagcaggaactggaacagcttgctcaactgccttcaagtaagaatagtctgcttaaagacgccatggcccctgggacaccaaagtcactactgctgagcgccagcatcaagagagagggcgagagtccaacagccagcccccactcatcagctaccgacgatctgcaccactcagacaggtatcagacgttcctgcgtgttagagcgaaccgccagacccgccttaacgccagaattggtaagatgaagagaagaaagcaagacgaaggccaagtgtgtcctctttgtaacagaccactcgccggatctgaacaagaaatgagtcgccatgtagagcactgtcttagcaagcgcgaggggagttgtatggctgaggacgacgctgtggatattgaacatgaaaacaacaacaggttcgaggaatatgagtggtgcggccaaaagaggataagggcaactacactgttggaaggaggcttccgcggatccggttttataatgtgctcagggaaagaaaacccagactctgatgccgacttggacgtggatggagacgacactctggaatatgggaagcctcagtacaccgaggctgatgtaattccttgtacaggcgaggagcctggcgaggctaaagaacgagaggcgctgcgtggcgcagtgttgaatgggggacccccatcaactcgaatcacccccgaattttccaaatgggcttcagatgaaatgcccagcactagcaacggtgaatcctccaagcaggaagccatgcagaagacctgcaagaattcggatatcgaaaagatcacggaggacagtgctgtaactaccttcgaggcactgaaagcgagggttcgagagttagagcggcagctgagtaggggggacaggtacaaatgcctgatctgcatggactcatactctatgccgctgacgagtatccagtgctggcacgttcattgcgaagaatgctggttgcgaacattaggagccaagaagctgtgtccgcagtgcaatacgatcaccgcgcctggtgatctgagaagaatctatctctag

SEQ ID NO: 30447 - DNA, 1782 bp, Artificial Sequence
  Description of Artificial Sequence: Synthetic coding sequence
atggagaagctgtccgcccttcaggagcagaagggggagttacggaaaagactctcatacactacgcacaagttggagaaactggaaaccgagtttgattctacaaggcattatctcgagatagaactgaggagagcccaggaggaactcgagaaggtgaccgagaagctgcgcaggattcagtccaattatatggctctacaaagaattaaccaagaattggaagacaagctgtaccgcatgggacagcactacgaagaggaaaagcgagcgctgtcccacgaaatagttgctttgaactcacacttacttgaagcaaaggtgactatcgacaagctgtctgaagataacgaactgtataggaaagactgcaacctggcggctcagctgcttcaatgctcccagacctacggcagggtccacaaggtgagcgaacttccatctgattttcaagagcgggtgtctttgcacatggagaagcacggatgttctctgccttctcccttgtgccaccctgcttatgccgattctgttccaacctgcgttattgccaaggtgctggaaaaaccagaccccgcatccctttcaagcaggctaagtgacgcatctgcaagggatctggccttttgtgatggcgtggagaagcccggaccaagacctccctataagggagatatctactgctcagatacagccctttattgtccagaggagcgccgaagggacaggcgcccaagcgttgatgctcctgttactgacgtcggatttcttcgagcccagaactcaaccgacagcgctgctgaagaggaggaagaggccgaggcagccgcttttcccgctggcttccagcatgaggcttttccctcatatgcgggttccctgccaacatcttcgagctactcatcatttagtgccaccagcgaggagaaagagcatgctcaggcatctaccttgacggcttcccaacaggctatttatttgaactcccgggacgaactgtttgaccgaaaacccccagccaccacatatgagggatctcctaggttcgcaaaggccactgcggctgtggccgcacccctcgaggccgaagttgcaccaggattcggcagaactatgtcaccctacccggctgagaccttcaggttccccgcttcccccggacctcaacaagccttgatgcctccaaacctgtggagcttacgggctaagccaggcacagccaggctccccggagaggacatgaggggtcaatggcgccctctttcagtggaagacatcggagcttactcgtatccagtgagtgcagcagggcgagcgagtccctgctccttcagtgaacgctattatggcggagctggtggatctcctggcaagaaagccgacggccgtgcttctcccctttatgccagttacaaagctgactctttcagtgaaggtgacgatctgtctcaaggacatctggccgagccttgtttcttgagagccggtggagacctcagcctctccccaggcagatcagcagaccccctgcccggttatgccccttcagaaggcggtgacggggacaggctgggcgtccagttgtgcggtacggctagctccccagagcccgagcagggaagtcgcgattccctcgagccaagttcaatggaagccagtccagaaatgcatcccgctgctagactctcccctcagcaggcgttccccagaacaggtggatccgggctcagccgcaaggacagcctgacaaaggcacagctttatggcactttgcttaactag

SEQ ID NO: 30448 - DNA, 363 bp, Artificial Sequence
  Description of Artificial Sequence: Synthetic coding sequence
ctggccctccagattagcgaaaatctgttctccaacaaggtgctcaatgcacttaaacccgagaaggacgtggatggggttacagacatcaatctggggaagctcgtaaggggcgatgcccacgaatgctttgtatccccggttgccaaggctgttatagaactgctggaaaagtccggtgtgaacctcgacggcaagaagattctggtggtgggcgctcatgggtccctcgaggcggctctgcagtgcctattccagagaaagggtagcatgacaatgtccattcagtggaaaacccgacagctccagtccaagacggagagccgctctgtaactcgcctggagtgtcggagggtcatctag

SEQ ID NO: 30449 - DNA, 1167 bp, Artificial Sequence
  Description of Artificial Sequence: Synthetic coding sequence
atgtctggcactttcttaatccgaaaaccccagctgctgcagggcgtctatgccatggggttcaacaggcccagtaaaattcaggagaatgccctcccaatgatgttagcagaacctccccagaacctaatcgcccagtctcaatctggtactggaaaaactgcagcgtttgtacttgctatgctgtctcgcgtggagccctcagaccgatacccccagtgtctgtgccttagtccaacatacgaactcgccctgcaaacaggcaaggtgattgaacaaatgggcaaattctatccagagctgaaactggcctacgccgttagagggaacaagctcgaacgtgggcagaagatcagcgagcagatagtgattggcacccctggaactgtgctggactggtgttccaagctgaagttcattgaccccaaaaaaatcaaggtgttcgttctcgatgaagccgacgtcatgatcgctacacagggccaccaggaccaaagtattaggattcagcgaatgctcccccgtaactgtcagatgctgttattttccgcaacattcgaagattccgtctggaaattcgcccagaaagtagtgccagatccaaacgtgattaagttgaaacgggaagaagagaccctggacactatcaaacagtattatgtgctgtgcagcagcagagacgagaagttccaggccctgtgtaatctgtatggcgctataaccatcgcacaagctatgattttctgtcataccagaaaaactgcttcttggctggccgcagaactaagcaaagagggccaccaggttgccttgctgagcggcgaaatgatggttgagcagcgggctgctgtcattgaaagattccgggagggaaaggaaaaagttctggtgacaactaatgtgtgcgcacgcggaatcgatgtggagcaggtgtccgtggtcattaacttcgatctcccggtcgataaggacgggaacccagacaacgagacttatctgcatagaattgggaggacagggaggtttgggaagcgcggtctcgccgtgaatatggtggatagcaaacatagtatgaacattctgaatcgcattcaagagcattttaataagaagatagagcgcctggacaccgatgacttggacgaaattgagaaaatcgccaactag

SEQ ID NO: 30450 - DNA, 1821 bp, Artificial Sequence
  Description of Artificial Sequence: Synthetic coding sequence
ctgcggcaatgttataactataattgcccaagctttcttgctgccgcattggcacgggcaacaagcgatgaggttctgcagagcgacctgagtgcgcattatatccccaaagagaccgatggcacagaaggcactgttgaaattgagacagttaagctggctcgcagtgtcttctcgaagttgcacgagatttgttgctcctgggtaaaggattttcctctacgacgccgtcctcagctatactacgaaaccagtattcatgctattaaaaatatgagaaagctcttctacaaacacatctccaaaaagaagaaaaagcgcaaaaagagagattgggaccaggaagagcaggcttacttcgcagtgttcgacggtcacgggggagtggacgctgcgatttatgcgagcatacatctgcacgtcaacctcgtccgtcaagagatgtttccccacgaccccgctgaggctctgtgccgggcattccgtgtgactgacgagcgtttcgtccagaaggcagcaagggaaagtctgaggtgcggtacaacaggagttgttacttttataaggggcaacatgctccacgtggcttgggtaggtgactcgcaggtgatgttagtgcgaaaggggcaggcggtggaactgatgaagccccacaagcccgacagagaggatgaaaagcagaggatcgaggcactggggggatgtgtggtgtggttcggcgcatggagagtgaatggaagcttaagcgtcagtagagcaattggtgacgccgaacataagccctacatctgcggcgacgccgacagcgcatctacagtgctcgacggaacagaagactatcttattctggcgtgcgacgggttttacgacaccgtcaatcccgacgaggctgtgaaggtggtgagcgaccatttaaaagaaaacaacggcgattctagtatggtagcacataagctggtcgcttctgccagggacgccggaagctccgataatatcacggtcatcgttgtattcttgcgcgacatgaataaagccgtcaacgtgtcagaagagtcagattggactgaaaacagtttccagggaggtcaggaagacggaggagatgataaggaaaaccatggggagtgtaaaagaccatggccacaacaccagtgtagtgcacctgcagacctggggtacgatgggagggtcgactcctttaccgataggacttccctctctcccggatctcaaatcaatgttctcgaggatccgggatatctcgaccttacacagatcgaggcgagtaaaccgcattccgcccagttccttctgccagtggaaatgttcggtccaggtgccccaaaaaaggcgaacttgataaatgagcttatgatggagaagaaaagtgtccaaagtagtttaccggaatggtccggcgcaggcgaatttcccacagccttcaacctcggaagcacaggggaacaaatttatcggatgcagtctttgtccccagtttgttcagggctggagaacgagcagtttaagagccctgggaatagggtttctaggctgtctcaccttcggcaccactactctaagaagtggcaccgtttcagattcaatcccaaattctactccttcctgtccgcccaggagccatcacataaaatcggcacctccctgagcagcctgacaggcagtggaaagaggaaccgtatccgcagctcattgccgtggcgccaaaattcttggaaagggtactccgagaatatgagaaagcttaggaagacacacgatatcccttgtccagatcttccttggagctataaaattgaatag

SEQ ID NO: 30451 - DNA, 678 bp, Artificial Sequence
  Description of Artificial Sequence: Synthetic coding sequence
atggagaatttgttgcaagccactaaaagccacgtggacaaagtcataatgaagttgggaaagacaaatgcaaaggcagtatccgagatgcggcagaagatttggaataacatgcctaaggatcaccccgaccacgaacttatagacccattccccgtgcccctcgttattatcggctccaagtatgatgtgttccaggatttcgaaagcgaaaaaagaaaagttatctgcaagacactgaggtttgttgcacattactatggggcttccctcatgttcacaagcaaaagtgaggcacttctgttgaagatccggggtgtgattaaccagctggccttcgggatcgacaagtccaaatcgatttgcgtggatcaaaacaaaccccttttcatcacggccggtctggactcattcggtcagatcgggagtccaccagttcctgagaatgatatcgggaagctgcatgcacactcccctatggagctatggaaaaaagtgtacgaaaagctgttcccaccaaagagcatcaacactctgaaggatatcaaggaccccgcacgggacccacagtatgcagaaaatgaggttgatgagatgagaatccagaaagatctggagttggaacagtataagcgctcaagctccaagagttggaagcagatcgagctggactcatag

SEQ ID NO: 30452 - DNA, 621 bp, Artificial Sequence
  Description of Artificial Sequence: Synthetic coding sequence
atgggcttcagtaatatggaggacgatggaccggaagaagaggagcgggtggccgaaccccaggctaactttaacactcctcaagccttacgttttgaagaactgctggcaaaccttctaaacgagcagcaccaaatcgccaaagagctctttgaacagctgaaaatgaagaagcccagcgctaagcagcagaaagaggtagaaaaagtcaagccacagtgcaaggaggtacaccagaccctcatcctggatccagcccaacgaaaaaggcttcagcagcagatgcagcaacatgtgcagttattaacccagatccaccttcttgccacatgtaacccgaacttgaaccctgaggcatcgagtactcggatctgcctgaaagaactcggaacatttgctcaatctagcattgccttgcatcatcagtacaacccaaagttccagacactctttcaaccttgtaacctcatgggcgctatgcagttgatcgaggactttagcacacacgttagcatcgattgttcgccacacaagacggtcaaaaaaacagcaaacgagttcccctgtctgcccaaacaggtggcctggatcctggccacatcaaaggtgttcatgtattag

SEQ ID NO: 30453 - DNA, 468 bp, Artificial Sequence
  Description of Artificial Sequence: Synthetic coding sequence
atgggcaaggattactacaagattctggggattccaagcggggctaatgaagacgaaattaagaaggcttaccggaagatggcccttaaataccatccagacaaaaacaaagagccaaacgcagaagagaaattcaaggagatcgcagaggcgtacgacgtgctcagcgaccccaaaaaacgaggattgtacgaccagtatggtgaagaaggactgaaaaccggcggaggtacatccggtggctcgtccggcagcttccactataccttccatggggatcctcatgccacctttgcctcctttttcggagggagcaacccatttgacatcttctttgcgtccagccgcagcacgagacccttcagcggtttcgacccagacgacatggacgtggatgaggacgaggatccatttggggcttttggacgctttggtttcaatgggttaagccggggtccaaggcgctag

SEQ ID NO: 30454 - DNA, 246 bp, Artificial Sequence
  Description of Artificial Sequence: Synthetic coding sequence
atgtcaattagcagcgatgaggtgaacttcctggtgtatcggtacctgcaagagtccggcttctcacattccgccttcacctttgggatcgaaagccatatctctcaaagcaacattaacggggcactcgtccctccagccgctctgatatccataattcagaagggcttgcagtatgtggaggcagaagtttccatcaatgaagatggtacattgtttgatggtaggccaatcgaatcactgtag

SEQ ID NO: 30455 - DNA, 1248 bp, Artificial Sequence
  Description of Artificial Sequence: Synthetic coding sequence
atggccccagtaggggtggagaagaagcttcttctgggccctaatggtccagcagtggcagccgcaggggacctcacatcagaggaggaggagggccaaagcttgtggtcttccattctctctgaagtatcgacaagggctcggtcaaagctaccatccggcaaaaatatactcgtgtttggagaagacgggagcggcaagaccacactcatgaccaaactgcaaggagcagagcacggcaaaaaggggagagggctcgagtacctgtacttgtctgtgcatgacgaggatagagacgtggttaaggattttcaagactatatggaaccagaggaagggtgccagggatcaccacaaaggcgtggccctctcacgagtgggagcgatgaagagaacgtcgcccttccattgggggataacgttttgacccataatctcgggattcccgttttagttgtgtgtaccaagtgtgacgcagtctctgtgttggaaaaagaacacgattacagagacgagcatcttgattttatccaaagtcacctccgacgcttttgcttgcagtacggggctgctctgatatatacatcagtcaaagaagaaaagaacctggatctgctctataagtatatcgtgcataagacttatggcttccattttaccaccccggctctggtagtggagaaggacgcagtgtttatcccagccggttgggacaacgaaaagaaaattgccatactacacgagaatttcacaaccgtaaagccggaagatgcgtacgaggatttcatcgtgaagccgccagtaaggaagcttgttcacgataaagaactcgctgccgaagatgaacaggtgtttctcatgaagcaacagtccttgctggccaagcagcctgcgactcctactcgcgcttctgaatccccagcccgaggacctagcggtagcccacgcacccagggcagaggagggccagccagtgtgccatcaagtagtcccggaacatctgtgaagaagcccgaccccaatataaagaataatgcagcatcagagggtgtcttggcgtcctttttcaactccctcttgagcaagaagaccggatcccccggaagtccgggagctggaggggttcagtcgactgctaaaaagagcggacagaagaccgtgctgtccaacgtccaggaagagctcgaccgcatgacgcgaaagcccgattcgatggtgaccaacagttctacagaaaacgaggcttag

SEQ ID NO: 30456 - DNA, 1929 bp, Artificial Sequence
  Description of Artificial Sequence: Synthetic coding sequence
atgcggtctatcacccaaggagcttgtcggttcatatgggaagacaagggctatatcagtggagaccacatcaacctcgtatccagctccctgagtagttttcctatccttcagcgcagctcggaagaaaagatcctatatagcgataggttgagcctggagaggcaaaagctgacagtgtgtcctatcatcaatggcgaggaccacctgcggctgttgaatttccagcataatttcatcacaaggatccagaacataagcaacttgcagaagctgatctcactggatctctatgataaccagatcgaggagatcagcggcctctctacactgcggtgtctgagggtactcctcttaggtaagaatagaatcaaaaagatttcaaatttggagaatctgaagagtctggatgtacttgaccttcacggaaatcaaatcaccaagatagagaatatcaatcacctatgtgagctaagggtcctcaatcttgctcggaactttctgagccacgtggacaatctgaacggcctggactccctcaccgaactgaacctccgccacaaccagattacattcgtgcgtgacgtcgacaacctgccatgcttacagcatctgttcctaagtttcaataatatttcaagctttgattcggtgtcctgcctggcagatagctcctctctgtctgatattacctttgacggaaacccaatcgcccaggagagttggtacaaacacaccgtgcttcaaaatatgatgcagctgagacaactcgacatgaagagaatcacagaggaggaaaggcggatggcctctgttcttgcaaagaaagaagaggagaagaaaagagaaagtcacaaacaaagtctgttgaaggagaaaaaaagactcacgataaacaatgttgccagacagtgggaccttcagcagcagagagtggctaacattgcaaccaacgaggaccgcaaagactcagacagccctcaagatccctgccaaattgacggaagcacgctgtctgctttccctgaggaaacagggcctttggattctgggctgaataatgctctgcagggcttatcagtgatcgatacttatcttgtggaagtagatggcgataccctgtccctgtacggcagtggcgctctagagagcctggatcgcaattggtcagtacagaccgcaggtatgatcacaactgtttcttttacgttcattgagttcgacgaaatcgtacaagtcctgccaaagctcaagataaaatttcctaattctttgcatctgaaattcaaggagacaaacttagtgatgctgcagcagttcaacgcactggcccagctccggcgtattgaccagctcacaatcgatccacaagggaatccagtggtgaatttcacgctgtggaagtactatgtgctgttccgactgtcacacttttcaatgcaaaaaatcaacggcactgaggtgactcaaaacgacatgatcatggccgagcgactgtttggcatcctagcacatgtagcctcttctgagttgccgcagtaccgtttgatctccatcctgggggatgcacgaaagaagcagtttcgctacctgctggaaagtaaaggaaagaaaccgggtatcatcaatgaggaaaataacgacagcaagagactcgtgggggagaacacaaaccgggcaacgctaaattacaccactcgcgacttttacaatgagaagctcgaagaaattaaagaaaagaagaagttctgcaagacctatatcgaagacctggttaaggaggccaccgagattaatatgaaaaatgaggccctacaaaaactttggccgcagatgttcatcgagctcgttcgggatgcggtgattgagattaggaataagaatagttatatgaagctgtgcctgcaacagattactgaccagaagtag

SEQ ID NO: 30457 - DNA, 432 bp, Artificial Sequence
  Description of Artificial Sequence: Synthetic coding sequence
cgactaggtcggtacgaagttgaaaaacgctgtgcagtggagaaggaagactacgacctagcaaaggaaaaaaaacagcagatggaacagtaccgggctgaggtttatgaacagctggaacttcacagccttctagatgccgagctgcactcggccgtcgacccactgctacctgccacagaccctcatccgaagatcaacgctgaaagcctaccgtacgacgaaaggccgctcccagcgatccggaaacactatggagaggcagtggtggagcccgaaatgtctaatgcagacatcagtgacgccagacggggtggcatgctgggcgagcctgagccactcacggagaaggccctgcgagaggcctcgagtgctattgatgtgttgggggaaaccttagtagccgaagcctattgcaaaacatggtcttag

SEQ ID NO: 30458 - DNA, 1842 bp, Artificial Sequence
  Description of Artificial Sequence: Synthetic coding sequence
atggccaccatccctgattggaagctgcagctgttggcccgtcgaagacaggaggaggcttcagtgcgcggtagggaaaaagctgagagggaacgtctgtcccagatgccagcttggaagcgcggactgttggaaaggaggagggcaaaactcggcctgtcccctggcgaacctagtcctgttttaggaactgtcgaggctggtcctcctgatcccgacgagtctgctgtgctgcttgaggctattggtcccgtacatcagaaccgcttcataagacaggagagacagcaacagcagcagcaacagcagaggagcgaagaactcttagcggagcggaagccgggtccccttgaggctcgcgagcgacgacccagccccggagagatgcgggaccaatcccctaaaggcagagaaagccgagaagagcggctgtccccacgggagactcgggaaagaaggctgggcattggtggtgcccaggagctgagtttaaggcccttggaagcccgagattggcgtcagtccccaggagaggtaggagaccggagttctcggctctccgaggcctggaagtggaggctgagccccggagagaccccagaacggtcactccgtctggccgagtccagagagcagtcccctcgacgcaaggaggtggaatcccggctctctccaggcgagtcagcctatcagaaactgggacttactgaagcccataaatggcgcccagatagcagggaatcgcaagaacagtccttggttcagctggaagcaactgagtggcggctgaggtcaggggaagaaagacaggactatagcgaagagtgtggacggaaggaggagtggcctgtgcctggggtggcaccaaaggagactgctgaacttagtgaaactttgacccgggaagctcaggggaacagcagtgctggtgtggaggcagctgaacagcgccctgttgaggacggtgagagaggcatgaaacctactgaaggatggaagtggactctaaattccggcaaagcacgagagtggactccaagagacattgaggcgcagacacagaagcccgagccaccagagtcagctgagaaactgctcgaatcccctggagtggaagccggtgaaggtgaggcagaaaaggaagaggccggagcacaaggcaggcccctccgggcactgcagaattgctgctccgtgccgtcaccactccctcctgaggatgccggaaccggtggtctgcggcaacaggaagaagaagctgttgagctccagccccctcccccagcgcctctgagcccccctccgccagctccaaccgccccacagccccctggagatcctcttatgtcacgcctgttctacggcgtaaaagcaggtccaggtgtcggagcccctcggagaagtggccatacttttaccgttaatccaaggagatctgtccctcccgctacccccgctacccccacgtctcctgcaacagttgatgccgcagtccccggagctggcaaaaaaaggtacccaacggcagaggaaatcctggtgctaggcggatatttacggctgtcacgatcctgtctggcaaaaggcagcccagagagacaccataagcagctgaagatctcattcagcgagaccgcattggaaactacatatcagtacccgtccgaatctagcgtcctcgaggagctcggccctgagcctgaggttccctccgcacccaatccacctgcagcacaaccagacgatgaagaagacgaagaagaacttctgttgctgcagcccgaattacagggcggactgcgcacgaaggcgctgatcgttgatgagtcttgccggcgatag

SEQ ID NO: 30459 - DNA, 552 bp, Artificial Sequence
  Description of Artificial Sequence: Synthetic coding sequence
atggggccactgcctagaaccgtagaattattttacgacgtgctatctccctattcctggctcggattcgagatcctctgcaggtatcagaatatctggaatatcaacctgcaactcaggccaagccttatcaccgggatcatgaaagactctggctcattatctgcgatgaggttcctcacggccgtaaacctggaacacccagagatgctggagaaggcgagccgtgagctgtggatgcgggtctggtcaagaaacgaggacataacagagcctcagagcatcctggccgctgctgagaaagctggcatgagtgcggaacaagcccagggcttgctcgaaaaaattgccacacccaaggtgaagaaccagttaaaggagacaacggaagcagcctgtcgatatggagccttcgggcttcctatcactgtggcacacgtggatggtcagacccacatgctctttgggagcgacagaatggaactgctagctcaccttttgggggagaaatggatggggccaatacccccagccgtgaacgccaggctatag

SEQ ID NO: 30460 - DNA, 306 bp, Artificial Sequence
  Description of Artificial Sequence: Synthetic coding sequence
gagggtaccagcggcaagaccgctctccaccttgctgtagaaacccaggaaagaggtcttgtacagttcttgctgcaagccggagcccaggtggacgctaggatgctcaatggctgtacgcctctccatttggctgcgggtagggggctgatgggaatctcctctaccctgtgcaaagcaggggcagatagcctacttagaaatgtcgaggacgagaccccccaggatctgacagaagaatcgctggttttgctaccatttgacgatctgaaaatctccggaaaactgcttctgtgtacagattag

SEQ ID NO: 30461 - DNA, 14586 bp, Artificial Sequence
  Description of Artificial Sequence: Synthetic coding sequence
atggctacgatgatccctcctgttaagctcaaatggctggaacacttgaattccagctggatcacggaagactccgagagcatcgctacaagggagggggtcgctgtcctgtatagtaagctggttagcaacaaggaggtggtgcctttaccccagcaggttttatgcctgaaggggccacagctccctgacttcgaacgagaaagtctctctagtgacgagcaggatcactaccttgacgcactgttgtcaagtcaactggcactggctaagatggtctgctcggacagtcccttcgcaggtgctctccgcaagcgtcttctagtgcttcagcgcgttttctacgctttgtctaataaataccacgataaaggaaaagtgaagcaacagcaacactcccctgagtcatcaagcgggtctgctgacgtgcatagtgtgtccgagagacctcggagcagcaccgatgccctaattgaaatgggcgtgaggaccggcctgtctcttctgtttgcgctcttgcgtcagtcctggatgatgcccgtgtctggtccaggtttgtccctgtgcaatgacgtcattcacaccgctatcgaggtcgtgagtagcctgcccccactgtccctggctaacgagtccaagatcccaccgatggggctcgattgcttgagccaagtcacaacctttctgaagggtgtgacaatccctaattccggagctgatacactggggaggcggctggcaagcgagctcctcctggggctggccgctcaaagaggctccctgagatatttgcttgaatggatcgagatggctctgggggcaagcgccgtcgtgcataccatggagaagggcaaactcctgtcgtctcaggaaggcatgatatcctttgactgcttcatgaccattcttatgcagatgagacgctccttgggctctagcgcagacagaagtcagtggagagaaccaaccagaactagtgacggcctgtgtagtctgtacgaggcagccctgtgtctatttgaggaggtgtgtaggatggcctccgactattctagaacatgtgccagtcctgacagcatacaaactggcgatgcccctattgttagcgagacgtgtgaagtgtatgtttggggctcaaattcgtctcatcagctggtggagggaactcaagagaaaatcctgcagccaaaactcgcaccatctttctcagatgcgcagaccatagaggccggtcagtactgcaccttcgtgattagtaccgacggctccgtgcgcgcttgtggaaagggaagttatggacggcttggtctcggcgacagcaataaccaaagcaccctcaagaagcttacttttgaaccccaccgtagtataaaaaaagtgtcttcctctaagggtagcgacggccacaccttagccttcaccacagaaggtgaggttttctcatggggagatggggattatggcaaactgggacatggaaattcctccactcagaagtaccccaagctcatccaaggcccactgcaagggaaagtcgtggtctgtgtgtctgcgggatacagacatagcgcggcagtgaccgaggatggcgagctttacacctggggcgagggagactttggccgtctagggcacggcgactcaaacagtaggaacatccctaccctcgtgaaggacatcagcaacgtcggggaggtcagctgcggctcctctcatactattgccctgagtaaagacggaagaaccgtctggtcttttggaggcggtgacaatggcaagctgggccacggcgataccaaccgcgtgtacaaacctaaggtgattgaggccctacagggcatgtttattcggaaggtctgtgctgggtcccagtcatcccttgccctgactagcaccgggcaggtgtatgcctggggctgcggcgcttgcctgggatgtggctcttctgaagccacagccctccgaccaaaactaatcgaggagctagcagctacaaggattgtagatgttagtatcggtgacagccactgcctggccctctcccatgacaacgaggtctacgcttgggggaacaactccatgggacagtgtggccagggtaactccacgggtcctattaccaagccaaaaaaggtgagcggccttgacggaatcgctatacagcagatctctgccggtaccagccattcactcgcatggacagctctacccagagaccgacaggttgtggcttggcatcgaccttactgtgtggatcttgaagagagtacattctcgcacctccgttcttttttggagcgatattgcgataaaatcaatagtgagattccgccattgcccttccccagctcacgagagcaccactcctttctgaagctgtgcctcaagctgctgtctaatcacctggctctcgccctagccggaggtgtggctacctctatcttggggagacaggccggaccactacgcaatctgttgtttcgcctaatggactctactgttccagacgaaatccaagaggtggttattgagacattaagcgtcggtgcaactatgctgctgccccctctgcgggagaggatggagctgctccacagcctcttgccacagggaccggatcggtgggagtcactgtccaagggacagaggatgcagctcgacataatccttaccagtctacaggatcacacacacgtcgcgtcactactgggctattcctcacccagcgatgccgctgacctttcttcggtgtgcacaggctacggcaatttatccgatcaaccatatgggacccagagttgccatcctgatacccacctcgcggaaatcttaatgaagaccctcctgaggaacctgggtttttacactgatcaggctttcggagagcttgagaaaaacagcgataaatttttgctgggaacatcctcttccgagaatagccagccggcacacctccacgaactcctgtgttcattgcagaagcagttactggctttctgtcacattaacaacatcagtgagaactccagttctgttgccctccttcacaagcacttacagctgcttctcccccacgccactgatatatacagtagatcagcaaatttgctgaaggaaagtccatggaacgggagtgtgggcgaaaaacttagggatgtcatctacgtaagcgcagctggttctatgttatgtcagatcgtaaactccctactgctactgccagtttccgtggcacgacccttgcttagttacttgctcgatctccttcccccactggattgcttgaaccggctgctaccagcagctgacctgctcgaagaccaagaactccagtggcctttgcatggaggtccggagcttatcgaccctgccggtctgccgctgccccagcccgcacagagttgggtgtggctggtggacctcgaacgaacaatcgctctcctcattggaaggtgcctgggagggatgctccagggctcacctgtgtcgccagaggagcaagacacggcctattggatgaagacccccttgtttagcgacggtgtcgaaatggatacccctcagctagacaagtgcatgtcttgtctgctggaggtggccctcagcggtaatgaggagcagaagccttttgattacaaactcagaccggagatcgccgtgtatgtggatctggcactgggatgttccaaagagcctgctcggagcctgtggattagcatgcaggactatgcagtttccaaggactgggattcagcaacgctatctaacgaatcactactggacacagtgagcagattcgtactcgccgcactacttaagcatacaaatctgctgtcccaagcatgcggtgagtcacgttaccagccaggcaagcatctgagcgaggtctataggtgcgtgtataaagtgagatcacgactactggcatgcaaaaatcttgagctgatccagacccggagctccagtcgcgacagatggatatctgaaaatcaagactccgccgatgtggacccgcaggagcactcatttactcgtacaatcgatgaagaagccgagatggaggagcaagcggagagggacagggaagaaggacatccagaacccgaagacgaagaagaagagagagaacacgaagtcatgaccgctggaaagatctttcagtgctttctgagtgctagagaggtagcgagatccagagatcgggatagaatgaacagtggcgctggcagcggcgcaagggcagatgatccaccgcctcagtcgcagcaagagcggcgagtgtcaacagaccttcccgaagggcaagatgtgtacaccgcagcgtgtaactcagtgatccaccgctgtgcattgttaatcctgggagtttctcctgtgatagatgaactccagaagaggagggaggagggccaactgcagcagccttctacatcagcttcagaaggtggcggtttaatgacccgcagcgagtccctgaccgcggagagccgactggttcacacttcccccaattatcggctgatcaagtctcgaagtgagtctgacctcagccaacccgaaagtgacgaagaagggtacgcgctgtccggcagacgtaatgtagatcttgacctggcagccagtcaccgtaaacgtgggccaatgcattctcagctagagtccctgagtgattcttgggcccgactgaagcacagccgcgactggctttgtaatagtagctatagctttgaatcagactttgaccttactaagtctcttggagtccacaccttgatagagaacgttgtgtctttcgtgagtggcgacgtagggaacgcacccggtttcaaggagccagaggagagcatgagtacttccccacaggcttctatcatcgccatggaacagcagcagcttagagccgaacttcggttggaggcactgcatcagatcttagtcctcctctctggcatggaggagaagggcagcatcagcctagcagggtctcgactgagctcagggtttcagtcaagcacactgctcaccagcgttaggttgcaatttctggccggttgctttgggctgggaaccgtcggccacaccggcggtaagggggagagcggacggctgcaccattaccaggacggaattcgggctgcaaaacgcaatatccagatcgagatacaggtggcggttcataaaatataccagcagctatctgcaaccctcgagagagccctacaggccaacaaacatcacattgaagctcaacagagacttttgttggtgaccgtcttcgccctctcagtacactaccagccagtagatgtgtcgctcgccatttcaactggcctcctcaacgtgctgtcacagttgtgtggtaccgatacaatgttagggcagccgctgcagctgttacccaagacaggagtgtcgcagctttctacagccctgaaggtggcctccaccaggctactgcagattctcgctatcaccacaggcacgtacgccgacaaactctcaccgaaggttgtgcaaagtttgctggacctactgtgctctcagcttaagaaccttctaagtcagacaggcgtccttcacatggcctccttcggtgagggcgagcaggaggacggcgaagaagaggaaaaaaaggtggattcctcaggcgagactgagaaaaaagatttccgagctgcgctccgcaaacagcatgccgctgaactgcacttgggtgacttcctggtgtttctccgccgtgtggtgtctagcaaggcaattcagtcaaagatggcttcccccaaatggacagaagtactgctgaatattgcctcccagaaatgctccagtggcattcccttggtcggcaatctgagaacccgacttcttgctctacatgtgctggaggccgtgttaccagcttgcgagtcaggcgtggaagatgaccagatggcccaaatcgtggaaaggcttttctccttactgtccgactgtatgtgggaaacaccaatagcccaggcgaagcacgcaatacagataaaggagaaggagcaggagatcaaactgcagaaacagggcgagctggaggaggaagacgaaaacctgcctatccaggaagtttcctttgacccggaaaaggcccaatgctgcctcgtggagaacggacagatcctgacccacggcagtgggggaaaaggatatggactggcctctactggcgtaacatcgggatgctatcagtggaagttctacattgtgaaagaaaatcgtggaaacgagggcacctgcgtgggggtgagcaggtggcccgtgcatgatttcaaccatcgtacaaccagtgatatgtggttgtatcgcgcatactccggtaatctctatcataacggagaacaaactttaaccttatcttctttcacacagggagactttatcacctgcgtcctcgatatggaagcaagaactatctcattcggcaagaacggtgaggagcccaaactcgccttcgaggacgtcgatgctgctgaactttacccttgtgtgatgttctacagtagcaacccaggcgagaaggtcaaaatctgcgacatgcagatgcgcggaaccccccgtgaccttctcccgggagatccaatttgcagcccggtggccgcagtgcttgccgaagcgactattcagctgatccggatcctccacagaacggaccggtggacttactgcatcaacaaaaagatgatggaaaggctgcataaaatcaaaatctgcataaaggagtctgggcaaaagctgaagaagtcaaggagcgtgcaaagtcgtgaagaaaacgagatgcgagaagagaaggagtctaaggaggaggagaaaggcaaacacacccggcatggactggccgatttgtccgagctgcagttaaggacactatgcatcgaagtatggcccgttctcgcagttatcggaggcgttgacgccggtctcagagtgggtggcaggtgtgtacacaagcaaacaggccgtcatgccactctgctaggagtagttaaggagggcagcacatccgcgaaagtacagtgggatgaggccgagatcacgattagttttcctaccttctggtcaccgagcgatacccctctgtacaatctggagccctgtgaaccactgccatttgatgtggcacgcttcaggggtctaaccgcttctgtgcttctggatctgacctaccttactggcgttcatgaggatatggggaaacagtcgaccaaaagacacgaaaagaaacaccgtcacgagagcgaggagaaaggcgacgtcgaacagaagcccgaatccgagagcgctttagacatgcggactggacttactagcgacgacgtcaagtctcaatctactacctcctcaaagtccgagaatgaaatagcctcctttagcttggatccaactttgccgagcgttgagtcccagcatcagatcacagaagggaagcgcaaaaatcacgaacatatgtctaagaatcacgatgtggcacagagtgaaattagggccgtgcagttgtcctatctctacctgggagcaatgaagtctctgtccgccttgctggggtgttctaaatatgcggaactcctgctgattcctaaagtgctagcagagaatgggcataactctgactgtgcttcatcccccgtggttcatgaagatgtggagatgcgggctgctctgcagtttttgatgagacacatggttaaacgcgctgtgatgcggagcccaataaagcgcgcattaggcctggccgatttggagagagctcaggcaatgatctataagctcgtcgtgcacggactactcgaggatcaatttgggggaaaaatcaaacaagagatcgatcagcaagcagaggaaagcgatcccgcacaacaagcacagacccctgtgacaacctcgcctagtgctagcagcaccacatcatttatgagtagttccctggaggacaccactactgctacaacacctgttaccgatactgagaccgttcccgctagtgaatcccccggagtgatgcctctgagtctcttaagacagatgttcagcagctatcccactactaccgtgttaccaacccgccgtgctcaaacaccgccaatcagctcactcccgaccagcccatctgacgaagtaggcaggcggcagtccctgacatcacctgatagtcagtctgcaaggccagcaaaccgcacggccctaagcgatccctctagcagactgtccacgagccctcctcctccagccattgcagtgcccttactcgaaatggggttttcattgcggcagatcgccaaagctatggaagccacaggagctaggggagaggccgacgcccagaacattacagtcctggccatgtggatgattgagcacccaggccacgaggacgaggaagagccccagtctgggagtaccgctgattcccggccaggcgcagcagtgttgggatcagggggaaagagcaatgacccgtgctatctgcagtcccctggcgacatcccatcggctgatgctgctgaaatggaggaggggttttctgaaagccccgacaacctggaccatacagagaacgctgccagcgggagcggcccaagcgccaggggcaggtccgcagtgacacggagacataagtttgatctggcagcacgtactctccttgcaagggccgctggcctgtatagatctgtgcaggctcatcggaaccagtctaggcgcgagggtatcagcctgcagcaggatccaggggcactgtacgactttaacttggatgaggagttagaaattgacctggatgatgaggctatggaagccatgttcggccaagatttaacatctgataacgacatcctcgggatgtggattccagaggttctcgactggccaacatggcatgtgtgcgagtcagaggaccgcgaagaggtggttgtctgtgagctgtgcgagtgttcggtggtgagttttaaccagcatatgaagagaaatcatccaggctgtggaaggtcggcaaataggcagggatatcggtctaatggctcttatgtggatggatggtttggcggtgagtgcgggtctggcaacccctattatttactgtgcggtacatgcagggagaagtacctggcgatgaagacgaagtccaagagtacttcctcagaacgatataaaggccaggcgcctgatttgattggcaagcaggatagtgtgtatgaagaggattgggacatgctagatgttgacgaagatgagaaactgacaggagaggaggaatttgagctgttggctggacccctggggttaaacgaccggaggatcgtccctgagcccgtgcagttcccggacagtgacccgttgggggctagcgtcgccatggttactgccacaaactctatggaagaaacactgatgcagattggctgccacggctctgtggagaaaagtagttcagggcgaattacccttggtgagcaggctgctgcactggcaaatccgcacgacagagtagtggcactgcggagggtaacagcagctgctcaagtgctcctcgctcggaccatggttatgcgggcactgagccttctttcagtctccgggtctagctgctcgctcgcagccggtctggagtctctcggcttaacagacataagaaccctggtgcgcttgatgtgtcttgcagctgctggtagggccggattgagtacgtctccatcagcaatggccagtacatctgagagatcccggggaggtcatagcaaagctaacaagccaatcagctgcctcgcatatttgtccactgcagtgggatgtctggcctcaaatgcgccatccgctgcgaagcttttagtgcagctgtgcacgcaaaatctaatatctgccgctacaggcgtgaatctgaccacagtcgatgattctatacagaggaagttcctgccatcttttttgaggggcatcgcagaggagaataagttagtaacaagcccaaacttcgtggttacccaggccctggtagccttgctggcggacaagggtgctaaactccgaccaaattacgacaagtctgaggtcgagaaaaaggggcctctggaactggctaatgcgctggcagcttgttgcctgtcgtctagattaagttcccagcacaggcagtgggctgctcagcagctcgtaagaacactggccgcacatgatagagataatcagactaccctgcagaccctcgcagacatgggcggtgacctgcggaaatgctcttttattaagctcgaggcacaccagaacagggtgatgacctgcgtatggtgcaataagaaagggcttctggctacaagcggtaacgacggtacaatcagagtgtggaacgttaccaagaaacagtactccctgcagcaaacctgcgtctttaaccggctggaaggagatgccgaagagagccttggatcgcctagtgacccatccttcagtccggtgtcctggtctatcagcgggaaatatttggctggagccctggaaaaaatggtaaatatctggcaggtaaacgggggtaagggactggtggatattcagccacattgggtttcagcactggcgtggccagaggaaggtcccgcaactgcgtggagtggcgagtcccctgaattactgctcgtgggccgaatggacggttctctgggccttattgaagtggtggatgtgtccacgatgcaccgcagggagttagaacactgctatcggaaggacgttagcgtgacctgcatcgcttggttctctgaagatcgaccttttgctgtcggttacttcgatggtaagctcttactgggcacaaaagagccactggagaaagggggaatcgtgctcattgatgcgcataaagacaccctgatctcaatgaaatgggacccgacaggccacattctgatgacctgcgcaaaggaagacagtgtcaaactttgggggtccatctccggctgctggtgttgtctacactcgctgtgccatcccagcattgtcaatgggatagcctggtgccgcctgcccggaaagggctctaaactgcagttgctgatggcaaccgggtgtcagtccgggctggtatgtgtttggcgaatccctcaggataccactcagacaaacgtcacctccgccgagggctggtgggagcaggagtccaattgtcaggacggatacagaaagtcaagcggggcaaaatgtgtgtatcagctgcgcggtcatatcacaccagtcagaaccgtagctttcagtagcgacggcttggctctggtttctgggggattaggaggtttgatgaatatatggtctttgcgcgatgggtccgtcctgcagacagttgtgatcggcagcggcgcaattcaaacaacagtttggatacctgaagtgggtgtggcagcgtgctctaaccgatcaaaagatgtgctggtggtgaattgcaccgcagagtgggccgctgctaaccacgttctggccacctgccgaacagccctgaagcagcaaggggtcctggggctcaacatggccccttgtatgagagcttttttggagcgactcccgatgatgttgcaggaacagtacgcatacgagaaaccccatgtggtatgcggtgatcaattagtgcacagtccctatatgcagtgccttgcctctctcgccgtagggctgcacctggaccagttgttatgcaacccccctgtgccccctcaccaccaaaactgcctgcccgatcccgctagttggaaccctaatgaatgggcttggttggagtgtttctcaactactattaaagcggctgaagcgctcactaacggggcacagttcccagagtctttcactgttcctgaccttgagcccgtgcccgaagacgaactggtatttctcatggacaattccaagtggattaacggaatggacgagcagattatgagctgggccactagccggcctgaagattggcacctggggggtaagtgcgacgtgtacttgtggggtgccggaagacacggccagctcgccgaagctgggagaaatgttatggtgcccgctgcagccccaagtttttctcaggcacagcaggtgatctgtgggcagaattgcacctttgtgatccaggctaacggaacagttttagcctgcggggaaggctcttacggccgactgggacaaggcaactctgacgacctccacgtgttgaccgttatatccgccctccaagggtttgtagttacgcagctggtgacatcctgtgggtcagacggacacagcatggcgctgacggaaagcggcgaagtgttctcctggggagatggagattacggcaagctaggccatggcaacagcgatcggcagaggcgcccacgccagattgaggccctgcagggagaagaggtagtgcagatgtcttgtggtttcaaacatagcgccgtggtcaccagtgacgggaaattgtttacttttggcaacggtgattacggcagactgggcctgggaaacactagcaacaagaagctgccggagcgcgtcactgctctagaaggctaccagatagggcaggtcgcctgcggcctgaatcatacactggccgtgtctgcagacgggtcaatggtgtgggccttcggagatggcgactacggaaaacttggcctggggaactcaactgccaagagttcccctcaaaagatcgacgtcctgtgcggaataggcattaaaaaagtcgcttgtggaactcaattctccgtggccctgaccaaagatggacatgtgtatacctttgggcaggaccgcctcatcggtctgccggaaggtcgggctcgtaaccacaacagaccccagcaaattcctgtgctggctggggttattattgaggatgtggctgttggagctgaacacacacttgccctcgcgtctaacggagacgtgtacgcctggggcagcaatagcgagggtcagctcggtttaggtcacacaaatcatgtccgagagcccactctcgttacgggcctgcaaggcaagaatgtgaggcagatttccgctggcaggtgccacagtgcggcttggaccgcccctcccgttccacccagagccccaggagttagcgtaccgctgcagttagggttaccagatactgtgcctcctcaatacggtgccctgagggaggtgtcaatccatacagtgcgggctcgcttaagactgctctaccatttcagcgacctcatgtactcgagttggcgtctgctgaacctgtccccaaacaatcagaatagtacgtctcattacaatgctgggacctggggtatcgtccagggccagctccgcccattacttgccccacgtgtttataccctgcctatggtgcgttccatcggaaagactatggtgcagggaaagaactatgggcctcaaatcaccgtaaaaaggatatccactcggggtcgcaagtgtaagcctattttcgtgcagattgctaggcaggttgtgaaattaaatgcttcggacctcagactgccttctagggcttggaaggttaagcttgtcggcgagggggctgacgatgccggaggagtgtttgacgacacaattactgaaatgtgtcaggaactggagaccggtatagtggatttgctgatccctagtcccaatgccaccgctgaggtcggttacaatcgcgaccgctttctattcaatccaagtgcatgtctcgatgaacacctcatgcaattcaaatttctcgggatcttaatgggcgtggccatccgcacaaagaagccattagatctgcaccttgcaccactcgtgtggaagcagctatgttgtgtgccactcaccctcgaagatctggaagaggtggacctgctctacgttcagacactgaactctattttacacatcgaagattctgggattactgaggagtcctttcacgagatgattccgttggatagttttgtggggcaatctgcggacggcaaaatggtgccgataatacccggtgggaactccatccctctaacttttagcaataggaaggagtatgtagagcgggcaattgaataccgcctgcatgagatggatcgacaggtagccgcagtgcgggaagggatgagttggatcgtgcctgtgccattgctgtcactgctgacagctaagcagctggagcaaatggtctgcggaatgccggagattagtgtggaggtactgaagaaagtggtgagatatagagaggtcgacgaacagcaccagctggtgcaatggttctggcacacgctggaggaattttctaacgaggaaagggtgctgttcatgaggttcgtgagcggcagatcccgcctccccgcaaataccgccgatatctcgcagcgattccagatcatgaaggtggaccggccatatgactcccttccaacaagccaaacttgctttttccagctgagactacctccatactctagccagcttgtgatggcagaaagactccgatatgcgatcaataattgcaggagcatcgacatggacaactacatgttgtcgagaaacgttgataatgccgagggctccgacaccgactactat

SEQ ID NO: 30462 - DNA, 3633 bp, Artificial Sequence
  Description of Artificial Sequence: Synthetic coding sequence
atggcctcgcagctacaggtgttttcgccgccatcagtgtcctctagcgcattctgtagcgccaagaagctgaaaatcgaaccatcaggatgggacgtctctggccagtctagtaacgataaatattacacgcattctaagactctgccggctacacagggacaggcaaactcatctcatcaagtggctaattttaacatcccggcttacgaccagggtttattgctcccagcacctgcagtggaacacattgtcgttactgctgcggactcatccgggagcgctgcaacatcaacatttcagtctagccagacactcacccacaggtccaacgtctctctgttagagccctatcaaaaatgcggcctgaagaggaagagcgaggaagtggactctaatggaagtgtgcagatcatagaagaacatccccctttgatgctgcaaaataggaccgtagtgggcgctgccgctacaaccacaaccgtgaccaccaagagttcatcaagttctggggaaggagattatcagttggtccagcatgaaatcctatgctcaatgaccaactcatatgaggtcttggaattcttagggagaggtaccttcggccaagtcgcaaaatgctggaaaagaagtacgaaagaaatcgttgccattaaaattctgaaaaatcacccttcctacgccagacaggggcagatcgaagtttcaatcctgtcgaggctgtccagcgaaaacgcggacgagtataactttgttcgatcctacgagtgtttccagcacaagaaccacacctgtctagtcttcgaaatgcttgaacagaacctgtacgacttcctcaaacaaaacaaattttcaccgctgcccctaaagtacatccggccaattttgcagcaagtggccacggccctcatgaagttgaaatccttaggccttattcacgctgacttaaagccggaaaacatcatgttggtggaccccgtgcggcaaccctatcgcgtgaaggtcattgacttcggctctgcaagccatgtgtcaaaagcggtctgctctacctacctgcaatctaggtactaccgcgcacctgagatcattctagggctgcccttctgcgaggcaatagatatgtggagcctgggctgtgtgatcgcggaattatttctgggctggcccctctatcctggggctagtgagtatgaccaaattcgctatatttcccagacgcaggggctgcctgcggaatacctgttgagtgccggtacaaagaccacccgcttctttaaccgggatcccaacctcggatatccattgtggcggctcaagactcctgaggaacacgagctggagactggcatcaaatcaaaggaagcgcgtaagtacatctttaactgcttggatgacatggcccaggtgaatatgagtacagatttggagggtacggatatgcttgcagaaaaagcagatcgacgggagtacatcgatttgctaaagaaaatgctgacaatagatgccgacaagcgcattacgccactgaagaccctcaatcatcagttcgtcaccatgactcatctgctagacttcccccattctaatcacgttaagtcttgtttccagaacatggagatctgcaaaaggagagtccacatgtacgacaccgtatctcaaatcaagtcccctttcacaactcatgttgctcccaatacgagcactaacctgaccatgagtttctcaaaccagctgaacacagtccataaccaggcctccgtgcttgcctcgagttcaaccgcagctgctgcgactcttagcttagccaactccgatgtgtctttacttaactaccagtccgccctgtatccaagttccgccgctcctgtacctggcgtcgcccaacagggcgtgagcctccagcccggtactacacagatttgtacccaaacggacccttttcagcagaccttcattgtctgtccgccagctttccagacgggcctgcaagccactacaaagcacagcggttttcctgtcagaatggataatgccgtcccaattgtcccacaggcccctgctgcccagcccctgcaaatccagtctggagtactgacacaaggctcttgtacaccccttatggttgctaccctgcacccccaggttgccaccatcactccacagtacgcagtccccttcactctctcatgtgccgctggaaggcccgctctggtggaacaaacagccgctgtgctgcaagcatggcccggagggacgcaacagatcctactgcccagtacttggcagcagctgccaggagttgctctgcacaattcagttcaacctactgcaatgatcccagaggcaatggggtctgggcagcagctagccgactggaggaacgcccatagccacgggaatcagtactccacaatcatgcagcagcccagccttttgaccaatcacgtcactctagccaccgcgcagccactcaacgttggggtggcacacgtggtgcggcaacagcagtctagctccttgcccagcaagaaaaacaaacagtctgcacctgtttcctcaaaaagtagcctggacgtcctgcctagccaggtgtattccctcgtcggcagctctccattgcggacaacaagcagttataactctctggttccagtgcaagaccaacaccagcccattatcattcctgataccccctccccccctgtatctgtgattactattaggtcagacactgacgaggaggaagacaataagtacaaaccgagctccagcggtctcaaaccacggtccaacgtaatttcttatgttacggtaaatgacagccctgattcagattctagcctgagctcaccatatagtaccgacacactgtctgctctgcgaggtaactccggaagtgtacttgagggtcctggtcgggtcgtggccgacggcaccggtacacgaactatcattgttcctcccctaaaaacgcagctgggcgattgcacggtcgctacacaagccagtggactgttgagtaacaaaacaaaacccgtagctagtgtttccggccagagttctggctgttgcattacaccaactgggtacagggcccagcggggtggcaccagcgctgcgcagccattaaatctgtcccagaatcagcagagctccgctgcacccacttcacaggaaagatcttccaatccggcacctaggcgacagcaagcctttgtcgcacccttgtctcaggctccttatactttccaacacgggagtccattacattccaccgggcacccacatcttgcgcctgctccagcccacttgccgtcccaagctcatttgtacacttacgctgcccctacctccgcagccgctttgggaagcacaagcagtatcgcccatctcttttctccacagggcagcagtcgccacgccgcagcatacactacacatccatctactttggtgcatcaagtgccagtttcagtcgggccatcactactgacatccgcatctgtggccccagcccagtatcagcaccagtttgctacacagtcctatatcggcagcagccgaggatccacaatatacacaggatatcctctgagtccaactaagatcagccaatactcctatctttag

SEQ ID NO: 30463 - DNA, 579 bp, Artificial Sequence
  Description of Artificial Sequence: Synthetic coding sequence
atggggaaaggctgcaaagtcgtagtttgtggactgcttagcgtgggcaagaccgcgatcctggaacaactcctttacggcaaccacaccataggcatggaggactgcgagaccatggaggacgtatatatggcaagtgtcgagaccgacaggggggtaaaagaacagctgcacttatatgacacgagaggtcttcaggagggcgtggaactcccaaaacactacttttcttttgccgacgggttcgtactggtatattcagttaataatctggagtcgtttcaaagggtggaacttcttaagaaggaaattgataaattcaaagataaaaaagaggtagccatagtggttttgggaaacaaaatcgacctctctgagcagcggcaagtggatgccgaggtggcccagcagtgggctaaatcagagaaggtgcggctgtgggaagtcacagtcactgataggaagacactcattgaaccttttacactgctggcttctaaactgtcccagccacagtcaaagtcttccttcccactgcctggcagaaagaacaaaggcaattctaactcggagaactag

SEQ ID NO: 30464 - DNA, 1803 bp, Artificial Sequence
  Description of Artificial Sequence: Synthetic coding sequence
atggcctctaaccacaagtccagtgccgctagaccagtcagccgcggtggagtcggccttacaggcaggcctccgtctggcataaggcccctgtccggcaatataagagtagcaaccgccatgcctcctgggactgccagaccaggctctagaggatgcccgatagggaccggcggagtgttatcatctcagataaaggtcgcccataggccagtcacccaacaaggcctaaccgggatgaagacggggacgaagggcccacagcggcagatcttagacaagagttattatttaggcctgctgaggagcaaaattagcgaacttactaccgaagtgaataagctacagaagggcatcgagatgtacaaccaggagaatagcgtctacttaagctacgagaaaagagccgaaactcttgccgttgagatcaaagaactgcagggacagcttgctgattataatatgctcgttgacaaactcaacaccaacaccgaaatggaagaggtgatgaacgattataacatgttgaaggcccagaatgatcgggagacccaaagcctcgacgtcatcttcaccgaacgtcaagcaaaagaaaagcagatcagatctgtggaggaggagattgagcaggagaagcaggccaccgatgatattatcaagaacatgtctttcgaaaaccaggtcaaatatttggagatgaaaactaccaatgagaaactgcttcaggagctcgacaccttgcagcaacaactggattcgcaaaatatgaagaaggagtcgctggaggctgagatcgcccatagccaggttaagcaagaggccgtccttcttcacgaaaagctgtatgaactagagagccaccgagaccaaatgattgcggaagataagtccattggtagccccatggaagagcgcgagaagctgttaaagcagattaaggatgataaccaagaaatcgcttctatggaacggcagctgaccgatacaaaggagaaaatcaatcagttcatcgaagaaataagacagctggatatggacttagaggaacatcagggcgaaatgaaccagaagtataaggagctgaagaaaagagaagaacatatggacacattcatcgagacatttgaggagaccaagaaccaagagctgaagcgcaaagcccaaatagaggccaatatcgttgccttgctcgagcattgctctaggaatatcaaccgtattgagcagatcagtagcattaccaatcaggagcttaagatgatgcaagatgacctgaatttcaagagcaccgaggtgcagaagagtcagagtactgcgcagaacttgacaagcgatattcagcggctgcagctggatttgcagaaaatggagcttttagaaagcaaaatgacggaagagcagcacagcctcaagagcaaaattaaacagatgaccactgacctggagatctataacgaccttccggctcttaagagttcaggcgaggagaagataaagaagcttcatcaggaacggatgatccttagtacccatcgcaatgctttcaagaagatcatggagaaacagaatatcgaatatgaggcactgaagacccagctgcaggagaacgagactcacagccagctgacgaacctcgaacgaaagtggcagcacctagagcagaacaactttgcgatgaaggagttcatcgccacaaagtcacaggagtcagactatcagccaattaagaagaacgtgaccaaacaaatcgcggagtacaataaaacaatcgtagatgcgcttcacagtacctctggcaattag

SEQ ID NO: 30465 - DNA, 1197 bp, Artificial Sequence
  Description of Artificial Sequence: Synthetic coding sequence
atgctgcgcaggaaaccaagcaatgctagcgagaaagagttcaacctcgacgacaatattcccgaagacgactccggagtccccactcccgaagatgccggtaaatcgggcaagaagttgggcaaaaagtggcgcgcagtaatctcgagaacaatgaatcgtaagatggggaaaatgatggttaaggccctgtccgaggaaatggctgacaccttggaagagggaagcgcctctccgacctctccagattattcacttgactcacctggaccagagaagatggctcttgcctttagcgagcaggaggagcatgagctccctgtcttgtcgagacaggccagcacgggctccgagctctgttctccatcccctgggagcggaagttttggagaggagcccccagctcctcagtatactggaccattctgtggcagggcccgtgtgcacacggatttcactccaagcccctatgatcatgattccctcaagcttcaggtcagaagcgcaagcggtctcctttggtcacttgcgggatgcgcacagaaggggagctggactgaaccaggctacgacagcgtgagtggagggcagggcccaccatatcctctctccctcgcccctttcagcagtcccctgcctcagcagaagggcgatgtgattcagattatcgaaaagccgccagtggggacctggctcggactgctgaacgggaaggtaggtagttttaaattcatatatgtcgatgtgctaccagaagaggcagtggggcacgcccgaccaagccggagacaatccaaaggcaaacggcctaaacccaagaccctgcacgaactgctggaacgtataggcctggaagaacacactagcaccctgttgctgaatggctaccagacgttagaggactttaaagaactcagggaaacacacttaaacgagctaaatatcatggacccgcagcatagggccaaactgctcaccgccgctgaacttctcttagattatgataccggatccgaggaagcggaagagggcgcagaatccagtcaggagccggtggctcacactgtctccgagcccaaggtagatatcccacgggactcggggtgctttgaagggagcgagtcaggtcgcgatgacgccgaacttgctggaaccgaggaacagctacaaggactgtctctggcgggagctccttag

SEQ ID NO: 30466 - DNA, 1002 bp, Artificial Sequence
  Description of Artificial Sequence: Synthetic coding sequence
atgggaacgcggaaaaaggtgcatgcatttgtgcgggttaagccgacagacgactttgctcatgaaatgataagatacggagatgacaaacgcagtattgatatccacctcaaaaaggatatcaggaggggcgttgtcaacaaccagcagaccgattggtcatttaaactggatggtgtgctgcatgacgcctctcaggacttggtgtatgagaccgtggcgaaggatgtagtgagtcaggcactggatggatataacgggacaatcatgtgttacggacagacgggtgcaggaaagacttataccatgatgggggcaactgaaaattacaagcacaggggtattctgcctcgcgcactgcagcaagtgttccggatgatcgaagagagacccacgcacgctataacagtaagagtttcttatctggagatttacaatgagagcctgttcgacctgcttagcaccctcccctatgttggtcctagcgtgacaccgatgactattgtggagaatcctcagggcgtcttcattaagggactgagcgtgcacttgacttcacaagaagaggacgccttctcgttgctctttgagggcgaaacaaatcgaatcattgcgagtcatactatgaataaaaacagctccaggtcacattgcatctttaccatttacctggaggctcactcacggacgctgtccgaagagaaatacatcacctcaaaaattaacctcgtggatctcgccggttctgagcgcctcgggaaaagtggctcagaaggtcaggtgctcaaggaagctacatatattaataagtctctgtcctttttggagcaggcaatcatcgcgctcggggatcagaaacgcgatcacataccttttcgccagtgtaaattgacccacgccctgaaggatagcctcggagggaactgcaatatggtgctagtcactaacatttacggcgaagcggctcagcttgaggaaactggctctcgtctctggttgtag

SEQ ID NO: 30467 - DNA, 1248 bp, Artificial Sequence
  Description of Artificial Sequence: Synthetic coding sequence
atgatgctcggtcctgaaggcggtgagggcttcgtcgtaaagttaagaggcttaccctggagttgctccgtggaagatgtccaaaacttcctgagcgactgtaccatacatgatggcgctgcaggcgtgcatttcatttatacgagagagggaaggcagtccggggaggcattcgttgaactggggagcgaagacgatgtcaagatggccttgaaaaaagaccgggaatctatgggccataggtatatcgaagtgttcaaatctcaccggactgaaatggattgggttctgaaacattccggcccaaacagtgccgactctgccaatgacgggtttgtgagactccgcggtttaccgttcgggtgtactaaagaggagatagtgcagtttttctctgggctggaaattgtgcccaacggtattaccctgcctgtggatccagagggaaagatcaccggggaagccttcgttcagttcgcctcacaagaactggccgaaaaagccctcggaaaacataaggaaaggatcgggcacaggtatattgaggtatttaagtcctctcaggaagaagttcgctcttactcggatccccctctgaagttcatgagtgtgcaacggccaggcccttacgaccgtcccggtacagctcgccgatatatcggcattgtcaagcaggcagggcttgaacgcatgaggcctggcgcatatagcacagggtacggtggatacgaggagtacagcggactttccgatggatacgggtttactacagatctgttcggccgtgatctatcttattgcctcagtggaatgtacgaccaccgctatggcgacagtgaattcacagtgcagagcaccactggccactgtgtgcatatgaggggcctgccatacaaggctacagagaatgacatttacaattttttttctccccttaatcccgtgagagtgcatatcgaaatcggtcccgatggacgggtgaccggagaagccgatgtggaattcgctactcatgaggaggcggtggccgcaatgtcaaaagaccgcgcaaatatgcaacaccgatacatcgagctgttcttgaactcaactacgggcgcttctaacggagcgtattcaagccaggttatgcagggcatgggtgtaagcgcagcccaggccacatacagtggtctagaaagtcagtctgtttccggttgctacggggctgggtatagtggccaaaactccatgggcggatacgactag

SEQ ID NO: 30468 - DNA, 3108 bp, Artificial Sequence
  Description of Artificial Sequence: Synthetic coding sequence
atgtctgagcaagagcggattcaggagtgtttaagaaaagaaataagatccctcttgatcagcaccaaggacggtctgtcgccccaagagttggagaaagaatacctgctgatggtgggcaatcacctcccactgaggattttgggataccggtccactatggaattggtgctcgacatgccagacgttgtccgagtgtgccctggagctggtggaactgtgattctcaaggctatccctgacgagtccaccaaaggaattgctagtcttgtggccaagcagcgaagtagtcacaagctacggaactccatgcacaagggtaggcctagtatttactcagggccacgttctcatcgcagggtgccatatagggggagggtggcccctatcctgccagccgtagtaaagtcagaattgaaagatctgctcgctctgagccccgtccttttgtccgacttcgagaaggcatttgccaaaaggttcgggcgttcattccagtatatgcagtacgggtttttatcaatgtttgaggtcctcaatgccgcatccgacgtaatctccgtggagcagacaagggccggatcccttctgatgttaaagaagtcagttacggaagaaaaacctaggggctgccccgcaggaaagatattcacccagcctttcaggatgaagcagggatcctattcaaccgggttcccagttgctaagccttgttttagtcagcccacttccaatatggaacccccaaaacagattatgtccatggagaaaacatccaaattaaatgtagtggagactagcagactaaaccacacggaaaagttaaaccaattggagaatacttttaaatctgttatcgcacagataggtcctggtgggacgattagctccgagctgaaacacaagatcaaatttgtggttagtaagtttcccgaggggctgttcattagcaaactactgggcgagtacgaggtcatctttaaagagcagctgagtcccaagaaactgggtttcttaaacgtgaccgagctcgtgggagcgctcagcgatattcttcacgtggagtttcggaaaggccaccaggatcttctcgttttcgacgccgataaaaagcccttgcctccggtccagagtgataaaaagatagaagctaaagcttgtgtgagcagcccgcctcgaaatagtctgagtaccgccgctgtgaaggagaccgtatggaattgcccttcaaaaaagcagaaagaaccacagcagaagatctgcaagaagcccaatctcgtcgttaagccccttcagcttcaggtggagacaaacaaaagcgaactgaaccttgccatggccaaccatgatatcccaccggatgcagtgcccaataaaaaactgtgccggctccccccactcgacacaagttcacttattggagtgtttgtggagtatattatcagcccgtcccaattttacatccgcatttattcccgagattcctcggaactactggaggacatgatgattgaaatgagaagatgctatagtaatcagctcgtaagcgaccggtacgtcatgccagaatgctttatacaacccggtcatctgtgttgcgtgcgcatctccgaggacaagtggtggtacagagtgattatccacagagttctggaaaagcaggaggtcgaggtattctatcccgacttcggcaatataggaatcgtgcagaagagcagtctgaggtttcttaaatgctgctacaccaagcttcccgcacaggccattccgtgttcccttgcatgggtgaggccagttgaagagcactggacaagcaaagcaattctgcaatttcagaaactgtgcggtctcaaacctctagtgggagtcgtcgacgagtacgttgatggaattctgaatatttttctttgcgacactagctctaatgaagacgtctactttcaccatgtcctcaggactgagggacacgccatcgtgtgtagggagaacatcagctccaaaggttttagcgagctaaaccccctggccctatacactactagctcgggaggaccagaggacatcgtgctgactgagttgggataccccagtcagcaacattatttcaatgaagatcgtaaaatttcccctcaatcaaaagagagcgagttgcgtattcttcaggatatcaacgacgaaaagagccttagtcatttgaagtctgaatccaaagagccgctgaaggacagtgaattcgaatcactgaaaacatgtaacaagtcatttgaagaggatccaaagtggagcaaccctgagccaaacgatctgaaggaggaaaacgaggatgagatccccaccggtatgccatgcctggaatcagtcacaataggagacgacatttgggatgaaaactggctgccactgcaggcgaagatgggtaagggcggagacgcagcttcacacctttttactgcctccctaggaggcaagaaccagtactccagctgcaaagagatgccacagaaagattggtgtttctctactccaaaggacacttgggatgatagctggcagccatctggtctcgtcaatggcaccaaggtggaagtacacaaaccggaagttctgggcgcacaggagaaaaatactgggaccaatagaacacagaaacagctcgacataaacggtagctcagactcatccactctccctaaactggaggaattctgtaccagtctcacacagtccgagcagtctgccgatggatcgcaatctgagcctaacaattcccagacccagcccaaacagatacagctcagtactgccgcaccttgcagtacgacagctgttgatgacagcgcagaaaagccttccgggtctgtagaatcatctccagagatcttgaagaatgaggatttcagttcatcaagagccattactttgtataaagataaacggcaagagagtgtggaccaactaagcctaatcctgtcatatgagtgtcagattagtcaaaagctgtatattcctcggagtactgctacagctgcgttgggtgctgccgctcggctggccacttcgcgtagtctactccactggtacccttcggttaaacggatggaagcatag

SEQ ID NO: 30469 - DNA, 660 bp, Artificial Sequence
  Description of Artificial Sequence: Synthetic coding sequence
atgggtggcgcacaactggagctgccctctggcgctcggccaggggtgtgcgtacggagaagtttcagggcacatgccggtgaccagcctcgcaggcctcccggtccaatccctgtgcctggcacaatgaaacaagagagcgctgcgcctaacactccacctacatctcagagtccgactcccagcgctcaattcccacgcaatgatggagacccgcaagccctctggatctttggttatggttccttagtgtggcgtcccgacttcgcatattctgattcaagggtagggttcgtcagaggctattcgaggcgcttttggcagggcgacactttccatcggggatccgataaaatgcctgggagagtcgttacacttctcgaggaccacgaaggatgcacctggggagtcgcatatcaggttcagggggaacagaaccctggctatcttggcccagcgccagaagaagcgattgctacccagatccttgcttgcagaggtttcagtggccataacctggaatatctgttgcgactggcagattttatgcagctgtgtggcccacaggcccaggatgagcacctggctgctatcgtggacgccgtcggaaccatgctgccatgtttctgtcctaccgaacaggctttagcgcttgtttag

SEQ ID NO: 30470 - DNA, 2382 bp, Artificial Sequence
  Description of Artificial Sequence: Synthetic coding sequence
atgtcagaacagggcgatctgaatcaagccatcgctgaggaaggtgggaccgagcaggaaacagcaacacctgagaatggtattgtaaaatccgagtcactggatgaggaagagaagctagaactccagcgccgactggaagcccagaaccaggaaagacggaagtccaagagcggagcaggcaaaggcaagctgacccgatccctggctgtatgcgaggaaagctctgcccgtccaggcggtgaatcattacaggaccaggaaagcattcatctccagctgagctcttttagcagcctgcaggaagaagacaaaagtcgtaaggatgacagcgagcgggagaaggagaaagataaaaacaaagataaaacctccgagaagccaaaaatccgaatgctttcaaaagattgcagccaggagtacactgacagcaccggcattgatttgcatgaattcctcatcaataccttgaagaataacagcagagaccggatgattctactcaaaatggagcaagagattattgatttcatagctgacaacaacaaccattacaagaaattcccacagatgtcatcttatcagagaatgctggtgcatagagtagcggcatactttggcctggatcacaacgtggaccagaccggtaagtcagtgattatcaataagaccagttccacacgcatccctgagcagcgcttttgcgagcacttgaaggacgagaaaggggaggaatcgcagaaacgatttatcctaaaacgggataatagttccatcgacaaggaggataaccagtccgtatgctctcaggaaagtctgtttgttgagaatcgcggaaatcgcgacgggagtggcaggactagcgggtctcggcagagttcatcagagaacgagctgaagtggagcgaccatcagcgagcctggtctagtaccgatagtgacagctccaaccggaacctgaaaccagccatgacaaagactgcctccttcgggggaataaccgttctgacccgcggtgactccactagcagtaccaggagtactggaaaactttccaaggcgggaagcgagtcgtccagctctgcagggtccagtggctcgctttctaggactcatccccctttgcagtccacgccactggtgagcggagttgccgcaggctcacctggctgcgtaccttacccagagaatggcataggaggacaggtggcgcctagctctactagttacattctactgccattggaagccgcaacaggtatacccccaggtagtatactgcttaacccacacacaggccaacctttcgttaaccctgatggcacccccgcaatttacaatcctcctacctcccagcaacccctcaggagtgctatggtcggacagagtcagcagcagccccctcagcagcagccctctccacagccccagcagcaggtccagcctcctcaaccccagatggccggtccccttgtcacacaatccgtccaaggactccaagcgtcctcccagtctgtgcagtatcccgctgtgtcatttcctcctcagcatttgctgccagtttcccctacccagcattttccaatgagggacgacgtggctactcagttcggccagatgacccttagtaggcaaagtagtggagagacaccagaacctccaagcggacctgtctacccttcgtctctcatgccgcagcccgctcagcagccctcctatgtcatcgcctccactggccaacagctcccaactgggggtttctcaggatccggccctccgatcagccagcaagtcttacagcctccaccgagcccccaaggctttgtacagcagcctcccccagcccagatgccagtttattactatccctccggtcagtatccaaccagcacaacgcagcaatatcggcctatggccccagttcaatataatgcgcagcgctcccagcagatgcctcaagccgcacagcaagccggataccagcctgtgttatctggccagcaaggcttccagggtctgattggggtacaacaaccaccccagagccaaaacgtcataaacaatcagcagggaacacccgtgcaatctgtaatggtcagttatccaacaatgagtagttatcaggttccaatgacccagggttctcagggactgcctcagcagtcctatcagcagcctataatgttgccaaaccaagcaggccaagggagtttgccagccaccggtatgcctgtgtactgcaacgtgaccccgccaacgcctcagaacaacctgagactaattggtccacactgcccatcatccacagtacctgtgatgtccgctagttgtcggacaaattgtgcttccatgtcgaacgcaggttggcaagtgaagttctag

SEQ ID NO: 30471 - DNA, 1842 bp, Artificial Sequence
  Description of Artificial Sequence: Synthetic coding sequence
atggccacaatccctgactggaagctgcagctcctggccagacgaaggcaggaggaggcaagcgtgcgcggaagagaaaaggccgagagggaacggctgtcacagatgccggcttggaaacgagggctcctggaacgcagacgagcgaagctaggcttgtcccccggtgagccaagccctgtgctggggacagtggaggctgggcctcccgaccctgacgaaagcgcggtgctgttagaagctattggccctgtgcaccagaacaggttcattcgccaggaaagacagcagcagcagcagcagcaacagaggtcagaagagcttttggccgagagaaaacccggaccgctggaagcacgcgagcgcaggcccagtcctggcgagatgcgcgatcaatctcccaaaggcagagagtcacgcgaggagaggctgtctcccagagagactagggaaagacgccttggaattggcggagcccaagagcttagcctacggccactggaggctcgggattggcgccagagccccggagaggtcggggatcgcagcagccggttatccgaggcttggaaatggaggctcagtcctggagaaacaccagaacgcagcctgcgtctcgccgagtctcgggagcagagcccaagacgcaaggaagtagagagcaggctttccccaggagaatccgcataccagaagttaggccttacagaggctcacaaatggcgacccgactccagagagtcccaggaacagagccttgtgcagctggaggctacggagtggcgtttgcggtctggagaggagcggcaggattactcggaagaatgcggacggaaggaagaatggccagtgcctggagtggcacctaaagagacggccgaactcagcgaaacccttacgagagaggcccaggggaattctagcgccggagtcgaagcagcagagcaacggcctgtagaagacggcgagcggggaatgaaaccaacggaagggtggaaatggaccttgaatagtggcaaagctcgtgaatggactcctcgggacatcgaggctcaaacacagaagcccgaaccccctgagagtgccgaaaagctgctagagagcccaggagtggaagccggtgagggtgaggcagaaaaggaggaagcaggtgcacagggcagaccgcttagggctctacagaattgttgttccgtgcctagtcctctacccccagaggacgcgggtaccggtggcctgagacaacaggaggaggaggccgtcgagcttcagcccccaccaccagcccctctgtcacctccacccccagccccaaccgccccacagcctccgggagatcctctcatgtccagactcttttacggggtgaaagcaggcccaggagtgggcgctcctcgtagaagcggtcatacatttaccgtgaacccgagaagatctgtgccaccagcaacacctgccacacccacatctccagccaccgtggatgccgctgtgcccggagccggaaaaaaaagataccctacagcagaggaaatcctggtgctaggcggttacctcagactgagcaggagttgtctggcaaagggctccccggagcggcatcacaaacaactgaagatttcttttagcgagacagcgctcgagaccacttaccagtatccatccgagtccagcgtgctggaagagctgggcccagaacccgaagttccaagcgcccctaatccaccggctgctcaacccgacgatgaagaagatgaggaggagctactgctcttgcagccagagctgcagggcggtctaagaacgaaggcacttatagtggatgaatcttgccgtcgatag

SEQ ID NO: 30472 - DNA, 582 bp, Artificial Sequence
  Description of Artificial Sequence: Synthetic coding sequence
atggccagagcgggtcccaggctggtcctgtctgaggaagctgtcagagccaagtccggcctgggaccccaccgcgacctcgccgagctccaatcattgagcattccgggtacataccaagaaaaaataacgcatctcggtcattcactgatgtccctgaccggcctgaagtctttggacctttcaaggaattccctggtgtctcttgaaggaatccagtacctgaccgccctagagagtctcaatctgtattacaactgtatcagcagcctggcagaagtattccgattgcacgccttgaccgagctggtggacgtggatttccggctcaaccccgtggttaaagtcgagcctgactaccgcctcttcgttgtgcatcttctgccgaagctccaacagcttgacgacagaccagtccgcgcaagcgagcgcaaggccagtcgcctacacttcgcttccgaggattccctagattcaaaggaatccgtgcccgcttccctcaaggagggacggattcagacatctgttgagcctgcagtcggcacagttcccgtgtgggggctttgggaggcaggaccctag

SEQ ID NO: 30473 - DNA, 177 bp, Artificial Sequence
  Description of Artificial Sequence: Synthetic coding sequence
atgtactttaactataaatctgtgtgcggcagctgcgggtttggatcgtgttacggatgcggttatggttgtattcactcaacacattgtgggtgtaatggttactacggatgttatgagaacaaatatagcgtcatagatgacctgatcttctttgcaagcaagaaatgccattag

SEQ ID NO: 30474 - DNA, 585 bp, Artificial Sequence
  Description of Artificial Sequence: Synthetic coding sequence
atgaatgggcgagccgacttccgggagcccaacgcggaagtgcctcgcccaatcccccatataggaccagactacattccgacagaggaagaacggagggtattcgctgagtgtaatgatgagtctttttggttccggagcgtgccgctagctgcaacctccatgctgatcactcaaggcttgatctctaaagggatcctgtcaagtcatcctaaatatggttccattccgaaactgatattggcatgcattatggggtactttgcaggaaagttgtcatacgtgaagacatgccaggaaaaattcaagaaactggagaactcaccgcttggtgaggcactgaggagtggacaggccagacggtcctccccacccggacactactaccagaagagtaagtatgattcaagcgtgtcaggccagtccagctttgtaaccagcccagcagctgataacatcgaaatgctgcctcattacgagccaatcccatttagctcaagcatgaacgagagcgcacccaccgggatcacagatcacatcgttcaggtcaaggtgaataagtatggagatacctgggacgagtag

SEQ ID NO: 30475 - DNA, 2421 bp, Artificial Sequence
  Description of Artificial Sequence: Synthetic coding sequence
atgagcagcagccctgtgaacgtgaagaagttgaaagtttccgagctcaaggaggagctaaagaagcggaggctgtctgataaaggtctgaaggccgagctgatggaacggctccaggccgctctcgatgacgaggaagcgggtgggcgtcccgcaatggagcccggaaacggatcacttgaccttgggggagactccgcaggaagatccggggcaggcctcgaacaagaggccgctgctggcggagacgaagaagaggaggaggaagaagaggaggaggagggcataagcgctttggatggggaccagatggagctcggggaggagaacggggctgccggagccgctgacagcggtcccatggaggaagaagaggccgcttctgaggacgaaaatggggatgaccaaggtttccaggaaggagaagacgagttgggcgatgaggaggagggggctggagacgagaatggacacggcgaacagcagccgcagcctcccgctactcagcagcagcaaccacagcaacagaggggagccgctaaagaagcagcaggaaaatctagtggtcctacatctttatttgctgtcacggtagcacctccgggagctaggcaggggcagcagcaggccggtggtgatggtaaaacagaacagaagggaggagataagaaaagaggagtgaaacggcctcgggaggatcatggaagagggtatttcgagtatattgaagaaaacaagtacagcagagctaaatctccccagcctccagttgaggaggaggacgagcacttcgatgatactgtcgtctgtcttgacacctataattgcgatctccatttcaaaatttctagagacagactgtcggcgagttccctcacaatggaaagctttgctttcttatgggccggtggccgagctagttatggcgttagtaaagggaaggtgtgctttgagatgaaggtcaccgagaaaattcccgttaggcacctgtatacaaaggatatagacattcatgaagttcggataggttggagcttgaccacaagcgggatgcttctcggtgaggaggagttcagttacggatattcgcttaaaggcatcaagacgtgtaactgcgagacagaagactacggcgaaaaatttgatgagaacgatgttatcacatgttttgctaactttgaatcagatgaagtagaactctcgtacgccaagaacggccaagaccttggtgtcgcctttaagatctctaaagaagtgcttgctggaaggcctctgtttccccatgtcctgtgtcataactgcgccgtcgaattcaattttggacagaaagaaaaaccatactttcctataccggaggaatacacctttattcagaacgtccccctcgaagatagggtgagaggcccaaaaggtccagaagaaaagaaggattgtgaagtagtgatgatgatcgggctgcctggcgcaggaaagacaacctgggtgacaaagcacgccgcagaaaatcccggaaagtacaacattctcggaaccaatactataatggacaaaatgatggtcgctggatttaaaaagcaaatggcagacaccggcaagctgaatacactgctgcagcgggcaccccaatgtctgggcaagttcatcgagatcgctgccaggaaaaagcgaaatttcatactggaccaaactaatgtgagtgccgctgcacaacgaagaaaaatgtgtctgttcgccggatttcagcgcaaggcagtcgtggtgtgcccaaaggacgaagactacaagcagcggacccagaagaaggccgaagtggaggggaaagacttgccggagcatgcagtactcaagatgaagggcaattttacactcccagaagtcgcggaatgcttcgacgagattacctacgtggagctccagaaggaggaagctcagaaattgctggagcagtacaaagaggagtccaaaaaggcactaccgccagaaaaaaaacagaacacaggatccaagaaatccaataaaaacaagagtggcaagaaccagtttaacagagggggtggccatcggggtcgaggcggattcaacatgaggggcggaaattttaggggcggagcgccaggaaacagggggggttacaatcgcagaggtaacatgcctcagagaggcggtggtggcggagggtccggaggcataggatatccataccctcgggcacctgtcttccctgggcgaggctcctattctaacagaggtaattacaatagaggcggaatgcctaatcgaggcaattacaatcaaaactttcgcggacggggaaacaacaggggctacaagaatcaatctcaggggtataaccagtggcaacagggccaattttgggggcaaaaaccctggtcccagcattaccatcagggatattattag

SEQ ID NO: 30476 - DNA, 651 bp, Artificial Sequence
  Description of Artificial Sequence: Synthetic coding sequence
atgagcaccgtggatctggcaagagtgggcgcatgcatcttgaagcacgcagtcactggagaagccgtggagcttcgaagcttgtggcgagaacatgcgtgtgtcgttgccggattgcgaaggtttggatgcgtagtatgtcgctggatcgcccaggacctgtcgagtttggcaggcctcctggaccagcacggagtgcgccttgtcggggtcggacctgaggcgttgggactccaggagtttctggacggtgactactttgccggagaattatatctggatgagtctaaacaactgtacaaagaacttggatttaaaaggttgtggacccaagccagccctgagttcggacaggctacatggtgccttcggaggtataattctctgagcattctccccgcagccctcggaaagccggtgagagatgtcgctgccaaagcaaaggccgttggcatccaagggaacctgagcggagacttactccagtcaggaggtttgctggtagtatcgaagggcggagataaggtgctgttacacttcgtgcaaaaatctccaggcgattatgtccccaaggaacacatcctccaggtgctaggaatttcggctgaggtgtgcgctagcgatcccccacagtgtgatagagaggtatag

SEQ ID NO: 30477 - DNA, 1191 bp, Artificial Sequence
  Description of Artificial Sequence: Synthetic coding sequence
atgttctggaaatttgatttgcacacctcttcgcaccttgacacgctgctggagcgggaggacctgtcgttacctgaacttttagacgaggaggacgtcctccaagaatgtaaggtggtgaatcgcaagctgttggatttcctccttcagcctccacacctgcaggccatggttgcctgggtgacacaagagcctcctgattccggcgaagaaaggctccgctataaatacccttccgtcgcgtgcgaaatactaacatccgatgttcctcagatcaatgatgctctgggagcggacgagagcttgctgaatcggctttatggatttctgcagagcaccggttctctcaacccactgcttgcatctttcttttccaaggtaatggggattctgataaatagaaaaacggaccaactggtgtcctttttaaggaagaaagacgattttgtcgacctcctgcttcagcacataggcactagcgccattatggatctgctgcttaggctgttaacgtgcgttgaacgccctcaattaaggcaggatgtcgttaattggctgaacgaggaaaagatcgtccaacggctcattgagcaaatccaccctagcaaggacgaaaatcaacattcaaacgcctcacagtctctatgtgatattattagactgagccgtgagcagatgatacaggtgcaagactcgccagtgccaactgatgcccctacaagccctcgagtgtccggggaagaggaactgcatacaggaccccctgctccacaggggccattgtctgtgccgcagggcctaccgactcagagtctggcaagtccccctgcccgagatgctctacagctgcggagccaagatccgactccccctagtgcacctcaggaggctacggaaggcagtaaggtaactgagcccagcgcaccttgccaggcattggtgagtatcggagacttacaggctactttccacggaattagatctgctcctagcagcagcgacagcgcgacccgggacccctcaacgtctgtgcccgcttctggagcacaccaacctccacagacaacggagggagaaaaaagccccgagcctcttggacttccccagtctcagtcagcccaggcgctgacccctccccctatcccgaatggttcggctcctgagggtcccgctagccctggtagtcaatag

SEQ ID NO: 30478 - DNA, 2178 bp, Artificial Sequence
  Description of Artificial Sequence: Synthetic coding sequence
atgggcactcgtaagaaggttcatgcatttgtccgcgtgaagcccaccgatgattttgcccacgagatgattcgctacggtgacgataagcggtccatcgacatccatttgaaaaaggatatcaggaggggtgtagtcaataatcagcagaccgattggtcattcaaactcgacggagtcctgcacgatgctagtcaggacctggtttatgaaaccgtggcaaaggacgttgtcagtcaggcactcgacggatacaatggcacaatcatgtgctatggtcagaccggcgctggtaagacatataccatgatgggagctacagagaactacaaacatcgcggaatattaccgagagccctccagcaggtttttcgcatgatcgaggaacggcctacccacgctataactgtccgagttagctacctggagatttacaatgagtctttgtttgatctcctgtccacgctgccatacgtgggcccatctgtgactccaatgaccattgtggagaaccctcagggagtgtttataaaaggattgtctgttcacttgaccagtcaggaagaagatgctttttctctcctttttgaaggcgaaactaatcgcattatcgctagccataccatgaacaaaaactcctccaggtcccattgcatatttaccatctacctcgaagctcactcaaggaccctgtcagaggagaaatacatcacttcaaagattaacctagtagatctggctggtagcgaaagactcggaaagtccggttctgaggggcaggtcctgaaagaggccacctacatcaataagtcactcagctttctcgaacaggcgatcatagccctgggtgaccagaagcgggatcatattcctttcaggcaatgtaagctcacccacgccctgaaagattcactggggggaaactgcaacatggtcctggtcacaaatatctatggggaagccgctcaattggaagagaccctctcctcactgaggtttgcatcccggatgaaactggtcactacggaacccgctattaacgagaaatacgacgctgagcgcatggtgaaaaacctggagaaagaactggccctacttaagcaagagttagccattcatgattctcttaccaatcgcaccttcgtgacttatgatccaatggatgaaatccagatcgcagagataaacagccaggttcggcgttacctcgaaggaacattggatgagatcgacattatcagcctaaggcagattaaggaggtttttaaccagttcagagtggtcctgtctcaacaagaacaggaagtggagagtaccttaaggcggaaatacacactgatcgacaggaatgacttcgccgctattagtgctattcagaaggccggtcttgtagacgttgatggccacctcgttggcgaacccgagggacagaactttggccttggggtcgcgccattttcaactaaacccggaaaaaaggccaagtctaagaaaacattcaaagaaccgctgcgacctgatacgcctccctccaaacctgtggcgttcgaggaatttaagaatgaacagggttccgaaatcaaccggattttcaaagaaaacaaaagtatacttaacgaaaggaggaaaagggcaagtgaaactacacaacacattaatgccatcaaacgagaaattgacgtcactaaggaggctttaaacttccaaaagagcctgagggagaagcagggtaagtatgagaacaagggcctcatgataattgatgaggaagaatttctgctcattctcaagctgaaagacttgaaaaaacagtaccgttccgagtatcaggatctccgcgacctacgagctgaaatacagtactgccaacacttagtggatcagtgtaggcaccgattactgatggagttcgacatctggtataatgaaagctttgtgatcccggaagacatgcagatggcgcttaagccaggcggatccattcgaccaggtatggtgcctgtgaacaggattgtgagcctcggtgaggatgaccaggacaagttctcacagctgcagcagagggttttgcccgaaggccctgattctataagtttctataatgccaaagtcaaaattgaacaaaaacataattacttaaaaaccatgatgggacttcagcaagcacaccgcaagtag

SEQ ID NO: 30479 - DNA, 282 bp, Artificial Sequence
  Description of Artificial Sequence: Synthetic coding sequence
atggcagcagctactggcgatcccggactcagcaagctccagtttgcccctttctcatcagctctggacgtcggattttggcacgaactcacccagaagaagctgaacgagtatcggctggatgaggcccctaaggacatcaagggctattactacaatggtgattcagcaggactgccagcgcgtctcactctcgaattttccgccttcgacatgtctgcaccgacaccggctcgttgttgccccgctattggtaccctgtataatacaaatacactgtag

SEQ ID NO: 30480 - DNA, 333 bp, Artificial Sequence
  Description of Artificial Sequence: Synthetic coding sequence
atgggcaagaaacagaacaaaaagaaggtcgaggaagtgctggaagaggaggaagaagagtacgtcgtggagaaggtcctcgacaggcgcgtagtgaaaggcaaggtcgaatacctgttgaaatggaagggcttttcagacgaagataatacatgggagccggaggagaacttagattgccccgaccttattgctgaattcttacagagtcagaaaaccgctcacgagaccgacaagtctgaggggggaaaaaggaaagccgattccgactctgaggataagggcgaagagagtaagcccaaaaagaagaaggaggaaagtgagaagccatag

SEQ ID NO: 30481 - DNA, 270 bp, Artificial Sequence
  Description of Artificial Sequence: Synthetic coding sequence
atgagttattaccagaggcccttttcaccttcggcctactcactccccgctagtctgaactctagcattgtgatgcagcatggtactagcttagactccaccgacacttatccccagcacgctcagagtttagatggtacaacttcctctagcattccgctgtataggtccagcgaagaagaaaaacgggtgactgttatcaaggctccccactacccagggattggacccgtggatgagagcggcattcccacggcaatacgcacttag

SEQ ID NO: 30482 - DNA, 1269 bp, Artificial Sequence
  Description of Artificial Sequence: Synthetic coding sequence
atggagcggaaggacttcgagacctggcttgacaacatatccgtgacgttcctcagtctcactgacctacagaagaatgagacactcgaccatttgatcagcctctctggcgctgttcagctcagacacctttccaataatttagaaactctgctgaagcgagattttctcaagctgcttcctttagagctgtccttttatctgctgaagtggctggatccacagaccctgctgacctgctgcttggtcagcaagcagtggaacaaggtgatctctgcgtgcacagaagtatggcaaactgcctgcaaaaacctcgggtggcagattgacgattctgtgcaggatgccttgcactggaagaaagtttatttgaaagccatccttcggatgaagcagttagaagatcacgaggcatttgagacctctagcttgatcgggcatagtgctcgggtgtacgccttatactataaagatggcttattgtgtacaggatctgatgatctctcagctaagttgtgggatgtcagcacagggcagtgcgtgtacggcatccagacacacacttgtgccgcagtcaagtttgacgagcagaaactggtaacgggcagtttcgacaatacagtggcatgttgggaatggtccagcggtgccagaactcaacacttccgaggccacactggggctgtttttagcgtcgactacaacgacgaactggatatcctggtgtctggcagcgctgatttcaccgtgaaggtctgggccctgtcagcaggaacatgtcttaacactctcaccggtcatactgaatgggtcacaaaggtggtcctgcaaaaatgtaaagtgaaatctttgttgcattcacctggggactacattctgctgtccgcagataaatacgagattaaaatctggcccatcggtcgggagatcaattgtaaatgtttaaagaccctgtcagttagcgaagatcgctcaatatgcctgcagccacgtttacacttcgatggcaagtatattgtctgttcttcagctctgggcctctaccaatgggacttcgctagctacgatattctccgagtgatcaagacacccgagatcgctaatctggccctgctcggatttggagacatttttgccttgctgtttgacaaccgctacctgtacatcatggatttacgcacagaatctctcatctcccgctggccacttccggagtacagaaagagcaagcgtggatcaagctttcttgcaggcgagcatccaggttag

SEQ ID NO: 30483 - DNA, 1179 bp, Artificial Sequence
  Description of Artificial Sequence: Synthetic coding sequence
atgagcgctctggcgggtgaggatgtttggagatgtcccggatgcggggaccatatcgccccatcccagatctggtatcggaccgtgaacgagacgtggcatggcagctgctttcgcaggagcaactccattagtaaatctcctgggccatcctctccgaaggaacctctgctgtttagtagagacatctccaggagcgaatcccttagatgttcatcaagttattctcagcagatattccgaccttgcgaccttatacacggagaggtacttggcaagggcttcttcggccaggccataaaagtaacccacaaagcgacagggaaggtgatggtcatgaaggagctaatcaggtgtgacgaagagacgcaaaagacttttctgaccgaggtcaaggtgatgagatcactcgaccaccccaacgtgcttaagttcattggcgtgttatacaaagataagaagctgaacctactcaccgagtatatcgaaggcggtaccttaaaagactttctgcggtcgatggaccccttcccctggcaacagaaggtgagatttgccaaaggcattgcgtccgggatggcctacctgcatagcatgtgcatcattcacagggacctaaatagccacaattgccttatcaagctggataaaaccgtggtggtagcggactttggactcagcagacttattgtggaggagaggaagcgtgcacctatggaaaaggccactaccaaaaaacgaactctgaggaaaaatgatcggaaaaagcgctatacggtagtcgggaacccctactggatggcgcctgaaatgctcaacggtaaatcctatgacgaaaccgtcgatatcttcagctttggcatcgttctttgtgagatcataggccaggtctacgccgacccagactgtttgccacgcacactggattttggcctcaacgtcaagctgttctgggaaaaatttgtgcccacagactgccccccagctttcttccctctggctgcgatctgttgccgacttgaacccgagtccaggcctgctttcagcaaactcgaagattcgtttgaggcactgtctctgtatctgggcgagctgggcatccccttgcccgctgagttggaggagcttgatcacacagtttctatgcaatacggtcttaccagggattccccaccttag

SEQ ID NO: 30484 - DNA, 480 bp, Artificial Sequence
  Description of Artificial Sequence: Synthetic coding sequence
atggcgacatccgctccacttcgaagtttggaggaggaagtcacttgttctatctgcttggattacttaagggacccagtgacgatcgattgcggccacgtgttttgtcggtcgtgcacaaccgatgttcggccaatcagtggctcccgccctgtgtgtcccttgtgcaagaaacctttcaagaaggaaaatatccgaccagtttggcagctggaaaaaatactgaatcacttgtccaccctgcgacgggacagagataagatccaagggttccaggccaaaggcgaggccgacattctggcagcccttaagaagctgcaggaccaacggcagtacattgtagctgagtttgagcagggacatcaatttctccgggaaagggaggagcacctccttgaacaattagcaaagttggaacaggaactcactgaaggcagagaaaaatttaaatccaggggcgtcggtgagctcgcccgatag

SEQ ID NO: 30485 - DNA, 3585 bp, Artificial Sequence
  Description of Artificial Sequence: Synthetic coding sequence
atgttttccctagatagtttccggaaggatcgggctcaacatagacagcggcaatgcaaactgcccccacctaggctgcccccaatgtgcgtcaacccaacccccggtggaaccataagccgggctagtagagatctcctgaaggagttccctcaaccaaagaacctgttgaattctgtgataggcagagcgttaggtatttctcatgcaaaggataagctcgtctatgtccataccaatggcccaaaaaagaagaaggtcacccttcacataaagtggcctaagtcggttgaggtcgaggggtatggaagtaaaaagatagacgctgaacggcaggccgcagcagcggcatgtcaactctttaagggctggggacttctgggtcccagaaacgagttgtttgacgccgcaaagtaccgcgtgcttgctgaccggttcggctctccggctgactcttggtggaggcccgagccaacaatgccacctacgtcatggagacagctaaaccctgagagcataagacctggaggccctggcggtctatccaggtcccttggacgggaagaggaggaagatgaagaggaagagttagaggagggaaccatcgatgtgacagactttctatccatgacccagcaggatagtcatgctcctctacgggactccaggggctcaagcttcgagatgacggacgacgactcagcaatccgggctctcactcagtttcccctgcccaaaaatttactagcgaaagtgatccagatcgccacctccagctctacagctaagaacctcatgcaattccatacggtcggcacaaaaacaaagctttctacgttgaccctcctttggccctgtcccatgacctttgtagctaaggggaggaggaaagctgaggctgagaacaaagccgctgccctcgcatgcaagaagctgaaaagcctggggttggtggatagaaataacgagcctctgacccacgcaatgtataacctcgcatccctccgggaactcggcgagacacaacggaggccctgtacaatccaagtgccagaacccatactgcggaagattgaaacattcctgaatcactaccccgttgagtcatcatggattgctccagaactgcgcctacagagcgatgatatcctcccactgggaaaggattctggaccgttgtcagatccaattacagggaagccatacgttccccttctcgaagctgaagaggtgagactgagccagtcgctcctagaactgtggagaagaagaggccctgtatggcaagaagcccctcagctccctgtggatcctcaccgcgatacgatactgaacgcaatcgagcaacaccccgtggtcgtcatctctggcgatacggggtgcgggaaaaccacccgcattccccaactacttctcgagagatacgtgacagaaggtcgcggagcacgttgtaacgtgataataactcagcccaggaggatttcagccgtcagcgtcgctcaaagggtgtctcacgaactggggccaagccttcgtagaaacgtagggtttcaggtaaggctggaaagcaagcctcctagcagagggggtgccctattgttttgcacagtaggaatattgttgagaaagctccagtcaaaccctagtttggaaggggtctctcacgtcatagtcgacgaagtacatgaacgggacgttaataccgactttctgctgattctattaaaaggcctgcaacgcctgaatcccgcactcagactcgtgctgatgagtgcaactggagacaacgagaggtttagtcgctactttggaggatgcccggttattaaggttccaggcttcatgtacccagtcaaagagcattacctggaggatattctggccaagttaggcaaacaccagtacctgcacagacaccggcaccacgaaagtgaggacgagtgcgccctggatttggaccttgtgacagatttggtcttgcatatcgatgccaggggggaaccaggaggaatattgtgctttctgccaggctggcaagaaatcaagggggttcagcaaagactgcaggaagctctcggaatgcacgagtcaaaatatttgatcttgcctgtacattccaacatccctatgatggatcagaaagccatttttcaacaaccaccagtcggggtccgcaagattgtgctagctaccaacattgccgaaacctcaattactatcaacgacattgtgcacgtggtcgattccggcctccacaaagaggagcggtacgatcttaagactaaagtctcttgtctcgagacggtgtgggtctctagggctaacgtgattcagcggagggggagagctggtagatgccagtccggtttcgcttaccatctgttccccaggtcaagactagaaaaaatggtcccatttcaggttccagagattctcaggaccccactcgagaacctggtgctccaggcgaaaatccacatgcctgagaagactgctgtcgaatttttaagcaaggcagttgactcccccaacattaaagccgtggatgaagccgtgatcttgcttcaggaaatcggcgtgttagaccaacgggagtatctgactactctgggccagaggttggctcatatctccaccgatccccgtctcgccaaggcaatcgttctggcagctattttccggtgcttgcatcctctgctggtggtcgtttcctgtcttactcgcgacccattttcttcttccttgcagaaccgcgctgaagtcgataaagtgaaggccctcctgagccatgattctgggtctgaccatttggcattcgtccgcgctgtggctggctgggaggaagtcctgcgatggcaggatcggagcagcagagagaactacttagaagagaacctgctgtacgcaccttctctgcggtttatccacggtctcattaaacaattctctgagaatatctacgaggctttcctcgtcgggaaacccagcgactgcaccctggcctctgcccagtgtaatgaatactctgaagaggaggagttggtgaaaggtgttctcatggccggactgtatccgaacctcatccaggtgcggcaaggtaaagtgacccgccaaggcaaattcaaaccaaattcagtgacatatcgcactaaatccggtaacattttgttgcacaagtccactataaatcgggaggctactcgcctgaggtcaagatggcttacctacttcatggctgttaaatccaacggttccgtgtttgtacgcgactccagtcaggtgcacccactggcggttctactgctgactgacggcgacgtgcacatccgcgacgatgggaggagagcaacaatctctctgtcagactccgacctgctgagactcgagggagattctcggaccgtccggttgctgaaagagctcagacgggctctgggccgtatggtcgaacgttctctcaggagcgaactggcagcactcccgccttccgtccaggaagagcacggtcagttgcttgctcttcttgcagagctcttacgtggtccctgcggtagcttcgacgtgcgcaaaacggccgatgactag

SEQ ID NO: 30486 - DNA, 207 bp, Artificial Sequence
  Description of Artificial Sequence: Synthetic coding sequence
atgtcttattaccaacgaccctttagcccctcagcttacagtctgccagcatcactgaattcctcaattgtgatgcagcatggcacttctctcgattccaccgatacgtacccgcagcatgctcaaagcctggacgggactaccagtagcagcataccgttgtatcgatctagcgaggaggagaaacgggttactgtgattaaatag

SEQ ID NO: 30487 - DNA, 1419 bp, Artificial Sequence
  Description of Artificial Sequence: Synthetic coding sequence
atgtctcggcgagtggttaggcagtccaaatttagacatgtgttcggtcaggctgcgaaagccgatcaggcgtacgaagatattcgggtgtccaaagtgacatgggactccagcttttgtgccgtgaacccaaaattcctggccatcatcgtcgaggcgggagggggaggtgcgtttattgtccttccgctggccaagactggcagggtggacaaaaactatcccctggtcacgggccacacagctcctgtgctggatatcgattggtgcccacataatgacaacgtcatagcatccgcctctgatgatactactatcatggtgtggcaaatccccgattacacacctatgcgcaatatcacggaaccaattatcactctggaaggtcattctaaaagggtcggtattctgtcatggcacccaactgcaagaaacgtcctcttgtccgctggaggcgataatgtaatcattatctggaacgtaggcaccggagaagtgttactctctctggatgacatgcatccagatgtcatccactctgtttgttggaactccaacgggtccctgttggcaacaacatgcaaggacaaaaccctccgcattattgatcctcgcaagggccaggtggttgccgaacaggcccgacctcacgaaggagccaggcctctaagagctgtgttcacagctgacggaaagctgctttcgacaggcttctctcgaatgagtgagaggcagctggcgttgtgggaccccaacaactttgaggagcccgtagctctgcaagaaatggacacatctaatggcgttctccttcccttctatgacccagacagctccattgtctacctctgtggcaaaggagattcttcaattcgctattttgagattacagacgagccaccgtttgttcactacctgaatacattttcttcaaaagagcctcagaggggtatgggctttatgccgaagcggggtttagacgtttccaaatgcgaaattgcacgcttctacaaactccatgaacgaaagtgcgagcctattatcatgaccgtcccacgcaaatctgatctgttccaggacgacctgtaccccgacacccccggaccagagccagcacttgaggccgacgagtggttgtctggacaggacgctgagccagtcttaatttctcttagagacgggtacgtgcctcctaaacaccgcgaactgagagtaaccaagaggaatatcctggacgtgaggcctccctccggacccagacggtcccagagtgcaagcgatgcccctctgtcccagcagcataccctggagacgctactggaagagatcaaagctctgcgagaacgagtgcaggcgcaggaacagcgaataactgcgttagaaaatatgctttgtgaactcgtcgatgggactgattag

SEQ ID NO: 30488 - DNA, 390 bp, Artificial Sequence
  Description of Artificial Sequence: Synthetic coding sequence
atcctacacagcctcgtccagacgggaatttgtgtcattaccctcgctgagagccatcccgttctgcaatccggaaaaaccataaagagtatctcctaccaaatctccacaaactgcagtagactacagaataaggtctcagggaagtttaaaaggggtgcccagttcttaaccgagctagcacccctttgtaagatctactgtagtgacggtgaagagtatactgtctccagctgcgtcagagggcgtctaatggaggtgaatgagaacatcctgcataagcccagtattctccaggaaaaacccagcaccgaggggtatatagcggtggtgctgcctaagttcgaggagtctaagtcaataacagaggggttgctcactcagaagtag

SEQ ID NO: 30489 - DNA, 735 bp, Artificial Sequence
  Description of Artificial Sequence: Synthetic coding sequence
atggtgcatcaggacaactgctcataccaggcccagaagaatgagcgagaaagtattcggcagaagctggctcttggatccttcttcgatgatggccctggaatctacactagttgcagcaagtccgggaagccatccctgtccagtcgcctgcagagtggaatgaacctccagatctgctttgttaatgactccggctctgataaggattctgacgcagacgatagcaaaacagagacctcactggatactccactctccccgatgagtaaacagagctccagttatagcgatagagatacaaccgaagaggagtctgaaagcctggatgatatggattttctcactcggcagaaaaagcttcaggcggaggccaaaatggccctcgctatggcaaaacctatggctaaaatgcaggtagaggtcgaaaaacagaacagaaagaagagccccgtggccgatctgttgccgcatatgcctcacatctcggagtgcttaatgaagcgctcccttaagcctaccgatctgcgggacatgaccataggccagcttcaggtaattgtcaatgacctgcattcccagattgagagcttgaatgaagaattagtccaactgttgctaattcgcgatgagctccacaccgaacaggatgccatgctggtcgacatcgaggacctgacccgccatgcggaatcacagcagaagcatatggccgaaaagatgccagcgaagtag

SEQ ID NO: 30490 - DNA, 1620 bp, Artificial Sequence
  Description of Artificial Sequence: Synthetic coding sequence
atggctaccagtgcgcctttgcgaagtcttgaggaggaggtcacatgctccatctgtctggattacctccgcgatcccgtaactatcgactgcgggcacgttttttgccgctcttgcacaaccgacgtgcgtccaatctcagggtcgaggccagtgtgccctctatgtaagaaaccattcaaaaaggaaaatatccgcccagtatggcaactggccagcttagtggaaaatatcgaacgtctgaaagttgataagggcagacagcccggagaggttaccagggagcaacaggatgcgaaactatgtgaacgccatagagaaaagctccactactattgtgaagatgatggaaagttgctgtgcgtgatgtgcagggagtcgcgggagcatagaccgcatacagctgttctaatggaaaaagctgcccaacctcatcgggagaaaatcctgaatcatctgagcactctgcgcagagatagggacaagatccaaggtttccaggcaaagggcgaagccgatatactagcagccctgaaaaagttgcaggatcaacgccagtatatcgttgctgagttcgaacagggtcatcaatttctcagagagcgcgaagagcatctgctggagcagttggccaagttagagcaggagctgaccgaaggcagagagaagttcaagtctcgcggagtcggcgagctagctcgtttggccctggttatatcagagcttgaaggtaaggctcagcagcctgcggcagagctgatgcaggataccagagactttctcaatagataccccaggaagaagttttgggtgggaaaaccgattgccagggttgttaagaaaaaaacaggagaattctctgataagttactgagtttgcagcggggtcttagagagtttcagggcaaattactaagggacctggaatacaaaacagttagcgttacattggatccgcagagtgcatcggggtacctacagctgagcgaagactggaaatgcgtaacttacacctctctgtataagtccgcttatctgcatcctcagcagtttgactgcgaacctggtgtactgggctccaagggcttcacatgggggaaagtctactgggaggtggaggtagaacgagagggatggtccgaggacgaagaggaaggagacgaggaggaagagggtgaggaggaagaggaggaggaagaagccggttacggggacggctatgacgactgggaaacagatgaggatgaagagtctttgggcgacgaggaggaagaggaggaggaggaagaagaagaggtgctggaatcctgcatggttggggttgcaagggactccgtgaagaggaagggagacctttctctgcggcctgaagacggggtgtgggcacttcgtttgtcttcatcaggcatttgggccaatacttcgcctgaagccgagctatttcccgcactgcggccaaggcgggtaggcatcgctttggactatgagggtgggaccgtgacattcaccaacgctgaatcccaggaactcatctacaccttcaccgcaacattcacacgacgtttagtccctttcctgtggttgaaatggcctggaacacggctgctgcttaggccctag

SEQ ID NO: 30491 - DNA, 441 bp, Artificial Sequence
  Description of Artificial Sequence: Synthetic coding sequence
atgtttgaaatactgacaagcgagttctcataccagcacagtctgtccattctggttgaggaattcttgcagtcaaaggagctccgtgccacggtcacacagatggagcaccaccatcttttcagtaacatcttagacgtcttgggcgcttcccagagattcttcgaagacctcgaacaacggcataaagcccaagtgctcgtcgaagacatttcggacatcctggaagaacacgctgagaaacacttccacccatatattgcttactgctcaaacgaggtctaccaacagaggactctgcagaaacttatcagtagtaatgctgcctttcgagaggctcttcgggagattgagagacggcctgcatgcggcggtttgcctatgctgagcttcctgatactgcccatgcaaagagtgactcgtcttccgctgctaatgtag

SEQ ID NO: 30492 - DNA, 483 bp, Artificial Sequence
  Description of Artificial Sequence: Synthetic coding sequence
atggaggcggaaaggcctcaggaggaggaagacggcgaacagggtccaccccaagacgaagaaggttggcctccaccaaacagcactacaaggccttggcgatccgccccaccttctccccctccccctgggacacggcacacagcactcggaccacgctcggcatccttgctcagcctgcaaacagaactcctcctggatctggtggccgaagctcagtccaggagactagaggagcagagagccacattctacaccccacaaaacccgtccagcctcgcccctgcgcctttgaggcctctggaggacagggaacagctttatagtacaatcctttcacaccagtgccagcgaatggaagctcaaagaagtgagcccccactgcctccaggtggacaagaacttctggaactcctgctgcgagtccaaggcggaggcagaatggaagagcagcgcagccgcccacccactcacacatgttag

SEQ ID NO: 30493 - DNA, 303 bp, Artificial Sequence
  Description of Artificial Sequence: Synthetic coding sequence
atgtcatactaccaaagacccttttccccttctgcctacagtctgccagcatccttgaattcttccattgtgatgcagcacggtaccagcctggattccaccgacacttatccccagcacgcccaaagtctggacggcactacaagttcctctattccactgtacagatcatccgaagaggagaaacgtgttactgtgattaaggcaccccactacccaggtatcgggcctgttgacgagtctggcatcccaacagcaatccgcaccacggtagaccggccaaaagactggtataagacatag

SEQ ID NO: 30494 - DNA, 369 bp, Artificial Sequence
  Description of Artificial Sequence: Synthetic coding sequence
atggctaccagcgccccactgagaagcctggaggaagaggtgacctgcagtatctgcttggactacctccgggatcctgtgaccattgattgcggccatgtattttgcagatcatgcaccaccgatgtgaggccgatctcaggctctagacctgtctgccctctttgtaagaagcctttcaaaaaggaaaatattagaccagtatggcagctggcttctctggtggagaatatcgagaggctgaaggtggacaagggacggcagccaggggaggtgactagggaacagcaagacgcgaagctttgcgagagacaccgtgagaaattgcattattattgcgaggacgatgggaaactcctttgtgtatag

SEQ ID NO: 30495 - DNA, 633 bp, Artificial Sequence
  Description of Artificial Sequence: Synthetic coding sequence
atggtgtccatgtccgtgccagattgcctctcaattatgacctatgtctcacagtactacaatcatttctgttctcccggacaagccggagtgtcccccccacgcaagggactcgcaccttgttcacctccgtcagtagcccctacacccgttgaacccgaagacgtggctcagggggaagaactgagctctgggagccttagtgaacagggaacgggccagaccccaagtagcacctgtgcagcatgccaacagcatgtgcacctggtacaacggtacctggccgatggcagactttatcacagacattgctttcggtgtcgcaggtgttcctcaaccctccttcctggtgcatacgagaacggcccagaggaaggcactttcgtctgcgccgagcattgcgctcgccttggcccaggaacacgcagcggtactaggcccggtcccttcagtcagccaaagcagcaacaccagcagcagttggctgaggatgctaaggatgtgccaggagggggaccctccagctcagcacctgccggtgcggaagcggacgggcctaaggccagcccggaggctcggccacagattccgactaagcccagagtcccaggaaaacttcaggaattggcgtag

SEQ ID NO: 30496 - DNA, 390 bp, Artificial Sequence
  Description of Artificial Sequence: Synthetic coding sequence
atggctgaattaatccaaaagaaattgcagggtgaagtggagaagtaccaacagctgcaaaaagacctttctaaatccatgagtggacggcaaaagctcgaagcccaactgacagagaacaacattgtcaaagaggagttggccctgcttgacggtagtaacgtcgtgttcaagctgctgggccctgtcctggttaaacaggagctgggagaggcccgagcgacagtgggtaagaggctcgattatattactgccgagattaagcggtacgagagtcaattacgagatctggagagacagtcagagcagcagcgtgaaactttggcgcagttgcagcaggagttccagcgggctcaggccgctaaagccggtgcaccgggaaaggcttag

SEQ ID NO: 30497 - DNA, 621 bp, Artificial Sequence
  Description of Artificial Sequence: Synthetic coding sequence
atggctctgaacgttgccccagttcgtgacaccaaatggctcacactggaggtgtgtcgtcaatttcaaagagggacttgcagcagatccgacgaggagtgtaaattcgcccacccccctaaaagttgccaggtggagaacggaagggtcattgcatgctttgactctcttaagggcaggtgtagtcgcgagaactgtaaatacttgcaccccccaacccatttaaaaacccaactggagataaatggccgaaataacctgattcaacagaagactgccgcagctatgttagcccaacagatgcagttcatgttccctgggacacctttgcaccctgtagctttcccccctggggctctgcatcctttgcctaaacggcaggccttagaaaaaagcaatgggacaagcgctgtcttcaatccctccgtgctgcattaccagcaagcactgacatctgcccagctacaacaacatgcggcattcattccaaccgataattctgagatcatcagccggaatggtatggaatgccaggagtcagccctgaggattacaaagcactgttactgtacctactaccccgtttcatccagcattgagcttccccagacagcctgttag

SEQ ID NO: 30498 - DNA, 978 bp, Artificial Sequence
  Description of Artificial Sequence: Synthetic coding sequence
atgcagcaacctgtcagagctggggatatcggcgtgtcacgcgtgcaaacccaccataatgcttctccattttccgtgcctaagaaacaagacgaaagtcccatgataggagacggggaggattattttctgtccctgtttggagatagcaagaaactaacggctcatagcaactacacccagaaaacgttgaaatacttttccatgatactggaggaggttggccagtttacctctagctccctcggggatgtggaaatagcagaagttaatgtgaagggccttttcgtgaagctcatcaatagcagcctggacaaagagatggccattggtgaccacattctgcagcaaaatgtgaacggccaaacgatatctttataccggttcctccctaatatcgtgatgcaggccaatagcaccgtgactgtctgggccgctgccagtgaggctaagcaccagcctccctcagacttcctttggaaggagcaagataagtttcgcgcttcccccgactgtatcacgatattatgtaagcctaacggccaggctatcgcatggtacacaccaatccactggaaacaggcgtgggaaaaacttgacgccgacgtcgagttcaatcggtgttccgttgtgagcccaacctttcgcaagagagtgttccagtggaccgctagcacagctaccattacgaaggaaaaacaagatcaacccaagaaggacatctccaactatcaggttgagcaggctcaagtgctcttaaaacgcgagaaggagatcccacctactgttttccctaatcggtcaccctggtgccagaacccttacgtttccgcacacccgtattgccctctgatcgaaccccataatacatctactgctggcggtagactggatagacagcccaggacccgctctacacgccctaaccgtgcaagcggttccaagaaaaagaaaacgtctgagagtcagaaacaatag

SEQ ID NO: 30499 - DNA, 1257 bp, Artificial Sequence
  Description of Artificial Sequence: Synthetic coding sequence
atgagggaaatcgttcacatccaggcaggacagtgcggaaaccagatcggcaccaagttctgggaggtcatctcggatgagcatggtattgatcctgctggaggatacgtgggtgacagcgccctacagttggagcggattaatgtttactataatgagagctcaagtcaaaaatacgtgcctagggccgctctcgtagacctggaaccaggaaccatggattcagtgaggtctggacccttcggtcagctgtttagacccgacaactttattttcggccagactggtgcagggaataactgcctccagggcttccagctgacacattccttgggcggtggaaccgggtctggaatgggcaccctcctgatcagcaaaataagggaagagttccccgatcgcattatgaatacgttcagcgtgatgccatctcctaaggtcagcgataccgtggtagaaccttacaacgccacattgtcagtgcaccagctggttgagaacaccgacgagacttattgtattgataacgaggctctgtatgatatttgctttcgtaccctgaaacttactacccccacttacggcgacctgaaccatctcgtgtcagcgactatgagcggagtgaccacctccctaaggttcccaggacagctgaacgcggatctccgcaaattagcagtgaatatggtgcccttccctcgcctgcacttcttcatgccaggctttgcacccctaacatcacggggttctcagcagtacagagctctgaccgtacctgaattgacccagcaaatgttcgacgccagaaacatgatggccgcttgtgaccctagacatggtagatacctcaccgtggcaaccgtgttcaggggcccaatgagtatgaaagaagtggatgagcagatgctggcgatccagagcaaaaactcatcttatttcgtggagtggatccccaacaacgtgaaagtggctgtttgcgacataccacctcgcggactgaaaatggcgtcaacattcatagggaactctacagctattcaggagctctttaaaaggatttctgagcagttcagcgccatgttccggcgaaaggcctttctgcactggtttacgggcgaaggcatggatgagatggagttcactgaggccgaaagtaatatgaacgacctggtatccgaatatcagcagtaccaagatgctacagccaacgatggagaggaggcttttgaggacgaggaggaagaaatcgatggctag

SEQ ID NO: 30500 - DNA, 270 bp, Artificial Sequence
  Description of Artificial Sequence: Synthetic coding sequence
atggacgttctctcacctctgtcattcattaaagtgtctcatgtgcgcatgcagggcatactactcctggtatttgctaagtaccaacacctgccttacattcagatcttgagcaccaagagcactccaaccggtttgttcggatattggggaaataagggtggcgtgaatatatgtttaaaattatacgggtactatgtcagcatcataaattgtcatctaccaccccacatctcaaataattatcaacgcctggaacattttgactag

SEQ ID NO: 30501 - DNA, 180 bp, Artificial Sequence
  Description of Artificial Sequence: Synthetic coding sequence
atgacccgcggtaatcagagggagttagcaagacaaaaaaatatgaagaaacagtcagattctgtcaagggtaagcgccgtgacgatggactgtccgccgcagccagaaaacagagagactcagagataatgcagcagaagcagaagaaagcaaacgaaaaaaaagaggagcctaagtag

SEQ ID NO: 30502 - DNA, 864 bp, Artificial Sequence
  Description of Artificial Sequence: Synthetic coding sequence
atggatgaaactgagatagggtcttgttttggtcgctacggatctgtgaaagaagtgaaaattatcacgaacaggacaggagtgtccaaaggatacggctttgttagttttgtgaatgacgtggatgttcagaaaattgtgggcagtcagattcattttcatggaaagaagctaaagcttggtccagccattcggaaacagaagttgtgcgccagacacgtgcagccccgacctctggtggtgaaccctcctccgcctcctcagttccaaaacgtctggcggaatcccaataccgaaacatatctgcagccccagataacgcccaaccctgtgacgcagcatgttcaggcttatagcgcttatccccactctccgggtcaagtgatcactggctgtcagctgcttgtctataactatcaggaataccctacttacccggactcggcatttcaggtgaccaccggataccagctgcctgtttacaactatcaacccttcccagcataccctagaagtccattccaggttaccgccggttaccagctgcccgtctataattatcaggctttcccagcgtacccaaattctccttttcaggttgctactggataccagtttccagtttacaattaccagccttttccagcttacccttcctcgccatttcaagtaacagccggataccagctgcccgtgtacaattatcaagccttcccagcttatcccaattcgccttttcaggttgccacaggatatcagtttccagtctacaattatcaggccttccctgcatatcctaattcacctgtgcaagtgacaactgggtaccagctgcccgtgtacaattaccagaaattcccatag

SEQ ID NO: 30503 - DNA, 1344 bp, Artificial Sequence
  Description of Artificial Sequence: Synthetic coding sequence
atggatatgggaaatcaacatccctcgatttctcggcttcaggagatacagaaagaggtgaagtcagtggagcaacaagtgatagggttttctggcctgagcgacgacaaaaactacaagaaactggagagaattctcacaaaacagcttttcgagatcgatagcgttgatactgagggcaaaggagacatccagcaggcaagaaagcgcgcagcccaagagaccgagcgactcttgaaagagcttgagcagaatgcaaaccaccctcatcggattgagatccagaacatttttgaggaggcccagagtctcgtgagagaaaagatcgtgcccttttataacggtggcaattgcgtcactgatgaattcgaagagggcattcaagacattattctgcgtttgacacatgtgaagaccggtggcaagatcagcttgcgcaaggctcggtaccataccctgacaaagatctgcgctgtgcaggagatcatcgaggattgtatgaagaaacagcccagccttcctctatccgaggatgcgcaccccagcgtagctaaaattaattttgttatgtgtgaggtcaacaaagcccgtggcgttcttatcgccctgctgatgggcgtgaataacaatgaaacctgccggcaccttagttgcgtgttgtcgggactgatcgccgacctggacgctctcgatgtgtgtggccgaacagagattcgtaactaccgacgcgaggtggtcgaagacattaataagttgctgaaatatctggatttggaagaggaagcagataccacaaaagccttcgacctgcgccaaaatcattctatcctcaaaattgagaaagttctcaagaggatgagggagatcaagaatgaactactgcaagcccagaatcctagtgagctttatttgagcagtaaaaccgaactgcagggactgatcggccagcttgacgaagtgagcttggaaaagaatccatgtatccgggaggcccgacggagagctgttatcgaagtgcaaaccctgatcacatacattgacctgaaggaagctctggaaaagcgcaaattatttgcgtgcgaagagcaccctagccacaaagctgtgtggaacgtgctggggaatctttcagagattcaaggcgaagtactctctttcgacggcaacagaaccgacaaaaactatatccggctggaagagttactgactaagcaactgctggctctggacgccgtcgatccgcagggggaggaaaagtgcaaggcagcaagaaaacaggcagttagattagcccagaacatactaagctacctcgatctgaaatctgatgagtgggaatattag

SEQ ID NO: 30504 - DNA, 474 bp, Artificial Sequence
  Description of Artificial Sequence: Synthetic coding sequence
atggctaacatcgcagtgcagagaatcaagcgcgagtttaaggaggtcctgaagagtgaggaaacatcaaagaaccagatcaaagtggacctcgtggacgagaacttcaccgagctgcggggtgagatcgccggtccaccggacacaccctacgaaggcggaagataccagctggagattaagatacctgagacttaccccttcaaccctccgaaggtccggttcattaccaagatctggcacccgaatatatcctccgtgactggcgcaatttgtctggacattcttaaggaccagtgggcagcagctatgacccttcggaccgtgctgctaagtctgcaggcactcctcgcagccgcagaacccgacgatccacaggacgccgtggtcgctaatcagaatgccgttatcgtagccttgtcatctaaatcctgggacgtagaaaccgcaactgagctgttgttgagtaactag

SEQ ID NO: 30505 - DNA, 582 bp, Artificial Sequence
  Description of Artificial Sequence: Synthetic coding sequence
atgccaactacgtcccgccctgcactggatgtgaagggtggtacaagccccgctaaggaggacgcgaatcaagagatgtcttctgtggcatattccaatcttgccgtgaaagatcggaaagctgtggcaatcctccattaccccggtgttgcatctaatggcacaaaggcctctggtgcacctacaagttcaagtggaagccccatcggcagtccaacaacaactccacccacaaagcctccatctttcaatctgcaccctgctccacacctgctcgctagtatgcatctgcagaagctaaattcacagtaccagggcatggccgctgcgactcctggacaaccaggagaggctggcccattgcaaaattgggatttcggggctcaggcaggcggtgccgaatctctttccccctcagccggtgcgcagagcccagcgatcatagactcggatcccgttgatgaagaagtcctgatgagcctggtagtcgaattgggcctagaccgggcaaacgagctccccgagctttggctggggcagaatgaattcgatttcacggcggactttccttcttcttgttag

SEQ ID NO: 30506 - DNA, 1188 bp, Artificial Sequence
  Description of Artificial Sequence: Synthetic coding sequence
atggcgtctgcagcctctgtgaccagcctcgccgatgaggtaaactgtccgatctgccaagggacattgagagaaccagtgactatcgactgcggtcacaatttttgtcgggcatgtctcaccaggtattgcgagattcccggacccgatctggaggagtcacctacgtgccctctgtgcaaagagccgttcagacccggaagcttccgacccaactggcagttggcgaacgtcgtggagaatatagaacgtctccagcttgtctcgactctaggactgggtgaagaggatgtttgccaagagcatggtgaaaagatttacttcttctgcgaggatgacgagatgcagctgtgtgtcgtgtgtcgggaggcaggggaacacgcaacacataccatgagattcctggaggatgccgcagccccttaccgggaacagatccataaatgcttgaaatgtctacgcaaggaaagggaggagattcaagagatccagtccagagagaataaaagaatgcaagtcctgctcactcaggtgagcacaaaaaggcagcaggtgatctcagaattcgcccacctacggaagttcttggaagagcagcaatcaatcctgctggcccagttggaatctcaggatggagatattctgaggcagcgcgacgagtttgatctcctggtcgcaggcgagatttgccgcttctctgccctgatcgaagaactggaggaaaaaaacgagcggccagcaagagagctgcttactgatattcggtctacattaattaggtgtgaaacccggaagtgtcggaaacccgtcgccgtgtctcctgagttgggacagaggattcgggacttcccgcagcaggcattgcccctccagcgcgagatgaaaatgtttttggagaaactctgctttgaactggactatgagcccgctcacatttcgctcgatccacagacatcacaccccaagctgttgttgtctgaggaccatcagagagcccagttttcttataagtggcagaattcacccgataaccctcagcgctttgatcgagctacttgcgtgcttgcgcacaccggaatcacaggcggacggcatacctgggtttggatggccagggtgccaggcgattccggttgctgccagttctgttccccgccttccgtgctggggacagaagtggcagcctag

SEQ ID NO: 30507 - DNA, 624 bp, Artificial Sequence
  Description of Artificial Sequence: Synthetic coding sequence
atgaccgaagattctcagcggaatttccgtagcgtttactatgaaaaggtaggttttaggggtgttgaggagaaaaaaagtctggagatcctcctgaaggacgaccggctcggtattctgcccccacaccacgagtcccatgccaaggtgatgatgtataggaaagagcagtacctggatgtcctgcacgcgttgaaagtggttcgctttgtgtcagacgctactccacaggctgaagtctatctccgtatgtatcaattggaaagtgggaaactgccccgatctccttcttttccactcgagccagatgatgaggtgttcttggccatcgctaaggcgatggaggagatggttgaagacagcgtagattgctattggatcaccagacgatttgtgaaccagctgaatactaagtaccgcgatagcctcccccaattacccaaggctttcgagcagtacctcaatctcgaggatgggcgactccttacccaccttcggatgtgctcagccgctccaaagttaccatacgacctgtggtttaagaggtgtttcgccggatgcctgccggaaagttccttacagcgggtatgggataaagtggtgagtggctcttgcaagatttag

SEQ ID NO: 30508 - DNA, 1404 bp, Artificial Sequence
  Description of Artificial Sequence: Synthetic coding sequence
atggctagcttattgcagtctgaccgggtgctatatctcgtgcagggcgagaagaaggtccgcgcacccctgtcacagttgtacttctgtcggtactgctccgagctgcgctcactggaatgtgtgagccacgaggtcgactcccattattgtccgagctgcctcgagaacatgccctctgctgaggccaaattaaagaaaaatagatgcgctaattgcttcgactgccccggatgcatgcacactttgtccacacgagcaacaagcatatccacgcagctgcctgacgaccccgcaaaaaccacaatgaagaaggcttattatttggcttgcgggttctgcagatggacgagtcgcgacgtgggcatggcagataagagcgttgccagcggcggatggcaagagcccgaaaacccccatacacagaggatgaataagttaattgaatattaccagcagttagcccaaaaagagaaagtcgagagggacaggaagaaactcgcacgacgtagaaattatatgccactggcatttagccaacacacaatccacgtggtagacaagtacgggttaggaacaagactgcagcgaccacgagctggcgcttctatctccactttggctggtctgagcctgaaggagggagaagatcaaaaagagatcaagattgagccggctcaggctgttgacgaggtggagccccttccagaggactactacacccggccagtcaacctgactgaagtgaccaccctgcagcagagactgctacaacctgactttcagcctgtgtgtgccagtcaactgtatccgagacataaacatttgcttatcaaaaggtcacttagatgcaggaaatgtgaacataacctgtcaaagcccgaatttaaccccacaagcattaagtttaagatacagctcgtggcagtcaactatatccccgaagtacggataatgtcaatacccaacctgcgatacatgaaggagtcccaagtgctgctgactctgacgaaccctgtcgaaaacctcacacacgtaaccctctttgagtgtgaggagggtgatcctgatgatatcaacagtactgccaaggtggtcgtcccacctaaggaactagtcctggccggaaaggacgctgccgcagagtacgacgaactggctgaaccgcaggacttccaagatgaccctgacatcatcgcctttcggaaagccaacaaggttggtatctttataaaggtgacgccccaaagggaagagggagaggttactgtgtgtttcaaaatgaaacacgactttaagaacctcgctgccccaatcaggccaattgaggagagcgaccagggaacggaggtgatatggttgactcagcatgtcgaactgagcctcggaccactgctgccttag

SEQ ID NO: 30509 - DNA, 435 bp, Artificial Sequence
  Description of Artificial Sequence: Synthetic coding sequence
gtcagggagctggaggccgagcttgacgcggaacaaaagaaacatgccgaagccctgaaaggcgtgaggaagcacgagaggagggtaaaggagttagcatatcaagcagaggaggatagaaagaatctcgccaggatgcaagatcttgtcgacaaactccaatcaaaggtcaagtcatacaaacgacagtttgaagaggctgtgtcagctctcgggccaggacacctggatcgcgcaccccagttgtgtcctagagtatgcgggcaggagcagcaagcgaataccaacttggcgaagtatcggaaagcccagcacgaactggacgacgccgaagagagagccgatatggcagagacacaggccaataaactgagggctagaacccgggatgcgctgggaccaaaattgtcactgtctcctcagcataaggagtag

SEQ ID NO: 30510 - DNA, 747 bp, Artificial Sequence
  Description of Artificial Sequence: Synthetic coding sequence
atggcaacttccgccccactgagatcccttgaagaagaggtcacatgctctatctgtctcgactacctgcgggatcctgtaaccatcgactgtggacacgtattctgccggagctgtacaactgacgtacgaccaatctccggttcccgacctgtgtgtccactctgtaagaagcctttcaagaaggaaaatataagacccgtgtggcagctcgcctctctggtggagaatattgaacggctcaaagtggacaaaggcagacagccaggcgaggttacaagggagcaacaggacgcgaagctttgcgagaggcaccgcgagaagctgcactactactgcgaagacgatggcaagttactgtgcgtgatgtgtcgcgaaagccgggagcaccgcccacatacggcggttttaatggagaaagctgcacagcctcatagggaaaaaatacttaatcatctgagtactctcaggagagacagggataaaatccaggggtttcaggccaagggtgaggccgacatcctggcagcgttgaagaaactacaggatcagaggcagtatattgttgcagagtttgaacagggccaccagttcctgcgtgaaagagaagagcacctgctggagcagttggcaaagcttgaacaggaactcaccgaaggtcgggagaagtttaagagccggggtgtcggggagctcgctcgattggccctcgtgattagtgagctggaggggaaggcacaacagtag

SEQ ID NO: 30511 - DNA, 3468 bp, Artificial Sequence
  Description of Artificial Sequence: Synthetic coding sequence
atggcagcaagtcgcgatctgctcaaagaatttcctcaacccaagaatttgttaaactccgtgataggccgtgctcttggcatctcacacgcaaaggacaagctggtgtatgtacatactaatggcccaaagaaaaaaaaggttactctgcacatcaagtggccgaaatctgttgaggtagagggttacggatccaagaagatcgacgcggagcgccaggctgcagccgctgcctgtcagctgttcaaagggtgggggctgcttggtcctcggaatgagctgttcgatgcagctaaatacagggtcctggcggatcgctttggctcgccagccgattcttggtggagacccgaaccaacgatgcccccaacttcttggcgtcaactcaatcctgaaagtattcgcccaggcggacccggaggactgtcaaggtcacttggcagagaagaggaggaagatgaagaggaggagctagaagaaggcacaattgatgttacagactttttgtccatgacccagcaggactctcacgccccactgagagattcaagggggagctcatttgaaatgactgacgacgattcagctattagggcactcacccagtttcccctgcctaagaacctgttagctaaagtgatccagatagcaacatcgagcagcaccgctaagaatctgatgcagtttcacacagtgggcacaaaaaccaagctgagtaccttgactctgctttggccctgtcctatgaccttcgttgcaaaaggccgtcgcaaagcagaagctgaaaacaaggcggcagctcttgcctgtaaaaaattgaagtccctcgggttggtcgatcggaacaacgaaccactgacacatgccatgtataacttagccagcctgcgcgaactgggcgagacacagagaaggccctgtactatccaggtcccagagccgattctccgtaagattgagacatttttgaaccactatccggtcgagtccagctggatcgccccagagctgcgactccaatctgatgacatcctgcctctgggcaaagattcaggcccactgagtgacccaatcacgggcaagccgtacgtgcccctcctcgaggctgaagaggtaaggctcagccaatcactcctcgagctttggcgacgtcgcggtcctgtctggcaagaggcaccacagttgccggttgacccacatcgggatactatactgaacgccatcgaacaacatcctgtcgtggttataagcggagacacagggtgcggaaaaaccactcgcatacctcaactgctcctggagcgttatgttaccgaaggtcggggagcacggtgtaacgtgattattacccaaccccgtagaatctctgcagttagcgtggctcagagagttagccatgagcttggcccatctcttcgaaggaacgtgggctttcaggtgagactggagtcaaagccaccaagccggggtggagctttgcttttctgtactgtgggaattctcctgcgaaagctccagtctaacccctccttagagggcgtctcacatgttatcgttgacgaggtacacgaacgcgatgttaacacagacttcctgttgattcttctcaaaggcctgcaacggctcaaccctgcactgcgcttagtgctcatgtcagcgaccggagacaacgagaggttctctagatacttcggcggatgtccagttattaaagtgccaggctttatgtatcccgttaaagagcattatctggaagatatcctggccaaactggggaagcatcagtacttacataggcaccggcaccatgagtccgaggacgagtgcgctctcgatctcgatctggtgaccgatctggtgttgcatatcgacgcccgaggggagccaggaggaattctgtgcttcctccccggatggcaggaaatcaagggtgtccaacagcgcctgcaggaagcgctcggaatgcatgagtcgaagtacctgatcctgccagtgcattccaacattcccatgatggatcagaaagcaatcttccaacagccccctgttggtgtgcgaaaaattgtgctcgcgaccaacattgcagaaaccagcatcactattaacgacatcgtgcatgtggtggatagtggcctgcataaggaagaaagatacgacctgaaaacaaaagtcagttgtctggagactgtgtgggtctcacgggctaatgttatccaaaggcgaggacgggctggtagatgccagtccgggtttgcctatcatttattccctcgctcccgtctggagaagatggtaccattccaggtccccgagatcctgcgcactccactagaaaatctagtgctgcaagccaaaatacacatgccagaaaagaccgcggtcgagttcctgagcaaggccgtggacagcccaaatatcaaggcagtggacgaagctgtaatcctgctgcaggaaattggggtgctggaccagagggagtatctgacgacgctgggacagagactggctcacatctccacagacccaaggctggccaaggctatcgtcctggctgctatctttagatgtcttcaccctctgctggtagtggtgtcttgcctcacaagggatcccttctcatcaagccttcagaacagagccgaggtggataaggtcaaggctcttctgtctcacgactcaggttcagatcacctggcttttgtgagggctgtggccggatgggaggaggtgctgcgctggcaggatagaagcagtcgcgaaaactatctggaggaaaatctcctgtacgctccctcacttagattcatccacggattgatcaagcagtttagcgagaacatatatgaggccttcttggtgggcaagcctagcgactgcacgcttgcttcagcccagtgcaacgaatactctgaggaagaggagcttgtgaaaggcgtgctcatggctgggctctatcctaacctgattcaggtgagacaaggcaaggtgacacgccaagggaaattcaaacctaacagtgtcacctacagaaccaagagtgggaatatcctgctgcacaaatccaccatcaaccgagaggccacacggcttagaagtaggtggttgacctatttcatggccgtgaaatctaacggaagtgtctttgtgcgtgactcgagccaagttcatccgctagctgttctgctgctgaccgatggggatgtgcacatccgagatgatggtaggcgtgccactatttctctcagtgattccgaccttctgaggctggaaggtgatagtcgaacagtcagactgcttaaggagctacggagagcccttggtaggatggtggaacgatctctacggtcagagcttgctgcacttcccccatccgtccaggaagaacatgggcagctgctcgccctcttggcagaactgctgcgcggaccctgtggttccttcgatgtgcgaaaaaccgccgacgactag

SEQ ID NO: 30512 - DNA, 762 bp, Artificial Sequence
  Description of Artificial Sequence: Synthetic coding sequence
taggtcggggtcgaggcagctagggtaatcgcgaaggctctggagaaaaagtctgagctgaagcggtgccattggtctgatatgtttacagggaggctgcgtacggaaatcccccctgccctgatctcactaggagaagggcttattaccgctggggctcagctggtggaactggatctgtcagacaacgcctttggacctgacggagtccaaggattcgaagccctgttaaagagctcagcttgttttactcttcaggaactgaagcttaataactgcggaatggggatcggaggcggtaaggtgatcgggaccctggaagaagtgcatatgccccaaaatggaataaatcaccccggaatcacggccctcgcccaggccttcgccgttaaccccttgcttagagtgataaatctgaacgataacacattcaccgaaaaaggagccgtagcaatggccgagactctgaagactttgcgccaggtggaggtgatcaatttcggtgactgccttgtgaggagtaagggagcggtggctatcgcagacgctatccgcggaggtctgccaaagctcaaggagctgaatctgtccttttgcgagataaagcgcgacgctgctcttgctgtcgccgaggctatggctgacaaggccgagctggaaaagttggacctcaatgggaacacactgggcgaggaaggctgcgaacagctccaggaggtcctcgagggtttcaacatggcaaaagtactcgctagcctttag

SEQ ID NO: 30513 - DNA, 3735 bp, Artificial Sequence
  Description of Artificial Sequence: Synthetic coding sequence
gacgtgggcggagataggccttgggactcgggcaacacccagctgccacctcgaaaccccgtaaaggctaacgcgatgttcggcgctggcgacgaagatgataccgacttcctgtcccctagcggaggagctagactggctagcctcttcggtcttgaccaggctgcagctggccatggaaatgagttttttcaatacaccgcgcctaaacagcccaagaaaggacagggcaccgcggctactgggaatcaggcaactccgaagaccgcaccagccacaatgagcacccccactattttagtggcaaccgcggttcacgcctatcggtacactaatgggcagtacgtgaaacaggggaagtttggggctgccgtcctcggcaatcacacagctagggagtatcggattctactgtatatctcacagcaacaaccagtgaccgtggctagaatccatgtcaactttgaattaatggtgaggccaaataactactctactttctacgacgaccagcgtcagaattggagcattatgttcgaatctgagaaagcggctgtggaatttaacaagcaagtctgcatcgctaagtgtaattcaacctcatctctggatgcagtactatcacaggacctcattgttgctgatgggccagccgttgaggttggtgactcgctggaagtcgcatacacaggatggctttttcagaaccacgtgctggggcaagtgtttgacagcactgccaataaagacaaattgctgagactgaagctggggtctgggaaggtgataaagggttgggaagatggcatgctgggaatgaaaaagggaggtaagaggctactcatagtaccccctgcatgcgcagtgggcagcgaaggcgtgatcggatggactcaggccaccgacagtatcctcgtgttcgaagttgaggttaggagggtgaagtttgctagggatagcggctcagatggtcactcagtttcaagtcgggacagcgctgccccatccccaatccccggtgccgataacctctctgctgatccggttgtgtctcctccaacgtcgatccccttcaagagcggcgaacctgctctgcgcaccaaatctaactcactgtccgaacagttggctatcaacacttcaccagatgcagtcaaggcaaagctgatcagtcgtatggctaagatgggccagccgatgttacccatcctgccaccccagctggatagtaatgactcggagatcgaggacgtgaacacactccagggcggaggacagccggtggtgaccccctccgtgcagcccagcctgcatcccgcacaccccgctctgccacagatgacttctcaggccccacagccaagcgttactggacttcaggcacccagcgcggcattgatgcaggtgtcttctctggactcacacagtgctgtttcaggcaacgctcagagctttcagccatatgctggaatgcaagcttatgcctacccccaggcatcagctgtcacttcccaactccaaccggtgcgtcccctatacccagcaccacttagccagccgccacacttccagggctccggcgatatggcgtctttccttatgaccgaagcacgacagcacaacacggagattcgcatggccgtgagcaaggtcgccgacaaaatggatcacctgatgaccaaggtcgaagaactacagaaacacagcgccggtaatagcatgctgatcccaagcatgtcagttacaatggagacctcaatgatcatgtcaaacattcagcgtatcatccaggagaacgagcgattgaaacaggagatccttgagaagtccaacagaattgaggagcaaaacgacaagatttcagagctgatagagaggaaccagcggtatgtcgagcagtccaatttgatgatggaaaagcggaacaacagcctacagaccgctacagaaaatacacaagccagagtgcttcacgctgagcaggaaaaggcgaaggtcaccgaagaactagcagcagccactgctcaggtatcccacctccagcttaagatgactgcgcaccagaagaaagagactgagctccaaatgcagttgacagaaagtcttaaggaaacagacctgttgagaggacaattgaccaaggttcaggcaaagctgagcgaattgcaagaaaccagtgaacaggctcagtccaaatttaagagtgagaagcagaaccgtaaacaacttgaactcaaggtcacctctctcgaagaagaattgactgatttgcgggtcgaaaaagagagcttagagaagaacctgagtgagagaaaaaagaagtccgcccaagaaagaagtcaggctgaagaggagatcgatgaaatacggaaaagctaccaggaagagctagataagctgagacagctgctgaagaagacaagagtttccaccgatcaagcggctgctgaacagcttagtctggtccaggctgaactccagacccagtgggaagccaaatgtgagcatctgttggctagcgcaaaggatgaacatctgcagcaatatcaagaagtttgtgcccagcgggacgcctaccaacagaagctggtgcagttgcaggagaagtgccttgctctccaggcacagatcacagcgctaactaagcagaatgagcagcatattaaggagctggagaagaacaaaagccagatgagcggagttgaagcagcagcttcagaccccagcgagaaagtgaaaaaaattatgaaccaagtatttcagagcctccgtcgcgaatttgaactcgaagagagttacaacgggaggaccatcttggggacaatcatgaacacaattaagatggtcactctgcaactcctgaatcaacaggagcaagagaaggaagagtcaagttctgaagaggaggaggagaaagctgaagagcggccacgcaggcccagccaggagcagagcgcctccgcttcatcaggccagcctcaggcccctttaaatcgagaaagacctgagtctccaatggtgccctctgagcaggtggtcgaagaagccgttccactgcccccacaggccctgactacgtcgcaggacggccacagacgcaagggagactccgaggctgaagccctcagtgagataaaagatggctctctgcctcctgaattatcctgcataccgagtcacagggtgttggggcctccgaccagcattccccctgagccacttggacctgtaagcatggattcagaatgcgaggagtctctagctgcatcacctatggcggcaaaacctgacaatccttccggaaaagtttgcgtgagagaggtagctccagatggcccactccaagagtcatcaacacgtctctcccttacctccgacccagaggaaggagaccctctggccctggggcctgaatcccccggagagccacagccccctcagttgaagaaagacgacgtcactagctcaacaggtcctcacaaagagctgagtagcactgaagccggtagcaccgttgctggagccgcactacggccatctcaccatagtcagcgaagttctttgtcaggagacgaagaagatgaacttttcaagggtgctacacttaaggcactacggcctaaggcccagcctgaagaggaggatgaggacgaagtgtcgatgaaagggcgtcccccaccgacacctttattcggagatgacgacgatgatgatgatatagactggctcgggtag

SEQ ID NO: 30514 - DNA, 1653 bp, Artificial Sequence
  Description of Artificial Sequence: Synthetic coding sequence
atgaagtgggaagagtacgaagaactgctgcattatgcaatagtcacccctaacatcgaaccatgtgccagccagtcttctcaccccaagggggaacttgtgccagatgtgcgtatatccactatccacgacatactccacagtcagggcaacaatagcgaggttcgggagacagcgattgaagtggggaaggggtgcgatttccacatctccagccatagtaaaactgacgaatcatctccagtcctttcccctcgcaagccttcacaccccgtcatggattttttttcaagccacttactcgcggactcatcgtcgcctgctacaaattcaagccatacagacgcacatgagatcctggttagcgatttcctggtgtccgatgagaacctgcagaaaatggaaaatgtactcgacctatggtctagtggattgaaaacgaacataatcagcgagctgtctaaatggcgactgaactttattgactggcaccgcatggagatgaggaaagaaaaagagaagcatgctgcccacctcaaacaactctgcaaccaaataaacgagttaaaggagctgcagaagaccttcgaaatatccatcggccgtaaagatgaagtcatcagctctctgtcccacgctatcgggaaacagaaggaaaagatcgaactcatgaggacgttctttcattggcggatcgggcacgtgagggcacgtcaggacgtgtacgaaggcaaactggccgaccaatactatcagaggaccttactgaagaaagtctggaaagtttggcggagcgttgtccaaaaacaatggaaagatgtcgtcgagcgagcctgtcaggcaagagcggaggaggtatgtattcagatctcaaacgattatgaggcaaaagtcgccatgctctcaggcgctctggaaaacgccaaagcagaaatccagcggatgcagcatgaaaaagagcatttcgaagattcaatgaaaaaggccttcatgcgcggagtgtgtgccctgaatcttgaggctatgaccatcttccagaatcgaaacgatgctggcatagacagcaccaacaataagaaagaggagtacggcccaggagtccaagggaaagagcattcagctcacctcgacccctcagccccacctatgccactgcctgtcactagtcctttgcttcccagtcctcctgctgcagtaggtggcgcttcagccactgccgtgccgtccgccgctagtatgacgtcaactcgggctgcttctgcttcttcagtgcatgtccctgtcagcgcacttggcgctggatcagctgccaccgccgctagcgaagaaatgtatgttccaagggttgtgacgtcagcccagcagaaggccggtcggacgattacagctcgaataacaggcaggtgtgatttcgccagtaaaaatagaattagtagcagccttgcaattatgggcgtgagccccccaatgtcctccgtggtcgttgaaaaacaccatcccgtaaccgtgcaaacaattccccaagccacagccgctaagtatccaaggactatccaccccgagtccagtaccagcgccagccggagcttaggaacaaggtcagctcacacgcaatcacttaccagtgtgcactcaatcaaggtggttgattag

SEQ ID NO: 30515 - DNA, 402 bp, Artificial Sequence
  Description of Artificial Sequence: Synthetic coding sequence
atgtctccaagccagatgatcatgcccaacgtcatggagatgatagcagccctggggccaggaccaagcccttacccactgccccctccacctggagggacgaactcaaacgactattcctcccagggtaacaattatcagggccacggtaatttcgacttcccccatgggaaccccggtggcacctcaatgaacgacttcatgcacgggccaccacaactgagccatcctccagacatgccaaataacatggctgcactagagaagcctctgagtcatccaatgcaagaaacactgcttccagagttaacaaatcccgacgaactgctgagctacctcgacccacccgacctgccgtccaattcaaacgatgacctgctatccctgttcgaaaacaattag

SEQ ID NO: 30516 - DNA, 1473 bp, Artificial Sequence
  Description of Artificial Sequence: Synthetic coding sequence
atgtcaagctgtgtaagctcccaaccttccagcaaccgagccgctcctcaggatgagctgggtgggagaggcagctcatcctccgaaagccagaagccatgcgaggcgctcagggggctgtcatcattgtctatacatctgggaatggagtccttcatcgtggtgacagaatgtgaaccaggctgcgcagtggaccttgggctggcacgtgacagacctctggaggctgacgggcaggaagtcccactggacacaagcggcagccaagcacggcctcacctgagtggcagaaaactgtcattacaagaaaggagccagggcggactcgccgcaggaggttcactggatatgaatggtcgttgcatctgtccatcgttgccctattcacctgtgtcgagtcctcagtcctcccctaggctccctcggaggccaactgtggagagtcaccatgtgtcaattactggcatgcaggattgcgtacagttgaaccagtatactttgaaggatgagattggcaagggaagttatggtgtggtgaagcttgcctacaacgagaatgacaatacttactatgctatgaaggtactgagtaagaaaaaacttattcgacaggcaggcttccctcgcaggcctcctccacgaggcacccgccctgccccaggtggttgtatccaaccaagagggcctatcgagcaggtctatcaggagatcgcaatactcaagaaactggatcaccctaatgtggtgaaactggtagaagtgctggacgatcctaatgaggatcacctctacatggtcttcgaattggttaatcagggcccagtcatggaggttcccacactcaagccattgtcggaagatcaagcccgattctacttccaggacctgattaaggggatcgagtacctgcattaccagaaaattatccacagggacatcaagccaagtaacttgcttgtgggagaagacgggcacatcaaaatcgctgactttggtgtcagcaatgagtttaagggttctgacgccctgttgagcaatactgttgggaccccggctttcatggcgccagagtccttatccgaaactaggaaaatcttctccggaaaggcactcgacgtttgggcgatgggagtgaccctgtactgtttcgtatttggccagtgtcccttcatggacgaacggatcatgtgccttcactccaaaattaaaagtcaggcactcgagttcccagaccaacccgatattgcagaagacctcaaagatctgatcacaagaatgttagacaagaatcctgagagtcggatcgtggtgcccgagatcaagatactggtgaagaccatgatcagaaaaagaagctttggcaatccattcgaaggtagccgtagggaagaaaggagtcttagtgcgccaggcaatctgctaacgaaaaagccgactagggagtgtgagtcactgtcagaactgaagacttag

SEQ ID NO: 30517 - DNA, 1872 bp, Artificial Sequence
  Description of Artificial Sequence: Synthetic coding sequence
atggccgctgctactggcgatccaggactgtccaaacttcaattcgcacctttctcttctgccctggatgttggattctggcacgagctgacccaaaaaaagctcaacgaataccgcttagatgaggcgccaaaggatattaaagggtattactataatggcgattcagccggactgcccgcacgcctgacattggagttctcagcatttgatatgtctgcacccactcccgcacgatgctgtccagccatcggcacactctacaataccaatactctcgagagttttaagactgctgacaagaagctgttgcttgaacaggccgctaatgaaatctgggaaagtatcaagtcaggtaccgcattggaaaacccagtgttattgaataaatttttgcttctgaccttcgcgatcgaggccctggagtgtgcttacgacaatctatgtcaaacagagggtgtaacagcactgccctattttctaatcaagtacgatgagaatatggtgctggtttccctgctgaaacactattcagattttttccaaggacagcgcaccaaaatcactattggggtatatgacccatgtaacctggcccagtatcctggatggcctctgcgcaactttctcgttctggccgcacaccgctggagttcttccttccaatcggtggaggtggtgtgctttcgggaccgcacaatgcagggcgcaagggatgtcgcccatagcattatcttcgaggtgaagttaccagaaatggccttttcccccgattgccctaaagcagtcggctgggaaaagaaccagaaggggggaatgggtccaagaatggtcaacctctcggagtgcatggatcccaagcgcttagccgaaagttctgtcgaccttaaccttaagctgatgtgttggaggctggtccccacgttggatctcgacaaagtcgtgagcgtgaagtgtttgttgctgggcgctggtactcttggatgcaacgtggctagaacgctcatgggatggggtgtcagacacattacttttgtcgacaatgctaaaatcagctattcaaatcccgtgcgacagcctctgtacgaattcgaggactgtctgggagggggtaaaccaaaagcgttagccgctgcggatcggcttcagaagattttccctggtgtcaatgccagagggtttaacatgtcaattcccatgccagggcaccctgtgaatttctcatctgtgactcttgagcaagccaggagggatgtcgaacagctggagcagctgatcgagagccacgacgtggtgtttctgttgatggacactcgggagtccaggtggctgcccgctgtgatagcagccagtaagaggaagctggttataaatgccgcattgggtttcgacacatttgtcgtgatgagacacggcctcaagaagcctaaacagcagggggcaggagacctctgccctaaccatcctgtggcatctgctgatttgttgggaagctctcttttcgcaaacattccaggatacaagcttggctgttatttctgcaatgatgtagtggcacctggcgactcaacgagggaccggaccctggatcaacagtgtactgtaagccggccaggcctggccgttatcgccggtgcactggccgttgagctcatggtgtctgtgctccagcatccagagggaggctatgcgatcgcatcaagtagtgacgatcgaatgaatgaacccccaacctccctgggccttgtgccccaccaaatacgagggttcctctctcgattcgataacgtcctgcccgtttccctggcctttgacaagtgcactgcctgcagctccaaaatctgggacatgtcagacgatgagacaatatag

SEQ ID NO: 30518 - DNA, 966 bp, Artificial Sequence
  Description of Artificial Sequence: Synthetic coding sequence
cggaggaatgtggagttaatcaacgaggaggccgcaatgttcgacagtctgttaatggattcctatgtgtcttccactacgggcgagtcagtgattacccgggaaatggtggaaatgctgttttccgatgactcagatctgcagctggcaacaactcaaaaatttcgcaagttgctctctaaggaaccatcccctccaatagacgaggtcattaatacgcctagagtcgttgatcggttcgtcgagtttctcaaaaggaacgagaactgtacccttcaagccgtatgggcactcgggaacattgccggtgactcttcggtctgtcgcgactatgttttgaactgctctattttgaacccactgctcacgcttctgacaaagtccaccagactgactatgacacgcaatgccgtctgggccttgagcaatctgtgtcgcggaaagaatccccctcccgagttcgccaaggtcagtccctgcctccccgtactgagccggctactgttctcttctgatagcgatttgctggccgatgcctgttgggctttgagttacctgagcgacgggcctaacgaaaaaatacaggcagtcattgatagtggagtgtgtagacgtctggtggagttattaatgcacaacgactacaaagtggcctccccagcattacgcgcagtgggaaacatagtgacaggggacgatattcagactcaggtcatcctgaattgcagcgctctcccatgcctgcttcacctcctgtcttcccccaaagagtccataaggaaggaggcatgttggactattagcaacattactgctggcaatagggcccagatccaagctgtcattgatgctaatatctttccggtgctcatcgagatcctgcagaaggccgaatttcgcacaagaaaggaggctgcctgggctattactaacgccaccagcggtgggacacccgaacagatatag

SEQ ID NO: 30519 - DNA, 795 bp, Artificial Sequence
  Description of Artificial Sequence: Synthetic coding sequence
atgggcggagctcagttagaactgccaagcggtgcaagacccggagtgtgtgtgaggagaagcttccgggcacacgctggggatcagcctcggagacctcctggccctattcccgtgccgggaactatgaaacaggaaagcgctgcccctaacaccccccctacgagccagtcaccaaccccttctgctcagttcccccgtaatgatggagatccccaggcactttggattttcgggtacggatctttggtctggcgcccagatttcgcttattcagatagccgtgtggggttcgtccgcggatattcaagaagattctggcagggtgacacgttccacagaggttcagacaagatgcccggacgagtcgtgactcttctggaagatcacgagggttgtacgtggggggtggcgtaccaagtccagggagagcaagttagtaaggcactcaagtatctgaacgtgagggaggctgtgctcggaggatatgatactaaggaggttaccttttatcctcaggatgctcctgatcaaccactgaaagcccttgcatacgtcgcgacacctcagaaccccggataccttggacccgctcctgaagaggccattgcaactcaaatcctggcatgccggggtttctcaggacacaacctggagtatctactgcggctcgcggactttatgcaattgtgcggccctcaggctcaggatgagcatctggctgcgattgttgatgctgttggtactatgctgccgtgcttctgccctacagaacaggccctagccttagtgtag

SEQ ID NO: 30520 - DNA, 747 bp, Artificial Sequence
  Description of Artificial Sequence: Synthetic coding sequence
atggcgacgagcgcccctctgcgatccctcgaggaggaggtgacgtgtagcatctgtctggattacctgcgggacccagttaccatcgattgcggccacgtattctgtcgaagctgtactactgacgtccgcccaattagtggttctcgccctgtttgcccgctttgcaaaaaacctttcaaaaaagaaaatatcaggccggtatggcaactggcaagtctggttgagaatatcgagcggttgaaggtggacaaaggtcggcaacccggagaagtgactagggagcagcaggatgcaaaactctgcgagaggcacagggagaagctacactactactgtgaagacgatgggaaactcctctgtgtaatgtgccgagaaagccgggagcataggcctcacacagctgtgttaatggagaaggctgcacagccccatcgggagaagatcttgaaccacttaagtactctacggagagatagggacaaaatccaaggctttcaggctaagggagaggccgacatcctggctgctctgaaaaaactgcaggatcaacgtcaatatatagtcgccgagttcgagcagggacatcaatttctgcgcgaaagagaagagcatctgcttgagcagttggccaaactggagcaggaactaacagaaggacgcgagaagttcaaaagccgcggtgtaggagagctggccagactcgcactggttattagcgagctggaaggcaaggcacagcaatag

SEQ ID NO: 30521 - DNA, 768 bp, Artificial Sequence
  Description of Artificial Sequence: Synthetic coding sequence
atgagcagctctatgtggtacatcatgcagtcgatccaaagcaaatacagtcttagcgagcggctgattcgaacaatagccgcaatccggagctttccacacgacaacgttgaagatctgattaggggtggggcagacgtcaactgtacccacggaactcttaagccgcttcattgcgcatgcatggtgagtgacgccgattgcgtcgaactcctcctcgagaagggtgcagaagtgaatgcactggatggctataatcggaccgcgctccattacgccgctgagaaggacgaggcctgcgtggaagtgctgctcgaatatggcgctaatcctaacgctctggactacaataatgacacacctctgtcttgggccgcaatgaaagggaatctggaatcagtgtccatcttgcttgattacggggctgaagtgagagttatcaatctcatcgggcagacgcctattagcagactggttgccctactggtccgcggtctaggcacggaaaaagaagatagttgcttcgaactcctgcaccgagcggtggggcatttcgaactgaggaagaatggaaccatgcccagagaggtggctcgcgaccctcagctgtgtgaaaaattaacagtgctgtgcagcgcgccagggacactgaagacattagctagatatgctgtaagacggtctctcgggttgcagtacttacctgatgctgtcaaagggctacctctgcctgctagcctaaaagagtatctgttgctactggagtag

SEQ ID NO: 30522 - DNA, 585 bp, Artificial Sequence
  Description of Artificial Sequence: Synthetic coding sequence
gaacccgttcaacctcactggttctattgtaaagaggtcgaatataaacagctatggatgccattttccgtattcgattccctcaacctagaagaaatatacaactctgtgcagccggatcccgaatcggtcgtgctcggtaccgacggagggaggtacgatgtatatttatacgacaggatcaggaaggccgcttactgggaggaggaacccgctgaggtccgcagatgtacctggttttataaaggcgatacagactctcgatttattccttacactgaggagttcagcgaaaagcttgaggttatcgtgcagttccaaccgtctagtgtaccagacgaatgggggaccacacaggatggccagacccgccctagggtggtgaagcgcggaatcgacgataacctggacgaaataccggacggagagatgccgcaggtcgaccatttagtgtttgtggttcatgggattgggcctgtctgtgatcttagatttcgtagcataatagagtgtgtggatgatttcagagtagtgtctcttaagctcctcaggactcattttaaaaagtcactggacgatggctag

SEQ ID NO: 30523 - DNA, 981 bp, Artificial Sequence
  Description of Artificial Sequence: Synthetic coding sequence
atgccgcacctaccattggcctcttttagacctccattttggggcctgaggcactcaagaggcctgccacggtttcatagcgtcagtacccagagtgagcctcatgggtctcctattagccggcgtaatagggaagccaagcagaagcggctgagagaaaagcaggccacgctcgaagcagaaatcgcaggcgagagtaagtcaccagccgaaagcataaaagcctggcgcccaaaagagttagtcttgtatgaaatccctactaagcccggtgaaaagaaggacgtgagcggacctctgcccccagcttacagtccaaggtatgtcgaagccgcatggtacccctggtgggtgagagagggctttttcaaaccagaataccaagctcggctaccacaggctacaggcgagacattttcaatgtgtattccaccccctaatgtgacagggtcactgcacatcgggcacgcactgacagttgccattcaggatgctttagttcgctggcacaggatgagaggagaccaggtcctctgggtgccaggatctgaccatgcgggaatagccacgcaagccgtcgtggagaaacagctgtggaaggaaagaggcgtgcgcaggcacgagctgagtcgtgaagcattcctgcgcgaggtgtggcagtggaaagaggctaaaggcggagagatctgtgaacagctgagggcccttggagccagtctagactgggatagggagtgttttactatggatgtgggatcaagtgtggccgtcaccgaagcctttgtgaggctttacaaggcaggactcttatatagaaatcaccagctggtaaattggtcttgtgcccttagaagtgccatttccgacatcgaggtcgaaaacaggccgttacccggacatacacagttaagactaccaggatgtcctacccctgtgtcattcggactccttttctcggttgcattccctgtggatgggtag

SEQ ID NO: 30524 - DNA, 990 bp, Artificial Sequence
  Description of Artificial Sequence: Synthetic coding sequence
atggcaggcgctctggagggagatatctttattgggccaaaagccgaagaacaccgtggcctgctgagtatacgttacccgatggagcacggcatcgtcaaagactggaatgacatggaaaggatctggcagtacgtgtattctaaagaccagctgcagacattttcagaagagcatcctgtgctcctaacggaggcgccactcaaccctcgaaagaatagggagcgcgctgcagaagtgttcttcgagaccttcaatgtacccgctctcttcatctccatgcaagccgtgctgagcctgtacgctactggacgcactaccggcgtagtgcttgatagcggagacggggtgacacacgctgttcctatttatgaaggcttcgcaatgccacactccatcatgcgcatagacatcgccggaagagacgtgtccagatttcttagactctacttgcggaaggagggctatgattttcatagctcctctgaatttgagatcgtaaaagccatcaaggagagagcatgctacttgagtattaacccgcagaaggatgaaaccctcgaaacagagaaggctcagtactatttaccggatggaagcactattgaaatcgggcctagccgttttcgggctcccgagctcctattccgcccagatttaatcggcgaagagtcagaaggcatccacgaagttctggtgtttgcaatccagaaatcagacatggacctgcgcaggacactgttctccaatattgtcttatctggcggaagcaccctgttcaaaggcttcggcgacaggttattaagtgaggtcaaaaagttggcccctaaagacgtgaagatcaggatttccgctcctcaagaacggctctacagcacctggattggaggttcaatcctggcgtcattggacacgttcaagaagatgtgggtttctaagaaagaatatgaggaggatggagcaaggtccatccaccgtaagaccttctag

SEQ ID NO: 30525 - DNA, 450 bp, Artificial Sequence
  Description of Artificial Sequence: Synthetic coding sequence
atggaaaagaccgagcttatccaaaaggccaagttagctgagcaggctgaaagatacgatgatatggccacatgtatgaaggccgttacagagcagggggctgaactaagcaacgaagaaaggaacctcctgtcggttgcttataaaaacgtggtgggcggtaggcgttccgcatggcgtgttatctcatccatcgagcaaaagacggacacttctgacaagaagctgcagctgatcaaagattacagagagaaggttgaatccgaactaaggtcaatctgtactacggttcttgagctgctcgataaatatctgatcgccaacgccaccaaccccgagtccaaagttttctatcttaagatgaaaggagattacttcagatatctcgccgaggtggcctgcggagatgatcgtaagcagacaatcgacaacagccagggagcttattag

SEQ ID NO: 30526 - DNA, 735 bp, Artificial Sequence
  Description of Artificial Sequence: Synthetic coding sequence
atgctgagcgatcggaagagagagcttgaacatcgcttgtctgcgaccttggaggaaaacgatctgctgcaagggacagtggaggagctgcaggaccgcgttctaatcctagagcgtcaggggcacgacaaggacctgcaactccatcagagccagctcgagttacaggaagtgaggcttagctgccgccagcttcaggtgaaagttgaagagctgacagaagagagatccctccagtcgtctgccgcaactagcacttcactgttatccgaaatcgaacagtctatggaggcagaggagctggaacaagagcgagagcaggttactctgctgagtgtggagatgacagctctgaaggaggagagagataggttgagggtgacgtctgaggacaaggagccgaaagagcagttgcagaaggcaattcgggatcgggacgaggccattgccaaaaagaacgccgtcgagctcgagctcgccaaatgcaggatggatatgatgagccttaactcgcagcttctggacgcaattcaacagaaattgaacttatcacagcaattggaggcctggcaggacgatatgcacagagttattgacaggcagctgatggacacgcatcttaaggaaagatcacagcccgcagcagccctttgccgcggacacagcgcaggaaggggcgacgaacctagcattgcggagggcaagcgtctatttagcttcttcagaaagatttag

SEQ ID NO: 30527 - DNA, 603 bp, Artificial Sequence
  Description of Artificial Sequence: Synthetic coding sequence
tagcatatgctgtcaaaggtaggcatgtgggatttcgatatttttctgtttgacaggctgactaacggaaattctctcgtgacactcttatgccacctctttaatacccatggcttaattcatcatttcaagctagatatggtcaccctgcaccgtttcttggtcatggttcaggaagactatcactcccagaatccctaccacaacgctgttcacgccgcagacgtcactcaggctatgcactgttatctgaaggagccaaaactcgcatcgtttctaaccccccttgatatcatgctgggcctactggcagcagctgcacatgatgtcgaccatcctggagtgaatcagccttttctgatcaaaacaaatcatcatctcgcaaatctgtatcaggttcgtgagccaaatctcgaacctgctactgtttggagcatcgccttggggccagtccttaaaccagaaagctgtccctggcggaaaccctgcttccgcgttcttgaggttcagcgcagaatgaaacacaatttgtgtccccaaaagttcgtgcagacgcaaatgttaaaaatgagtaagatacaggccaacctcataccggtctag

SEQ ID NO: 30528 - DNA, 1728 bp, Artificial Sequence
  Description of Artificial Sequence: Synthetic coding sequence
atggccatggctccttcccctagcctggttcaagtatatacctctcctgccgcagtggctgtgtgggaatggcaggatggactgggcacctggcacccatatagtgccaccgtgtgtagttttattgagcagcagttcgtgcaacaaaagggccagagattcgggctcgggagcctagcacacagtatccccctggggcaggcggatccttcgttagccccatacataatcgatctaccttcatggacacagttcaggcaggataccggcaccatgcgtgctgtgcggagacatctctttccacagcactcagcacccggaagaggagtcgtttgggagtggctgagcgacgatggatcctggacagcctatgaggccagcgtgtgcgattaccttgagcagcaggtcgctaggggcaatcaactggtggatctggctccgctgggatacaattacactgtgaattatacaacgcacacccagactaacaaaaccagcagcttctgccggtccgtcagacgccaggccggtcccccttatcccgtgacaactatcatcgcccctccaggccatacaggagtggcgtgcagctgtcatcagtgcctctccggctcacggaccggacccgtttccggcagataccgccactctatgactaacctgcccgcttaccctgtccctcaacacccaccacaccgcacagcctcagtgttcggcactcaccaggcgtttgctccttacaacaaacccagcctgtcgggggcacgttccgccccaaggttgaatacaaccaatgcctggggagcggctcctccgtctctgggcagtcaaccactctaccgaagctcactgagccatctgggtccacagcatctccctcccggttcttctacaagcggcgctgtctctgcttccttgcccagtggcccatcttcttctcccggatccgtgcctgccactgttccaatgcagatgccaaagccctcccgcgtccagcaagcgctagctggagccactcctaaacccgaacctgaaccagagcaggtcataaaaaattataccgaggaacttaaggtgcctcccgatgaagactgtattatctgtatggaaaaactgagtaccgcaagtggttactctgacgtaaccgattcaaaggccattggatccctagctgtcggtcacctcacaaaatgctcccacgcattccatcttctgtgtcttcttgctatgtactgtaatgggaataaggacggttctttgcagtgtccttcttgcaagaccatatatggggagaaaacaggcacccaaccccagggcaaaatggaggtgttgaggtttcagatgagtctgccgggtcatgaggattgcggtaccatactcatcgtctattcaatacctcacggcatacagggtccagagcatcctaatcctggcaaaccttttacagcaagggggtttcccaggcagtgctacctgcctgataatgcccagggtcgaaaggtgctggagcttctaaaggtggcctggaaaagacggctgatatttacagtgggtacctcaagtacaaccggtgaaacggacacagtggtgtggaacgagattcatcacaagactgagatggaccgtaacattacaggacatggttaccccgatcccaattacctccagaatgttcttgcagagctcgccgctcaaggagttaccgaagactgcctcgagcagcaatag

SEQ ID NO: 30529 - DNA, 3036 bp, Artificial Sequence
  Description of Artificial Sequence: Synthetic coding sequence
atggtctcctcagatagaccagtgagcctcgaagatgaagtcagtcactcaatgaaggagatgatcggaggatgttgcgtgtgcagtgacgaacgaggctgggctgaaaacccactggtgtattgtgatgggcacggttgcagcgtggcagttcaccaagcttgttatgggatcgttcaggttcccactgggccttggttctgccggaagtgcgagtcacaggagagggcagcacgcgttcgctgcgagctttgtccgcacaaagacggagcactgaaacgcacagataacggcggatgggcgcacgtcgtctgtgccctgtatatccctgaggtgcagtttgcaaatgtgagcacaatggagcccatagttcttcaatcggtgccacatgaccgatataacaagacttgctatatctgcgacgagcaagggagagagtcaaaggccgctacaggtgcatgtatgacatgtaataagcatgggtgtcggcaggcctttcacgtaacttgcgcgcaattcgccggactgctgtgcgaggaggaaggcaacggagctgacaatgtacagtactgtggatactgtaagtatcactttagcaagctgaagaaaagcaagcgcggatctaataggtcatacgatcagagccttagcgactcctccagccactcccaggacaaacaccacgagaaggaaaaaaaaaaatataaggaaaaggataagcataagcagaaacacaaaaagcagcctgagccctctcccgctctggtgccatctctgaccgtaactaccgagaaaacatatacgtcaactagtaataactccatatcaggcagcctgaaaaggttagaagataccaccgcaaggttcactaatgccaactttcaggaggtatcagcacatacctcatctggtaaggatgtatcggagacaaggggttcagagggcaaaggaaagaagtcgtcagcacatagctcaggccagagaggtcggaaacctggtggaggacgcaatccaggtaccaccgttagcgctgcctcacctttccctcagggatccttctcagggacacccggatcagtaaagtcctcgagtggctctagcgtccagagcccacaggatttcctgagcttcacagacagcgacctcaggaatgacagttactcacattctcagcagtcatccgctacgaaagacgtgcataaaggcgagtccgggtctcaggaaggaggggtgaactctttttcaactctaatcgggctccctagtacttcagctgtaacaagccagccaaaaagctttgagaacagcccaggggacctggggaattcctcactgcctacagctggctacaagcgcgctcagactagcggaattgaagaagagacagtgaaggagaaaaaacggaaaggaaataagcagtcgaagcacggcccaggtcggccaaagggaaataagaatcaagagaatgtgtcacacctgtcagtctctagtgcatctcctacaagttcagtcgctagtgctgccggatctatcaccagtagtagcttacagaaatcacctactttgcttagaaacggcagtctgcagagtctgagcgtgggctcctcaccagttggctctgagattagcatgcagtaccgacatgacggagcctgccccaccactacattttccgaattgctgaatgccatccacaacggaatctataattctaatgatgtagccgtgtcctttcctaatgtagtgtccgggtccggctccagcacccccgtttcttctagtcatctcccccagcaatcttctggtcatctgcagcaggttggggcacttagtccctctgccgtttccagcgccgctcccgcagtggctacaacccaggctaacacactgagtggcagctcgctctctcaagctccaagtcacatgtacgggaacaggagtaacagctctatggctgcgctgatcgcgcagagcgagaacaatcagaccgaccaggatctgggcgataatagccggaatctcgttggcaggggctcttcacctcggggatcactttcccctcgctccccagtgtcatcgctgcagattcggtatgatcagcccggaaacagtagcctagagaaccttcctcccgtcgcagcttctatcgagcagctgctggaacgacagtggtctgagggccagcaattccttttagagcagggcaccccgtccgacatcttggggatgttgaagagcctgcaccagcttcaggttgagaatcgcagactcgaagaacaaataaagaaccttacagctaagaaggaacgcctgcagcttctcaacgcacagctgtctgtaccttttcccacaattactgccaacccatcaccatcccatcagatccataccttttctgcccagacagccccaaccaccgatagcctcaactcatccaagagcccccatattggcaactctttcctgcccgataattcacttccggtgctgaatcaggatctgactagttccggccagtctacctccagcagcagtgcactctctactcctccaccagccggtcagagtccagcccagcagggctctggggttagtggagtgcaacaggtgaatggcgtgacagtgggagccctggcctccgggatgcagcccgtaacttctacgattccggcagtctcagccgttggaggtatcataggcgctctgccgggtaaccagcttgcaattaacggcatcgttggtgccctgaacggcgtcatgcagacgcctgtgaccatgtctcagaatcctacccccctcacccataccactgttccccctaacgcgacgcacccaatgcctgccaccctcacaaattccgcctcgggcctgggtcttctgtcagaccagcagcgacagattctgatccatcagcagcagttccagcaactactgaactctcaacaactgacacccgtgcacagacacccacactttacccagctgccaccaacccacttctccccaagtatggagatcatgcaggtgcgcaagtag

SEQ ID NO: 30530 - DNA, 3786 bp, Artificial Sequence
  Description of Artificial Sequence: Synthetic coding sequence
atggccgctgccgctgcctcaggtgcgggaggagctgcgggagccggaactggaggagccggaccggctggacgcctcctaccccctcctgcccctggttcacccgcagcacctgctgcagtgagtcctgcggcagggcaaccaaggcctcccgcacccgcttctagaggtccaatgcccgctaggattgggtactatgagattgatcgcaccataggaaaagggaactttgccgtggtaaagcgcgctacgcacctggtaaccaaagcgaaggtcgcgataaagatcattgataagactcagctcgatgaggagaatctaaagaagatattcagagaggtccagatcatgaaaatgctttgtcaccctcacataatccggttgtaccaagtcatggagacagagcgaatgatctacctcgtgactgaatatgcatctggcggagagatattcgatcatctggtagctcacgggagaatggccgagaaggaggcaagacggaagttcaagcagattgtaacggctgtgtacttttgtcactgtaggaatattgtgcatcgggatctgaaggcagaaaacctgcttctggatgccaacctcaacatcaagatagctgattttgggttttccaacctgttcactcccggacagttgctgaaaacctggtgcggctcacccccatacgcggcaccagagctcttcgagggaaaagaatacgacggacccaaagtggacatctggtccctcggggtggtcctgtacgtacttgtgtgcggggctttgcccttcgacgggtccaccctgcagaacctacgtgcaagggtactgtccggcaaattcagaattcctttttttatgtcaactgagtgtgaacatctgattcgacatatgttagtgttagacccaaataagcgattatctatggagcaaatatgcaaacacaagtggatgaaactgggtgatgccgatcctaactttgatcgccttatcgcggagtgtcagcagctcaaggaggagcgccaagtcgatccacttaacgaagacgtgttgctggcgatggaggacatgggcctggacaaggaacagactttgcaagctgaacaggccggaacagcaatgaatatcagtgttccacaggttcagctgattaacccagagaaccaaatcgtcgaacctgatggaacactgaatctcgatagcgacgagggagaagagccaagccccgaggccctggtccggtatctgagtatgcggagacacacggtgggagtagccgacccaaggacggaggtgatggaggacctgcagaagctgctcccaggtttcccaggggtgaacccccaggctccctttttgcaagtggcccctaatgtgaatttcatgcataatcttcttcctatgcagaatctacagccaacaggacagctggagtataaggaacagagcctgctccaaccacctactttacagctgttgaatgggatggggcctctcggaagaagggcttccgacggcggagcgaacatccagttgcacgctcagcagctgcttaagcggcctaggggcccttcccccctggttaccatgacaccggctgttcctgccgtcacaccggtcgatgaggagtccagcgacggcgagccagatcaagaagccgtccaaagatacctcgctaatcgcagcaagcgccataccctcgcaatgacgaacccaactgcagagattcccccagatctgcagagacaacttgggcagcagcctttcaggagtagggtgtggcctcctcatctagtgcccgaccagcacaggtccacctataaggatagtaataccctgcatttacctaccgaaagattcagtcccgtgcgcaggtttagcgatggtgctgctagtatccaggcctttaaagcacacttagagaagatggggaataacagctcaataaagcagctacagcaagagtgcgagcagctgcaaaagatgtacggcggacagatcgacgaaaggactctagagaaaacacagcaacagcatatgctgtatcaacaggagcagcaccatcaaattctgcagcagcaaattcaagatagtatctgcccgccacagccctcccctccattacaggcagcatgcgagaatcagcccgctctgcttacccaccaactgcaacgactaagaattcaaccctccagtccaccacccaaccacccaaataatcatttgttccgtcagccctctaattctccgcctcctatgtcatcagctatgatccaaccacacggcgcagcctcaagctcacaattccagggacttcccagtcgatccgccattttccaacagcagcccgagaactgcagcagcccccctaatgtagcattaacctgtctggggatgcagcagcccgctcagtctcagcaggtgacaatccaggtgcaagaacctgtggatatgcttagtaacatgccgggtaccgccgctgggtcctccggcagaggtattagcatctccccatctgccggacagatgcagatgcagcacaggacaaatttgatggctactctgtcgtacggacaccggcctctttccaagcaactgagtgccgattcagccgaggcacattccgcccaccaacagcccccacactatacaacgtcagccctgcaacaagcactgcttagccccacaccacctgattacaccagacatcaacaggtcccgcacatattgcaaggactgctgagcccgagacacagcctgacaggccattctgatattagattgccaccgactgaatttgcccagttaattaaaaggcagcagcagcagcgacagcagcagcagcagcagcagcagcagcaagaatatcaagagttattccggcacatgaatcaaggcgatgctggttccctcgccccttcactgggcggtcagtccatgacggaaaggcaggccctttcctatcagaatgcagattcctaccaccaccacacctcccctcaacatctgctgcagattcgcgcacaggaatgtgtaagccaagccagttcccccactccccctcatggttatgcccaccagcccgctctgatgcacagcgagtcgatggaggaggactgtagttgtgagggagctaaagacggcttccaggatagcaaaagttcatccacactgactaaaggctgccacgattcccctctgttgctctcaactgggggacctggggatccagaatccttactcggaacagttagccatgcgcaggaactggggattcatccatacgggcaccagccaactgcggcttttagtaaaaacaaggtcccaagcagagaacccgttattgggaactgcatggataggtcaagccccggacaggcagtggagctgcctgaccacaacgggcttggatatccagcacgccctagcgttcacgagcatcacagaccacgcgctctgcagcggcaccataccatccagaactcagatgacgcttatgtacagttagacaatctccctgggatgtcccttgtcgccggaaaggccctgtcttccgccaggatgagcgacgcagtgttatcccaaagcagcttaatgggtagccaacaatttcaggatggcgagaatgaagaatgtggcgcttccctcgggggtcacgaacatccagatctgtcggacgggagtcagcacctaaactcatcatgttatcccagcacgtgcatcaccgatatcctcctgagctacaagcatcccgaggtctcctttagcatggagcaagcgggagtctag

SEQ ID NO: 30531 - DNA, 519 bp, Artificial Sequence
  Description of Artificial Sequence: Synthetic coding sequence
atgagctccaacgagtgctttaagtgtggtcggagtggtcactgggctagagagtgccctaccggaggaggtaggggacgtgggatgaggtcaagagggagaggatttcaattcgtttcttcctcattgcccgacatctgttacagatgcggagaatcaggtcacctggctaaagattgcgacctacaggaggacgtggaggcgtgctataattgcggacgaggaggacacatagcaaaagattgcaaggagccgaaaagagagagggaacaatgctgttacaactgtggcaagccaggacatctggcccgagactgcgatcatgcagacgagcaaaagtgctacagctgcggcgagttcggtcacatccagaaagattgtacaaaagttaaatgttaccgatgtggcgaaaccgggcatgtggctattaactgctcaaaaaccagcgaagtgaattgctatagatgcggagaatcaggccatctggccagagaatgtacaatcgaagccaccgcttag

SEQ ID NO: 30532 - DNA, 471 bp, Artificial Sequence
  Description of Artificial Sequence: Synthetic coding sequence
atgctagcggagaaactccccaacctcactcatcttaacctgtcggggaataagctgaaagatatctccactctagaacccctcaagaagttggagtgccttaagtctctggatctgtttaactgcgaggtcaccaatctaaatgactacagagaaagcgtgtttaagttgttgccccagcttacatacttggacggatacgatagagaagatcaggaggctcccgatagcgacgcagaggtcgacggagtggacgaggaggaggaagacgaagagggggaggacgaggaagacgaggatgacgaggatggagaggaagaggaattcgatgaggaggacgacgaagacgaagacgtcgagggcgatgaagacgacgacgaggtcagcgaagaagaggaagaattcggactggatgaagaggacgaggacgaggatgaggacgaggaggaagaagagggaggtaagggttag

SEQ ID NO: 30533 - DNA, 516 bp, Artificial Sequence
  Description of Artificial Sequence: Synthetic coding sequence
atgagcagtggcaatgctaagataggacatcccgctcctaatttcaaggcaacggccgtgatgcctgacggacagttcaaggacatcagtctgtctgattataaaggaaagtacgtggtctttttcttttacccactcgatttcactttcgtgtgtcccaccgagattattgcctttagtgacagagccgaggagttcaaaaaattaaattgccaagtgatcggggcaagcgtggacagccatttttgccatctggcatgggtgaacacgcccaagaaacagggtggactaggaccaatgaatatcccgctggtgagtgatccgaagagaacaatcgcccaggattacggagtgttgaaggccgacgaaggcatctcctttcgcggacttttcatcatagatgacaaggggatccttaggcagatcactgtcaacgacctccctgtaggcagaagcgtcgatgagacactacgactggtgcaggccttccaatttacggataaacatggggaatag

SEQ ID NO: 30534 - DNA, 111 bp, Artificial Sequence
  Description of Artificial Sequence: Synthetic coding sequence
atgatcgagaagatgcaaggaagccggatggatgagcagcggtgcagttttcccccaccattgaaaaccgaggaagattacatcccctacccttcagttcacgaggtgtag

SEQ ID NO: 30535 - DNA, 639 bp, Artificial Sequence
  Description of Artificial Sequence: Synthetic coding sequence
atgtcatccaagggatcctccaccgacggcaggactgacctcgctaatggctcccttagcagcagccccgaggagatgagcggcgctgaagaaggccgagaaacctcaagcgggatagaggtggaggccagcgacctgtcgctgtccctcaccggcgatgacggcggaccaaacaggacttctacggagtccagaggcactgataccgaatcgtccggtgaagataaagatagcgactctatggaagatactggtcattattcgattaacgacgaaaatcgtgtgcatgaccgcagcgaagaagaagaagaagaagaggaggaggaagaggaggaacagcctcgcagaagagttcagagaaaaagggccaatcgggatcaggattcttccgatgatgaacgtgctctagaggattgggtctcttctgagacatccgcattgccccgtccacgatggcaggccttgcccgctttacgagaacgggagttagggtctagcgctcggtttgtctatgaagcgtgtggcgcaagggtattcgtgcagcgattccggctgcagcatgggctcgaaggacataccggatgtgtaaacaccctccactttaatcaacgtggcacatggctagcctcaggaagctag

SEQ ID NO: 30536 - DNA, 726 bp, Artificial Sequence
  Description of Artificial Sequence: Synthetic coding sequence
atgacctccgtgacccgcagcgagattattgacgaaaaagggccagtgatgagcaagacccatgatcatcaactggagtcctcgctctccccggtcgaggtgttcgcaaaaacgtctgctagtctggagatgaatcagggtgtcagtgaagaacgcatccacctgggttcctcgcccaaaaagggcggaaattgcgacctctctcaccaggaaagactgcaaagcaaatcgttacacctgagcccgcaagaacaaagcgcttcttatcaagacaggcgccagtcctggagaagggcatcaatgaaggagacgaaccggaggaaatccctccatccgattcaccagggtattactgaactgtctcgttcgataagcgtggatctcgctgagagtaaacggcttgggtgcctgctgctgagttccttccagtttagtattcaaaagctggaacccttccttagggacacaaagggcttttcccttgagagctttagagcgaaggctagctctctgtcagaggagcttaaacatttcgctgacgggctggaaactgacgggaccctccaaaaatgcttcgaggactctaacggtaaggctagcgatttttccctcgaggcctcagtcgcagaaatgaaagagtacataaccaagttttcactggagaggcagacctgggaccaattgctgctgcactaccagcaggaggctaaggagattctgtcctag

SEQ ID NO: 30537 - DNA, 1188 bp, Artificial Sequence
  Description of Artificial Sequence: Synthetic coding sequence
atggctagcgctgcttccgtgactagcctggccgacgaagtgaattgtccgatctgccaaggtacattgcgcgaacccgtgactatcgattgcggccacaatttctgtcgtgcctgcctgacgcgctactgtgaaattccagggccagatctcgaagaatcccccacatgcccgctctgtaaggagcccttcagaccgggaagtttccgcccaaactggcagctggctaacgtcgttgagaacatcgagaggctacagcttgtcagcacgctggggctgggggaggaggatgtctgtcaggagcatggagaaaaaatctattttttctgcgaagatgacgagatgcagctgtgtgtggtctgtcgcgaggccggagagcacgcaacccataccatgcggtttctggaagatgctgcagcaccatatcgcgagcagatccacaagtgcctgaagtgtctacggaaggagcgggaggagatacaggaaattcagtcccgagaaaacaagagaatgcaggttctactaacgcaggtgtccactaagagacagcaagtaatctctgagtttgcccacctgcggaaattccttgaagagcaacaaagtattctcctagctcagctggaatcccaggacggggatattctgcgacagcgcgacgagttcgacctgcttgtcgccggagagatctgccgcttctctgccctgatcgaagagctggaagaaaagaatgagcggcctgccagggagcttctgaccgatatccggtctactttgatcaggtgtgaaactcgcaagtgtagaaagcccgtggcagtgtctccggagcttggacagcggattagggactttcctcagcaagccctgcctttgcaacgggagatgaagatgtttctggagaaattgtgttttgaactcgactatgagcccgctcatatcagcctcgatcctcagacaagccaccctaagttactgttgtcagaagaccaccagcgtgctcagttttcttacaaatggcaaaattccccagacaatccacaaaggttcgacagggcaacttgtgtgctcgcccacaccggaatcactgggggaagacatacttgggtatggatggccagagttccaggcgacagtggatgctgccagttttgcagcccacccagtgtgctcggaacagaagtggcggcatag

SEQ ID NO: 30538 - DNA, 1887 bp, Artificial Sequence
  Description of Artificial Sequence: Synthetic coding sequence
atgtccgataagtccgatctgaaagccgaactggaaagaaaaaaacagcggctggcacagatccgtgaggagaagaagcgcaaggaggaagagaggaagaaaaaggaagcggatatgcagcaaaagaaggaacccgtgcaggacgatagcgacttagatcgtaagcggagagagacagaagctttgctgcagagtattggaatttcacccgaaccccctctcgtgcccacccctatgagcccaagcagcaaaagtgtctccacaccttccgaggccggttcacaggattccggggatctgggtcctttgactcgcactctacagtgggacacggacccctccgttcttcaactccagtccgatagtgagttaggaagaaggctccacaaattgggagttagtaaggtcacccaggtggattttctgccaagggaagtggtgtcctacagtaaagaaacgcagacccccctcgcgacacaccagagcgaagaagacgaagaagatgaagagatggtcgaatccaaagtgggccaagatagtgagttggagaaccaggacaagaaacaggaggttaaagaggccccacccagagagttgactgaggaagagaaacagcagattctgcactcggaggaattcctcatattctttgatcgcactatacgggtcatagagcgcgcactggcagaggattctgacatattttttgattactccgggcgagaactagaggagaaggatggagacgtgcaagcaggcgctaatctgtcgttcaataggcagttttatgacgagcattggagcaagcaccgcgtggtgacttgtatggactggagcctgcaatatcctgaactcatggtggcctcttataacaacaatgaagacgccccacacgaacctgacggtgtggcactcgtgtggaatatgaagttcaaaaagacgacacccgaatacgtcttccactgtcaatcttcggtcatgtctgtgtgcttcgctcgattccacccaaatcttgtcgtcggagggacctactctggccaaattgtgctgtgggacaaccggagccaccgacgcaccccagtgcagcggacaccgctctcagccgctgctcatacgcaccctgtctactgtgtaaacgtcgtcgggacacaaaacgctcacaatttgattaccgtgagcactgatggcaagatgtgttcctggagcctcgacatgttgtctaccccacaggaaagtatggaactggtttacaacaaaagcaagccagttgccgttacaggaatggcctttcccaccggggacgtgaataactttgtggtcggttctgaagaggggactgtctacactgcctgcagacatggatctaaagcgggtatcggggaggtgttcgagggacaccaaggacctgtaactgggatcaactgccacatggccgtggggcctatcgacttctctcatttgttcgtcacttcctctttcgactggacagtgaagctctggaccactaagcacaacaaaccgctttatagctttgaagacaacgcagattacgtgtatgacgtgatgtggagcccagtccaccctgccctattcgcctgcgtggatggaatgggacgcctcgacctgtggaatctaaataatgacactgaggtcccaaccgcaagtgtggccatagagggagcaagcgccctcaatcgagtgagatgggcccaggccggtaaagaggtagcagtgggagactctgaaggacggatttgggtgtacgacgtgggagagctggcagtcccacacaacgacgagtggaccagatttgcaaggacactcgtggaaatcagggccaatcgcgcagatagcgaagaggagggcacagtggagctgtccgcctag

SEQ ID NO: 30539 - DNA, 1644 bp, Artificial Sequence
  Description of Artificial Sequence: Synthetic coding sequence
atggccggtacaaaaaacaagactcgcgcacaagctaagacagagaagaaggccgcaatccaggctaaggccggagccgagcgcgaggccacaggcgttgtcagacccgtggcaaaaacaagggccaaggccaaggcgaagacgggctccaagaccgatgctgtggccgaaatgaaggcagtgtcaaagaataaagtggtagccgaaaccaaggagggggctctctccgagccaaaaacactagggaaggcaatgggagactttacccctaaggcgggaaacgaaagtacctcatctacgtgtaagaatgaggctggcactgacgcgtggttttgggcaggcgaagaagccacaatcaactcatggttttggaacggagaggaagcaggtaattctttctcaacgaagaacgataaacccgaaataggtgcccaggtgtgtgccgaagagttggagccggcagccggtgccgattgcaaacctaggtcaggtgcggaggaggaggaggaagaaaacgtgatcggaaattggttttgggagggagacgataccagttttgaccctaatccaaaaccagtcagtcgaatcgttaaacctcaaccggtttacgagattaacgaaaaaaaccgacctaaggactggtcagaggtgacaatttggccaaatgccccagccgtcactcctgccgtgctaggcttccgctcccaggccccaagtgaagcgagcccccctagctacatagtactggcaagcgctgaagagaatgcttgttctcttcccgtggccaccgcttgccggcctagccggaatacgcgctcttgctcccagccaattccagagtgtcggttcgattcagacccgtgcatccaaactatcgacgagattcgaaggcaaatcagaatccgcgaagtcaatggcataaaaccgtttgcatgtccctgcaagatggagtgctatatggactctgaggaattcgagaagctcgtctctttactgaagtcaacgaccgatcccctgatccacaaaatagccagaattgccatgggagtgcataatgttcacccattcgcacaggagttcatcaatgaggttggggtagtgaccctgatcgagtccctgttgtctttccccagccctgaaatgcgcaaaaagacagtgataacgctgaatccaccctcgggcgatgaaagacagagaaagatcgagctgcacgtcaagcacatgtgtaaagagactatgagctttccactgaacagccccggacaacagtccggcctgaagattctgggacagctcaccactgatttcgtgcaccattatatagttgccaactactttagcgaactgtttcatctgcttagttcaggcaattgtaaaacacgcaatctggttctcaaactgctgctcaacatgtctgaaaatccaactgcagccagagacatgataaatatgaaagcgctcgctgccctgaaattaatctttaaccagaaggaagccaaggctaatctcgtgtctggggtggctatttttatcaatattaaggaacatatccggaaagggtcaatcgtcgtcgtggaccatttaagctacaacaccttgatggcaatctttagagaggtcaaagaaatcattgagaccatgtag

SEQ ID NO: 30540 - DNA, 747 bp, Artificial Sequence
  Description of Artificial Sequence: Synthetic coding sequence
atggccttttcaggcagagctcggccatgcataattcctgagaacgaggagatccctcgggcagccttgaacacagtccatgaggctaatgggactgaggatgaaagagctgtgagtaaactccaaagaagacatagtgacgtgaaagtctacaaggaattctgcgatttctacgccaaattcaacatggccaatgccttagcgtcagccacttgcgagcggtgtaagggaggctttgcacccgctgaaacaatcgttaacagtaacggagaactgtatcatgagcagtgctttgtttgtgcacagtgcttccagcaattccctgaagggctcttctacgagtttgagggaagaaaatattgcgaacacgattttcagatgctctttgcgccatgctgccaccagtgtggggagttcatcattggacgcgtgataaaggccatgaacaattcatggcatcccgaatgcttcaggtgcgacctctgtcaagaagtgctggccgacataggatttgtgaaaaacgcgggacgacacctctgtagaccttgtcataaccgggaaaaggcgcgtgggttgggcaaatacatctgccagaagtgtcacgcgattatcgacgaacaaccactcattttcaaaaatgacccctatcatccggatcactttaactgtgcgaactgtggtcaggaaggttccgactgtcgatgtacaggcgctgagcgcggtgctatcctccctgccatgccgtag

SEQ ID NO: 30541 - DNA, 621 bp, Artificial Sequence
  Description of Artificial Sequence: Synthetic coding sequence
atggagtctaacttcaatcaggagggtgtgccacgtccttcctatgtcttcagcgcagatccaattgccagaccaagcgagataaactttgacggcattaaactggatttatctcacgaattctcattagtggcgccaaatacggaagctaattcatttgagagtaaagactacttacaagtatgtctccgcatacggccattcacccagagtgagaaagaactcgaatccgagggatgcgttcacatcctggactcccagactgtggtgctgaaggagccacagtgcattttgggacggctgtcggagaaaagcagtgggcagatggcccagaagttttcattcagtaaagtttttggacctgccaccactcagaaagagtttttccagggctgcatcatgcagccagtaaaggacctgctcaaagggcaatcaaggcttatattcacctacgggctcaccaatagcgggaaaacctacacgttccaggggacagaagaaaacatcgggatattgcccaggacactgaatgttctctttgatagtctgcaggagaggctgtatactaaaatgaatcttaagccccacaggtcacgggagtacctacggctctcttcctag

SEQ ID NO: 30542 - DNA, 990 bp, Artificial Sequence
  Description of Artificial Sequence: Synthetic coding sequence
atggaagtggctgagcccagctctccaaccgaggaggaagaggaggaagaggagcactcagctgagccgaggcctcggactaggtcaaatccagaaggagctgaagatagggctgttggggcacaggcctccgtgggaagccggtcagaaggcgaaggggaagccgcttccgctgatgacggtagcctcaatacctccggcgcaggcccaaagagctggcaggttccaccaccagcacctgaggtgcagatccggacacccagggtcaattgccctgaaaaggtgatcatttgtcttgatttgtccgaagagatgtccctgccaaaactggaaagctttaatggcagcaagaccaacgctctcaatgtttctcaaaagatgattgagatgtttgttagaacaaaacataagattgataaaagtcatgaatttgctctcgtcgttgtcaacgatgatacagcttggctcagtggcttgaccagcgatcctagggagctgtgttcatgtctgtacgatctagagacggcatcctgctcaacttttaacatttcaggggctagccctgctcgacaacagaagactgaattacccgtgactgaaaatgtgcagactattccccctccctacgtggtgcgcacaattctggtgtatagccggcctccctgtcagccccagttttcactaacagaaccgatgaagaaaatgtttcagtgcccctatttcttctttgacgtcgtgtacatccataatgggactgaggaaaaggaagaggaaatgtcatggaaagatatgtttgccttcatgggcagcttggacacgaaagggacatcatacaagtacgaggtggccctggcaggtccggcattggagttacataactgcatggcaaagcttttggctcaccccctgcagcgcccttgtcaaagtcacgccagctattccctgttggaagaagaggacgaggccatcgaggtggaagctacagtgtag

SEQ ID NO: 30543 - DNA, 1620 bp, Artificial Sequence
  Description of Artificial Sequence: Synthetic coding sequence
atggcaacttccgcacctctgagaagcctggaggaagaggtgacctgttccatttgtttagactacctccgcgacccagtaaccatcgattgcggccacgttttctgcaggtcgtgtactaccgatgtccgacccatatcgggatcacgccctgtctgtcctctgtgtaaaaagccttttaagaaggaaaacatcaggcctgtatggcagctcgcgagtctggtggaaaacatcgaaagactgaaggtcgacaaaggtcgacagccaggagaagttactcgggagcagcaagatgcaaagctgtgcgaacggcaccgggagaagctacactattattgtgaggatgacggcaaactactgtgtgtgatgtgccgcgagagccgtgagcaccggccacatacagccgtcttgatggagaaggccgctcagccccaccgtgagaaaattctgaaccatctatcaactttacggcgtgatcgggacaagattcaagggtttcaggcaaaaggagaggccgatatcctcgcagccctgaaaaagctgcaagatcagcgccaatatatcgtcgctgagtttgagcagggccaccagtttctgcgggagcgcgaagaacatctgctggagcagctggccaagctggagcaagagctgactgagggaagggaaaagttcaagagccgtggcgtcggcgaactcgctcggctcgccctagttatctctgagctggagggcaaggcccagcaacccgctgcagagctgatgcaggacactagagactttttgaacagatacccccgaaaaaagttctgggtcggcaaaccgatcgctcgggtagtcaaaaagaagacaggggagttctcagataagcttcttagcctccaaagaggcctgagggaatttcaagggaagctgttacgcgatttggaatacaagaccgtttccgtgaccctcgatccccagtcggcatccggctacctgcaactgtcagaggattggaagtgcgttacctatacatctttgtataaaagcgcctatctgcatccccaacagtttgactgtgagcccggagtcctagggtcaaagggcttcacctgggggaaagtgtattgggaagttgaagttgaaagagagggttggtccgaggatgaggaagagggggacgaagaggaagagggagaggaagaagaggaggaagaagaggcgggttacggtgacgggtatgatgattgggagacagacgaagatgaggaatctctgggcgatgaggaggaagaagaagaggaggaagaagaagaagtgctggagagttgcatggtgggggtagcaagggacagcgtcaagcgcaagggtgatctgtcactgagacccgaggacggtgtttgggcccttaggctaagctcaagtggaatttgggccaacaccagccccgaggctgaacttttccccgctctacgccctaggagggtggggattgccctggactatgaagggggtaccgtcacttttacgaatgcagagtcccaggagctcatatatacttttaccgcgaccttcactcggcgactagtgcccttcctctggctcaagtggccgggaacccgactgctgcttcggccttag

SEQ ID NO: 30544 - DNA, 3558 bp, Artificial Sequence
  Description of Artificial Sequence: Synthetic coding sequence
atgtgtgaagtgatgcctacaatcaatgaaggagataggctcggtccgccacatggagcggacgcggatgctaattttgagcagcttatggtgaacatgctagatgagagggaaaagctgttggagtcccttagagagtcccaggaaacactcgccgctactcaaagtaggcttcaggacgccatccatgagagggatcaattgcaaagacacttaaattccgcactgcctcaagagttcgctaccctcacccgagagttgagcatgtgccgagagcaactgctcgagagggaggaggaaatttcggaactcaaggcagaacgcaataacaccaggctgttactggaacatctggagtgcctggtttccaggcacgagaggagtcttcgaatgacagtggtgaagaggcaggctcaatcacctagcggagtctcctcggaagtagaggtcctgaaagcattgaaaagtttgttcgagcaccacaaggctctcgatgagaaggtacgcgagcgactgcgtgccgctttagaacgagtgactaccctcgaagagcaactggccggtgctcaccaacaggtcagcgctctgcagcagggcgctggggtgcgggatggagcagctgaggaggaaggtaccgtggagctcgggccaaaaagattatggaaagaggacactggacgggtggaagagctacaggaattgctggagaaacagaacttcgagctgtcccaagcaagggagcgtctcgttaccctgacaaccaccgtgactgagctagaggaggaccttggtactgctcggagggacttgatcaagtcagaggagttgagcagtaagcatcagcgtgatctccgggaggcacttgcccaaaaggaggatatggaagaacgaatcaccacacttgagaagcggtacctggccgcacaacgggaagcaacctccattcacgatttgaacgacaaattggagaacgagttagccaataaagaaagcttgcacaggcaatgcgaggagaaagccagacatctccaggagctgctggaagttgcagagcagaaactacagcagaccatgagaaaagccgagactttacctgaggttgaagctgaacttgcacagagaatagctgccctcaccaaagctgaagaacgtcacggcaacatcgaggagcacctgaggcagctggaaggacaactggaagaaaaaaaccaggagcttgctcggaccgccgtgcaagtaaggcaacgggagaagatgaacgaagaccacaacaaacggctgtctgatacagttgaccggcttctgtccgagtcaaacgagaggctgcagcttcacttaaaggagagaatggccgctctggaagagaaaaacaccctgatccaggagctcgagtcatcacagaggcagattgaggagcagcaccaccacaaggggcgactttcggaagagatagagaaactgaggcaagaggttgaccagcttaagggtcgagggggaccatttgtggatggtgtccatagtagaagtcacatgggatcggccgcagatgtcaggtttagccttgggacaacaacacacgctccccctggagtgcaccgacgctatagcgcccttagggaagagtcggcaaagctggccttgcctctgacagtgacactgaggtctcctacttggatgcggatgagccaaggtgtctgttgcaatttagaatatcacagttcaggaaccttgtgcggctccagtgggcctctgcctgtccccgaaatgattcaagaggagaaagagtcaaccgagctgagagccgaagaaatcgagactagagtgacctccggcagcatggaagccctgaacctgaaacaattgcggaagcggggatcaatccccacaagcctgaccgcgctttctcttgcatccgcctccccgcctcttagcggaaggtcaacccctaagttaacaagcagatcagccgctcaggatctggatcggatgggagtcatgacattgcctagtgacctccgcaagcatcggcgaaaactgctctcaccagtcagccgggaagagaaccgcgaggataaagcaactattaaatgcgaaacgagcccgccatcttcccccagaaccctgcggctggagaagctgggacatccagcactctcacaggaggaaggtaaatcagcactcgaggatcaaggaagtaatccctcatcctctaactcatctcaggatagccttcacaaaggggcaaaaagaaagggcattaagtcatcaatcggcagattattcggcaagaaggagaagggtaggctaatccaactgagtagggacggggctacagggcacgttcttcttacagattctgagttctccatgcaggagcctatggtaccagcgaagttgggcacacaggcggagaaggacaggcggctgaaaaagaagcaccagctcttagaggatgcaaggcgaaagggcatgccctttgctcagtgggacggacccactgttgtatcatggctcgaattgtgggtcggaatgcccgcatggtacgtagctgcatgtcgggcaaatgttaagagcggggctattatgtccgctctgtccgacacggagatccagcgggaaattgggattagcaatgctttgcataggcttaaactaagattggctatccaggagatggtctctctgaccagccccagtgcgcctcctacatctcgcacgtcgagtggaaacgtctgggttactcatgaggagatggagaccctagaaactagtaccaaaaccgactctgaggaggggagctgggcccagactcttgcgtatggcgacatgaaccacgagtggataggaaatgagtggcttccttctctgggattaccacaatataggagttacttcatggaatgcctcgttgacgctcgaatgctggaccacctgacaaaaaaagaccttagagttcacttgaagatggtggatagctttcatcgcacatccttgcagtatggcattatgtgcttgaagcggttgaattacgatagaaaggaactcgagaaaagaagagaagaatctcaacacgagattaaggatgtgctcgtttggacgaacgatcaggtcgtccactgggtgcagagcatcgggttgagagactacgccggaaatctccatgagtccggggttcatggtgctctcctcgctctggatgaaaatttcgatcacaatacacttgcacttatcctccaaatacccacacagaatacccaggcaaggcaggtgatggagagagagtttaataacttactcgccctgggaacagataggaagctggatgatggagacgataaagtgttccggagggctccatcatggagaaaacgattccgacccagggaacatcacggcagggggggaatgctttcagctagcgccgagactctgcccgcaggatttagggtatctacactagggaccctgcagcctccgccagcaccacccaagaagatcatgcccgaagcacactcccactatctgtacgggcatatgctgtctgcattccgtgactag

SEQ ID NO: 30545 - DNA, 1383 bp, Artificial Sequence
  Description of Artificial Sequence: Synthetic coding sequence
atggagatctgtgacattataaacgagaccgaagaagggccaaaagatgccctaagagccgtcaagaaacggattgtaggcaacaagaattttcatgaagtcatgctcgccttgacagttctcgaaacttgcgtgaaaaactgtggacacaggtttcatgttcttgtcgccagccaagattttgttgagagtgtgcttgttaggacgatacttccgaagaataatcctcccacgatcgtgcatgacaaggtgctcaatctgattcagtcttgggccgatgcctttcgaagctctccggacctgacgggcgtcgtgacaatctatgaggatctccgcaggaaaggccttgaatttcccatgacggatctggatatgctgtctcctattcacacacctcagcggaccgtgtttaactctgaaactcagagtggacaggactccgttggaacagattcctctcagcaagaggattccgggcagcacgctgccccactcccagcaccccctattctaagcggcgacacacccatcgcaccaacccccgagcagataggcaaactgcgatcagaactggagatggtgtctggcaatgtgagggtgatgtccgagatgttgacagaactggtgccaacccaggccgaacccgctgacctcgaactcctccaagaactcaataggacgtgtcgggctatgcaacaacgtgtactcgagttgattccccagatcgcgaacgaacagctgactgaggagctgcttatcgtgaacgacaatttaaacaacgtttttttaagacacgaacgtttcgagcggtttcggactggccagaccaccaaagccccttcagaagctgaaccagctgcagatttgatcgatatgggaccggatccagctgcaacaggaaatctcagctcccagcttgccggaatgaatctcggaagctccagtgtgagagccggattacagtccttggaggcctcaggacgactggaggacgaattcgatatgtttgctctgactaggggcagtagcctggcagaccagcgaaaagaagttaaatatgaggctccccaggccacggacgggctagccggagcactggatgcccgacagcagtcaaccggggctattccagtaacgcaggcctgtttaatggaggatatcgagcaatggctgtccactgacgttgggaacgatgccgaggagccaaagggtgtcacttctgaggggaaattcgacaagttcctggaggagcgggcaaaagccgctgaccgcttgcctaatctctcctccccctcggctgaaggccctccaggccctccaagcggcccagcccctcggaagaaaactcaggagaaggacgatgacatgctgttcgcactctag

SEQ ID NO: 30546 - DNA, 180 bp, Artificial Sequence
  Description of Artificial Sequence: Synthetic coding sequence
atgatgatgaagatgatgatgaggatgaagatcaggaagattcgctaccattgccagcgcaagcagaatctcatccacaacaatggcaacggactgggatccgtgcccgtggaaaagctcgtgctgcacccctcaccaatccagaatcctcagcaaagtgctgtggttagctgtgagtag

SEQ ID NO: 30547 - DNA, 537 bp, Artificial Sequence
  Description of Artificial Sequence: Synthetic coding sequence
atgcttggcttggacgcttgcgagcttggcgctcagctgctggagctcctgcgcttggccctttgcgcacgggtgctcttggccgataaggaaggcggaccacccgcagtcgatgaagtgttggacgaagcagtccccgaataccgagcccctggacgcaaaagcctgctcgagataaggcagctggacccagacgaccgatcactcgccaagtacaagcgggtgttactcgggccactgccacccgctgtggacccctcccttcccaatgttcaggtgactcgcctcacgctcctgtccgagcaagccccaggacccgttgttatggacctgaccggggaccttgccgttctgaaagaccaggtgttcgtgctcaaggagggggtcgactaccgtgtgcatcgagaaattgtaagcggattaaaatgtttacaccacacatatcggcgagggctgcgtgtcgacaagaccgtgtacatggtcggttcctacggtccgagcgcccaggagtatgaatttgtgactcctgtggagtag

SEQ ID NO: 30548 - DNA, 1119 bp, Artificial Sequence
  Description of Artificial Sequence: Synthetic coding sequence
atggattctgtgcggagcggccctttcggacaggtgttccgtcccgacaacttcatattcggtcaatgcggcgcaggaaataattgggcaaaaggccattatacagagggggctgaacttatggagagcgttatggacgtggtgaggaaggaggcagagtcctgtgactgtctgcaaggattccagcttacccactccctaggagggggaactgggtctggaatgggtactctcctgctgtctaaaatccgcgaggagtaccccgatcggattattaacaccttttcgatcctgcctagccccaaggtgtccgatactgttgtggaaccgtacaatgccacgctgagcgtgcaccagctcattgaaaacgctgacgagaccttttgcatagacaatgaggccttgtacgacatttgctctaaaactctcaaactccctactcctacttacggcgacctgaaccacctggtgtccgccactatgagtggcgttaccacctgtctcagattcccgggacagctcaacgcagacttgcggaagctggcggtcaacatggtaccctttcccaggctgcattttttcatgccaggctttgctccgttgacttccaggggatctcagcaatatagagctctgactgtggccgagctgacccagcagatgttcgacgcaaagaacatgatggcagcctgcgaccctcggcacgggcgttatcttacggcggctgcaatctttcggggtcgcatgcccatgagagaggttgacgaacagatgtttaacattcaggacaaaaactcttcctatttcgccgactggcttccaaataatgtgaagacggcagtttgtgacattcccccacggggtctcaagatgtcagcgacgttcattgggaacaacacagcaattcaggaattgttcaaaagagtttcagagcaatttacagctatgttccgccgaaaggccttcttacactggtacaccggagagggcatggacgagatggagttcactgaggccgagagtaatatgaatgatctcgtgtctgagtaccagcaatatcaggatgcgacagctgaggaagaagaggatgaggagtacgcggaagaggaagtagcctag

SEQ ID NO: 30549 - DNA, 576 bp, Artificial Sequence
  Description of Artificial Sequence: Synthetic coding sequence
atggcagcagccaaagatactcacgaggatcacgatacctccacagagaacacggatgagagtaatcacgatccacaattcgagcccatagtctcgctgcccgagcaagagattaagactttagaagaagatgaagaagagttatttaaaatgagggcaaagttgttccgctttgcttccgaaaacgatttgccagagtggaaagagagaggaacaggcgatgtgaaactccttaagcacaagacactcaaaatttgtgcaaatcactacatcacccccatgatggagctcaagccgaacgccggatccgatagagcctgggtttggaacacgcacgccgactttgccgatgagtgtccaaagccggagctgcttgccataagattcctcaatgcagaaagtgagcccagagctctaggcacctgtctcacttggggctctccagcttggcagcggggaggactctgtgctaccaatgccgtggccttctggggcgagggcgctgtgaccggcaaatgtgtggtttgggcagcgctgccttgctgtctgggcgcaatgcccaggctgaagccatag

SEQ ID NO: 30550 - DNA, 369 bp, Artificial Sequence
  Description of Artificial Sequence: Synthetic coding sequence
atggccacttcagcccctctgaggtctttggaggaagaagtgacgtgtagcatctgtcttgattatttacgggatccggtgaccatcgactgtggacacgtcttctgtcgaagttgcacaaccgatgtgaggccaatctctggaagcaggccggtatgtcctctctgtaagaagccttttaagaaggaaaacattcggcctgtgtggcagctcgcttccctggtggaaaatatcgaaagattaaaggtggacaaaggcagacaacctggcgaagttacgagagagcagcaagatgcaaaactctgtgagcgccacagggagaagctgcattattattgtgaagacgatggaaaactgttatgcgtttag

SEQ ID NO: 30551 - DNA, 1383 bp, Artificial Sequence
  Description of Artificial Sequence: Synthetic coding sequence
atggccagccttctccagagcgatagagtcttatatctggttcagggggagaagaaggtgcgggctcccctatctcagttatatttttgcaggtattgcagcgagctgcggagcctggaatgcgttagtcatgaggtggattcccattactgtccatcttgtttggagaacatgccctccgcagaagccaagctcaagaaaaatcgctgtgcaaactgctttgactgccccggttgtatgcacacactgtccacccgcgcaaccagcatctccactcagcttcctgacgacccagcaaaaactaccatgaagaaggcgtattatttggcctgtggattctgcaggtggactagtcgagatgtgggaatggccgacaaatccgtcgcgagcgggggatggcaagagcccgagaacccacacacccagcgtatgaacaaattgatcgaatactatcagcaattggcgcagaaggaaaaagtggagagagacaggaagaagcttgcccgaagacggaactatatgccgctggctttttcagataaatatggcctgggaacacggttgcagcggcctcgggcaggggcttcgatatcaactcttgctggcctctcgctaaaggaaggggaggatcaaaaagaaataaagatcgagccagcccaagccgttgatgaggttgaaccattacctgaggactattacactcgccctgtgaatctgactgaggtgaccaccctacaacagcggctgttgcaacccgactttcaacctgtgtgcgcttcacagctgtacccacgtcacaaacacctgcttatcaaaaggagcctgagatgccggaagtgtgaacacaacttgtcaaaacccgagtttaatcccacctctattaagttcaagatacaactggtggctgtgaattatatccctgaggtcagaattatgagcattccaaatctccgctatatgaaagagtcccaagttttactcacccttaccaatccagtggagaatctgacacatgtgactctgtttgagtgtgaggagggagatcccgatgatattaacagcaccgccaaggtcgtcgttcctccaaaagaattagtgctcgccggaaaggacgccgcagcagagtatgatgagctggcggagcctcaggacttccaggatgacccggacattattgctttccgcaaagctaataaggtcgggattttcataaaagtgacgccccaaagagaagaaggtgaagtgaccgtctgttttaagatgaagcacgattttaaaaacctagctgcccctatccgacccatcgaggaatctgatcagggcacggaggttatttggctgactcagcacgtcgagctctctctaggaccgttgctgccttag

SEQ ID NO: 30552 - DNA, 3336 bp, Artificial Sequence
  Description of Artificial Sequence: Synthetic coding sequence
atggagatggacgcgcctcgacctccaagcctcgcggtcccaggcgcagcctcccgcccaggcaggctgcttgacggaggacacgggaggcagcaggtgcaggctttgtcaagtcaattgttggaggtgatacccgattccatgcgaaagcaggaagttaggactggcagagaggccggacaggggcacggaacaggatcacctgccgaacaggttaaggccctgatggatctcttagcgggaaagggatcccagggttcccaggcacctcaggccctggacagaacacctgacgctccactgggaccctgtagtaacgacagccggattcagcgtcacaggaaggcgctcctgtccaaagtgggaggtggtcctgagttggggggtccttggcatcgccttgcaagtcttctactggtggaggggctgaccgatctgcaactgcgtgaacacgacttcactcaagtggaggcaacaagaggcggtggacatccggctaggaccgtcgccctggacaggctgttccttccactgagccgcgtgtccgtcccacccagggtatccattactatcggagtggcgggaatgggcaaaacaaccttggtgaggcattttgtgaggctctgggcgcatggccaagtcggaaaagacttttctttggtgctaccactgaccttccgagatctcaacactcacgagaagctatgtgcagatcgcttaatctgttcagtctttccacacgtgggggaacctagcctggccgtggccgtgcctgcgcgagctctgctgattttagacggcctggacgagtgtagaactcccctcgactttagcaataccgtggcttgcaccgaccccaaaaaggagatcccagttgatcacctaattaccaatatcatccggggtaatctgtttcctgaagtgtctatctggataacaagtaggcccagcgcatcgggacagattcccggaggattggtggacagaatgaccgagataagagggttcaacgaagaagagatcaaggtgtgcctggagcagatgtttccggaggaccaagccctgctgggctggatgctctctcaggtgcaggcggaccgcgctctatatttgatgtgcacggtgcccgctttctgcagacttaccggaatggctctcgggcacctctggagatcgagaaccggccctcaagacgccgagttgtggccccctcgaaccctgtgcgaattatatagttggtatttcagaatggctctgagtggggaaggacaggagaagggtaaggcatcacctcgaatcgaacaggtcgcgcacggaggtagaaagatggtcgggacgctgggacggctcgcatttcatggtctcctgaagaagaaatatgtgttttatgagcaagatatgaaggcatttggtgtggatcttgctctgctgcaaggcgcaccctgttcttgttttttacagagggaggaaaccttggcgagtagcgtcgcttattgctttactcatctgagcttgcaggaatttgtggccgctgcctattattatggtgccagtcgcagggctatctttgatctgtttactgagtcaggcgtctcatggccgagactcgggtttctgactcatttcagaagcgccgcacagcgcgctatgcaagctgaagacgggagactcgacgtgtttttgcggtttctgtcgggattgctgagtccccgtgtcaatgcactgctggctggctctctcctagcccaaggagagcaccaggcttaccggacacaggtcgccgagcttctgcagggctgcctgcggcctgatgccgctgtctgcgcccgagccatcaacgtcctgcattgtctgcatgaactacagcacacagaactcgcaagaagcgttgaagaggcaatggagagcggcgctttagctagactgactgggccagcccaccgagctgctctcgcctacctgctccaggtatctgatgcgtgtgctcaggaggctaatctttcgctgtcactgtcacagggggtgttgcaatccctgttgcctcagcttctgtattgccggaagctgcgattggataccaaccaatttcaggatccagtgatggaactcttgggaagtgtactgtctgggaaagactgcaggattcagaagatcagcctggctgagaaccagattagtaataaaggagccaaagctctggctcgctcactattagtcaatcgatccttgacctcacttgatctgcgcggaaacagtatcggaccacagggggctaaggcgctggcggatgccctgaagataaacagaacactgaccagtctttccctgcaaggcaacacagtgagggatgatggcgctagatcaatggccgaggccctcgcgtcaaaccggactctgtccatgttgcatctgcagaaaaatagtattgggccaatgggggcacagcggatggccgatttaaaacagaatcggagtctaaaggagctgatgttttcttccaactcaatcggagatggaggagccaaagccctcgcagaagcgctgaaggttaatcaggggttggagtctctcgaccttcagtctaacagcatatctgatgccggagtggctgccctgatgggcgctctgtgtaccaatcaaactcttctgagtctatcgctgagggaaaattctatttcaccagagggtgctcaagcaatcgctcacgccttatgtgccaactccactctgaaaaacctggacctgaccgccaatttgctgcatgatcagggggcaagagcgattgccgttgctgtcagagaaaaccgaactctcacctctttacacctgcagtggaatttcattcaagccggagcggctcaggcgctcggccaggctctgcagctgaacagatccttaacatccctagatctgcaggaaaatgcaattggggacgatggcgcttgcgctgtggccagggctctgaaggtcaacacagctctcacagccctgtacttgcaagtggcttctattggtgcgtctggagcccaggttcttggggaagcactcgctgtgaacaggactttagaaatcctggacttgagggggaatgcgataggggttgcaggagcaaaggccctggccaacgccctcaaagtgaattcttctctgcggagactgaacctgcaggaaaactctctcggaatggatggagccatctgcattgccactgcgctttccggcaatcatagactgcaacacatcaacctccagggtaaccacatcggagattctggtgcgaggatgatctctgaggcgatcaaaactaatgctccaacttgcacagtcgagatgtag

SEQ ID NO: 30553 - DNA, 2424 bp, Artificial Sequence
  Description of Artificial Sequence: Synthetic coding sequence
atgcttgagcgtagagccctcttgtggcagagggaagctggaccaggctggggagaccgggcaagggccggaaccgggggagcgggaggcggatgtggcggagccatggccgagaggggacctgctttttgtggcctgtacgatacttcgagtctactcagatactgcaatgatgacaatctttccgggacgtctgggatggaggtcgatgatagggtgagtgccttagagcagaggttgcagcttcaggaggatgaactggccgtgttaaaggccgctctcgcagatgccctgaggaggctgcgggcttgtgaggagcagggagctgcattgagggctagaggcacccctaagggccgagcaccccctcggcttggcaccaccgcgtcagtctgtcagctcctcaaaggtcttcctacaaggacccctctgaatggttcagggcctcctcgcagagtagggggttatgctacaagccctagctctccgaaaaaggaggcgacttcggggagatctagcgtgcggagatatttatcccccgaacggctggccagcgttagaagggaggatccgaggagtagaacgacatcaagctcaagcaattgttccgcgaagaaagagggcaagaccaaggaagtgatcttctccgttgaagacggatctgtgaaaatgtttttaaggggtcgaccagtgccaatgatgattccagatgagcttgcccctacatattccttagatacccgcagcgagctgccaagttgtcggctgaaattggagtgggtgtacggctatagaggaagggattgccgcgctaatctgtatctgcttccaactggggagatcgtctatttcgtggcaagcgtcgccgtcctttattcggtcgaggagcagaggcagaggcattatcttggccataatgatgatattaagtgtctggccattcaccccgacatggtcactattgccacaggacaggtggcaggaactacaaaagaaggcaaaccacttcctccacacgtgaggatttgggactctgtgtccctgtctacactgcacgtgcttggcctcggggttttcgatagggctgtatgctgcgtgggtttctccaagagtaacggcggaaatctcctatgtgcagttgatgaatccaatgaccacatgttgagcgtgtgggattgggctaaggaaactaaggtggtggatgtgaagtgctctaatgaggctgtcctggtggcaacctttcacccaacagatcccactgtccttatcacttgcggcaagtcacatatctatttttggacactggagggtgggtctttatcaaaaagacaaggcctttttgagaaacatgaaaaaccgaagtatgtcctttgtgtgacttttcttgaaggcggagatgtcgtgaccggtgactctgggggtaatttatacgtttggggcaaggggggaaaccggattactcaggcggtgctgggggcacacgacggcggagtctttgggctgtgcgccctgcgcgatgggacactggtttccggaggtgggaggaattcgattctccagggttctgttcatacaggctttagcctgctggtgcaagggcacgtcgaagaactttgggggctggccacccacccgagccgggctcagtttgtcacctgcggccaagataagttagtacatctctggtcctcagactcacaccagccgctgtggagcagaatcatcgaagatcctgctcgttccgccggatttcacccaagtggctcagtcctcgctgtgggaaccgtgacaggtaggtggctcctgcttgacacggagactcacgacctggtggccatccacactgatggaaacgagcaaattagcgtcgtgagcttcagccccgacggagcctacctagcagtcgggagccacgataatctcgtgtatgtctatacagtggaccagggaggaaggaaagtctctaggctggggaagtgctccggccactcctccttcatcacacacctagattgggcccaggacagtagctgttttgtgacaaattcaggggattacgaaatcctgtactgggatcctgcaacatgtaaacagataacctcggcagatgccgtgcgcaacatggagtgggcgaccgccacctgtgtgctcggatttggagtgtttgggatctggtcagaaggcgcagatggcaccgatatcaacgctgtggcaaggtcccacgacggtaagttgttggcttctgccgatgattttggcaaagtccatttattctcgtacccttgttgccagccacgcgcactgagccacaaatacggaggtcacagttctcacgtgacaaacgttgcttttttgtgggatgactccatggctctcacaacaggcggtaaggatacatccgtgctccagtggcgagtggtgtag

SEQ ID NO: 30554 - DNA, 1413 bp, Artificial Sequence
  Description of Artificial Sequence: Synthetic coding sequence
atggaggagacaattaaggatcctccgactagtgctgtgctcctggaccactgtcacttctctcaagttattttcaattccgttgagaaattctacattcctggaggagacgttacctgtcattacacctttacccagcactttatacctagaagaaaggactggatcggtatcttccgggctttcaaatgttttcaggacaagctggagcaggaacttctgaaatggcggagccaaggtcagaagctacaggtgggatggaagacaaccagggaatactacacatttatgtgggtgactctccccattgatctgaataataagagcgcgaagcagcaagaggtacagttcaaggcctactacctcccaaaggatgacgagtattaccagttctgctacgttgacgaggacggcgtcgtgaggggcgcttcgattcctttccagtttcggcctgaaaacgaggaagacattctcgtggtaacaacgcagggggaggtcgaggagattgagcagcacaataaggagctgtgcaaagaaaaccaagagctcaaggactcctgtatcagcttacaaaaacagaacagcgacatgcaggcggaactgcagaaaaaacaggaagaacttgagactctccaaagcattaacaagaagctggaactcaaggttaaagaacaaaaagactactgggagaccgagctgttgcagctcaaggaacagaaccaaaagatgagctccgagaacgaaaaaatggggattcgtgtggaccagctccaggcacagctatcaacccaggaaaaggagatggagaagctcgtccagggagatcaagacaaaacggaacagctggagcagctgaaaaaggagaatgaccacctgtttttgagtctaaccgagcaacgcaaagatcagaaaaagttggagcagaccgtggaacagatgaagcagaacgagacaactgcaatgaagaagcagcaggaactgatggacgaaaactttgatttatccaagaggctgagtgaaaatgaaatcatttgcaacgcccttcagcgccagaaagagcgcctagagggcgagaacgacctcctgaaacgggagaattctaggctgttgagttatatggggctggattttaactctctgccttaccaggtgcccacgagtgatgaagggggtgcgaggcaaaatccgggactggcctatgggaacccttactctggcatccaggagtcctcttcgccatctcctctcagcatcaagaaatgcccaatatgcaaagctgacgatatttgcgatcacactttagagcagcagcaaatgcaaccactgtgcttcaattgtcctatctgcgataagatttttcccgcaaccgagaaacaaatcttcgaagatcacgtgttttgccactcactttag

SEQ ID NO: 30555 - DNA, 1023 bp, Artificial Sequence
  Description of Artificial Sequence: Synthetic coding sequence
atgagcaagacgcacgaccatcagctagaaagttcattgtcgccagtagaagtgtttgccaagacttccgcttcactagaaatgaaccaaggggtgagcgaagaacggattcatctgggtagctccccaaaaaaaggaggcaattgcgatctgagccatcaagaaagactccagtcaaaatccctgcatcttagtcctcaagaacagtctgcttcatatcaggaccgcagacagtcatggaggcgtgcttctatgaaggaaactaacagaagaaaaagcctccatccaatccatcaggggattaccgaactttctcgatctattagcgtggatttagctgaaagcaagaggttgggctgcttgctgctgagcagttttcagttcagcatccagaaactggaaccctttttaagggacactaaaggctttagtctggagagcttccgtgccaaggcttcatccctgtctgaagaactcaaacactttgctgatggcttggaaaccgacggaacacttcagaagtgcttcgaggactcaaacggcaaggcaagcgattttagtctggaggccagcgtcgcggagatgaaggagtatattactaagttcagtctagaaaggcagacatgggatcagctacttctgcattaccagcaggaggccaaggagattctgtcacgagggtcaacagaggctaaaatcactgaggtgaaagttgaaccaatgacttatcttggttcttctcaaaatgaggtcctgaatacaaagccagattaccaaaaaatcctacaaaaccagagtaaggtgtttgactgtatggaattagtcatggacgaactacaaggtagcgttaagcagctccaggcttttatggatgagagcacacagtgttttcaaaaggtatctgtccagttgggaaaaagatctatgcagcagctggatcccagccctgccaggaagctccttaagcttcagttacagaacccccctgccattcacggatccggaagcggcagctgccaatag

SEQ ID NO: 30556 - DNA, 522 bp, Artificial Sequence
  Description of Artificial Sequence: Synthetic coding sequence
atgacacatgtcgcttcccagtttgcttcttcttatgtattttattggcgcgattatttcgaagatcagcctttattatatcctccgggtttcgacggaagggtcgtggtgtaccccagtaatcagacacttaaggattacttaagttggcgccaggcagactgccacatcaataacttgtataatactgttttttgggctcttatccagcaatctgggctaacaccagtgcaggcccagggcaggcttcaggggactctggcagcagacaaaaatgagatcctattttctgagtttaacatcaactacaacaatgaattgccaatgtatagaaaaggaaccgtcctgatttggcaaaaagttgatgaggtcatgacgaaggaaattaaactgccgaccgagatggaggggaagaagatggctgtgacccgcactcgaaccaagcccgttcctctccactgcgacattatcggggacgctttctggaaggagcaccctgaaattctggatgaagactcttag

SEQ ID NO: 30557 - DNA, 285 bp, Artificial Sequence
  Description of Artificial Sequence: Synthetic coding sequence
atggagatggagtcagcagccgcttcaacaaggttccaccaaccgcatatggagcggaagatgagtgctatggcgtgtgaaattttcaatgagctgagattggaaggaaagctttgcgacgtagtgataaaggtgaatggcttcgagttttctgcccacaagaacattctgtgcagctgttctagctacttccgtgcacttttcacaagcggatggaacaataccgagaaaaaagtctacaatataccagggatctcacccgacatgatgaagctgattatttag

SEQ ID NO: 30558 - DNA, 1572 bp, Artificial Sequence
  Description of Artificial Sequence: Synthetic coding sequence
atgaaccagccttgtaattcaatggagcccagagtgatggacgacgatatgttgaagctcgcggttggcgatcaggggcctcaagaagaggcgggtcagctggctaaacaggagggtatcctgtttaaagatgtgctctccctgcagctggattttaggaacatcctgagaatcgacaatctctggcagttcgaaaatcttcggaaactccaactggacaacaatattattgagaagatagagggcttagaaaacctggcccacctggtgtggctggacctcagttttaacaacatcgagacaatcgaagggctggacactctggttaatttagaggatctgagtctgttcaacaacaggatatccaaaatcgactcgctcgacgcgcttgtcaaactccaggtcctcagtctgggcaacaacaggattgataatatgatgaatattatatacctgcgacgcttcaagtgccttcggaccttgagtctgtccaggaaccctatttccgaagccgaggactacaaaatgttcatctgcgcgtacctcccagatctaatgtacctcgattacaggcgaattgacgatcacacaaagaagctcgcagaggccaaacatcagtactcaatcgacgaacttaagcaccaggagaatctgatgcaggctcagttggaggacgagcaggctcagcgagaggagctagagaagcacaagacggcattcgtcgagcacctgaacgggagctttctcttcgactcaatgtatgccgaagactctgagggtaataacttgagttatttgcctggtgtaggtgagctgctggaaacgtataaggacaaatttgtcataatttgtgtgaacatttttgaatatgggctcaaacaacaggagaagcgcaagacggagctggacacgttttctgagtgcgtgagggaagcgatccaggagaatcaggagcagggcaaacgaaaaattgcgaagttcgaggagaaacacctctcctccttatccgccattcgggaggagctcgaattgcccaatatcgaaaagatgattttagaatgctcggccgacatcagtgaactatttgatgccctgatgaccctggaaatgcagttggtagaacagctagaggagactattaatatgtttgagcgcaatattgttgacatggtgggtctctttattgagaacgtgcaatcactgatggcacagtgtcgggatttggaaaatcaccatcatgaaaaactccttgagatcagtatctcaactctggagaaaatcgtggagggcgacttggatgaggatctgccaaacgacctgcgggctctatttgtcgataaggacacgatcgtcaatgccgtcggggctagtcacgatatccatctgctgaagattgataatagggaggacgagctcgtgacgagaataaatagctggtgcaccaggttaattgacagaattcacaaggacgaaattatgaggaatcggaagcgcgttaaagaaatcaaccagtacattgatcatatgcaaagtgagctggacaatttagagtgcggcgatattctggactag

SEQ ID NO: 30559 - DNA, 372 bp, Artificial Sequence
  Description of Artificial Sequence: Synthetic coding sequence
atgggcacaggtgatttcatctgtattagcatgactgggggagctccatgggggttccggctgcaagggggaaaggagcagaagcagccactgcaggtcgccaaaattaggaaccagtccaaagcaagcggcagcgggctttgcgagggcgacgaggtggtttccatcaatggcaatccttgtgccgatttgacatatcccgaagtgattaaactgatggagtccattaccgatagcctacagatgctgatcaaacgccgtgtgggcgctcccttcctttttctcgaagaccaatctcacccgcctttcctccaccttctgggctacacctcattgttgatcgtgactctcgttaaccagcctatggactag

SEQ ID NO: 30560 - DNA, 1146 bp, Artificial Sequence
  Description of Artificial Sequence: Synthetic coding sequence
atgcccctccaggtttctgattatagttggcagcaaaccaagacagctgtgtttctgtctctgcccctgaagggcgtttgcgttagggacacagatgtcttttgtaccgaaaactacctgaaagtcaacttcccgccattcctgttcgaggcctttctgtatgcacctatcgatgacgagagttctaaagcaaagatcggtaatgatacgattgtctttacgttgtacaaaaaagaagccgcaatgtgggaaactctttctgtgacaggggtggacaaggagatgatgcagaggattcgcgagaagtctatcttgcaggcccaggagcgggctaaggaagctactgaagccaaggctgctgccaagcgggaggaccaaaagtacgcactgtctgtaatgatgaagatcgaagaagaggagagaaaaaagattgaagacatgaaggaaaatgagaggattaaggccactaaggctttagaggcgtggaaggagtaccaacgaaaggctgaggagcagaagaagatccaacgcgaggagaagctatgccaaaaagagaagcagataaaggaagagaggaagaaaatcaagtacaagtctctcaccagaaatctcgcctcgcgcaatctggcacccaaaggcaggaactccgaaaatatctttactgagaaattaaaggaagactccatacccgcacctaggtccgttgggagcattaaaatcaatttcacccccagagtgttccctactgctttgcgggagagccaggtggcggaggaagaagagtggctacacaagcaggctgaagcaagacgggcaatgaatacggatattgcagagctgtgtgacctaaaggaggaggagaagaatcccgaatggctgaaagacaaggggaacaaactgtttgctacagaaaactatcttgctgcaattaatgcttataacttagcgatcaggcttaacaataaaatgcctttgctttatcttaatcgggctgcatgtcacttgaaactgaagaacttacataaagcaattgaggatagttccaaagagttctgcagccttgaggggattgagtgtcaggcctccgaaccaaaattgtctcaccacatcccatccgatttacatgtgtatatccaaatggcctag

SEQ ID NO: 30561 - DNA, 615 bp, Artificial Sequence
  Description of Artificial Sequence: Synthetic coding sequence
atggtcatggcggaggggaccgccgtgctccgcagaaacagaccaggcacaaaagcccagtacattcaacaaaacatcagagcagactgctcaaatatcgataaaatcttggaacctccagaaggccaggatgagggcgtatggaaatatgaacacttacgacagttctgtctggagctcaatgggctcgccgtgaaactgcaaagtgagtgccaccccgacacctgtacacaaatgaccgcaactgaacagtggatctttctctgtgccgctcataagaccccaaaggagtgccctgcaatcgactatacacggcatacactagatggagctgcttgcctcttgaattcgaataagtatttcccttcacgagtgtctatcaaagagtctagcgttgcgaaattaggctcagtatgtcgtagaatatataggatcttctcgcatgcatatttccaccacagacaaattttcgacgaatatgagaacgagacattcctttgtcacagatttaccaagtttgtgatgaaatacaatctgatgtccaaggataatctgatcgttcctatactcgaagaagaagttcagaacagcgtgtccggcgagtcagaggcttag

SEQ ID NO: 30562 - DNA, 1293 bp, Artificial Sequence
  Description of Artificial Sequence: Synthetic coding sequence
atggcagccaatctatcccgtaatggccctgccctccaagaggcatatgttcgcgtggtcaccgagaagtctccgaccgattgggccttattcacatacgagggcaacagcaacgacatcagggttgccggaacaggagaagggggactcgaagagatggtggaagagttaaatagcggtaaggttatgtacgctttctgccgtgttaaagatcccaatagcggcctacctaagttcgtcctgatcaattggaccggtgagggagtgaatgacgtgcgcaaaggcgcatgcgcctcccatgtgtctaccatggccagctttctgaaaggtgctcacgtaaccataaacgcacgggcagaggaagatgttgagccagagtgtatcatggaaaaagttgcaaaggcaagtggagcaaactacagcttccataaggagtccggccgatttcaagacgtgggcccacaagcgcctgtcggttctgtgtatcaaaagacaaacgccgtttccgagatcaaacgggttggtaaggatagcttttgggctaaggccgagaaggaggaggaaaatcggcgactcgaagagaagcgtcgcgctgaggaggcccagagacagctggaacaggaacggagagaaagagagcttcgggaagccgctcggagggaacagcggtatcaggagcaaggtggagaagcttcccctcagagaacatgggaacaacagcaagaggtggtctctcggaacagaaacgaacaagagagtgccgtccacccgagagagattttcaagcaaaaagaaagggcaatgtcaactaccagcatatctagtccacagccaggtaaactgaggtcgccttttcttcaaaagcagctcactcagccagagacccacttcggccgagagccagcagcagccatctcaagaccgagggccgacttacctgccgaagaaccagccccatctactcctccatgtctcgtgcaagccgaagaagaggccgtgtacgaagaaccccctgaacaggaaacattttacgaacagcctccactcgtacagcagcaaggagctggctccgagcacatagaccaccatatacaggggcaaggtttaagcggacagggtttatgcgccagggccctctacgattaccaagccgcagacgacaccgaaatcagtttcgaccccgagaatcttatcacggggattgaagtgattgacgagggctggtggagagggtatggccctgacgggcactttggtatgttccccgctaactatgtggagttgatcgaatag

SEQ ID NO: 30563 - DNA, 3189 bp, Artificial Sequence
  Description of Artificial Sequence: Synthetic coding sequence
atggtatcgtcagcacagatgggattcaacctgcaggccttgctggagcaacttagccaggatgaactgagtaagtttaagtacctgatcaccactttctccctcgctcacgagctgcaaaagatacctcacaaagaagttgacaaagctgacggtaagcagcttgtcgagatcctcaccacacattgcgattcctattgggtcgagatggccagtctgcaagtctttgagaagatgcacaggatggacctgtctgagagggctaaggatgaagtccgtgaggccgcactgaaatcctttaataaaagaaaaccgttgtctctcggaatcacacgaaaagaacgaccccctctggatgtagacgagatgctggaacggtttaagacagaagctcaagcttttacagaaacaaagggcaacgtcatttgcctgggaaaagaggttttcaaggggaagaagccagataaagacaatcgctgtaggtacattctgaagactaaattccgagagatgtggaagtcttggcccggagactctaaagaggtccaggtcatggccgaacgctacaagatgctcattcctttttcgaaccccagggtccttccgggtcccttttcatacacggtggtcctttacggccctgctggcttaggcaaaaccactctggctcagaaactcatgctggactgggccgaagataacctgattcacaagttcaaatacgccttttatctgtcgtgcagggagttgtcccggctaggcccatgtagtttcgccgaacttgtcttcagggattggcccgagctccaggatgatatcccccatattctggctcaggctagaaagatcttgtttgttatagatggtttcgacgaacttggagccgctccaggcgctctaattgaggacatatgtggcgattgggagaagaagaaaccagtgccagtactattaggaagcctacttaatagagtcatgcttcccaaagctgctctcctggtgaccacacgcccacgcgctcttagggacctgcggattctcgctgaggagccaatctacattcgggttgaagggtttcttgaagaggataggagagcatatttcttgcggcacttcggcgacgaagaccaggccatgcgtgcattcgagcttatgaggtctaacgccgcactgttccaactcggaagcgcccctgccgtctgttggatcgtatgtacaaccctgaaattacagatggaaaaaggggaggacccagtgcccacctgcttgacaaggactgggcttttcttgcgatttctgtgttctagatttccgcagggagctcagctgcgcggagccctgagaactctgtctttgcttgctgcccagggattgtgggcccagacttctgtgctgcatcgcgaagatctcgaaagactcggggtgcaggaaagcgatttacgactgtttttggacggtgatatcctacggcaggatcgtgtaagcaaggggtgttactcttttattcacctgtcatttcagcagttccttaccgcactgttttatactctcgaaaaagaggaagaagaggaccgggatgggcacacctgggacattggcgacgtgcagaagctgctcagtggggttgagcgactgaggaatcccgatctgattcaggccggatattatagtttcggactggcgaatgagaagagggccaaggaacttgaggcgacttttgggtgtcggatgagcccagacattaaacaagagctgttaagatgcgacatcagctgcaagggaggtcactccacagtgaccgatctgcaggaactgctggggtgcttatacgaaagccaggaggaagagctagtgaaggaagttatggcccaattcaaagaaatctcccttcatctcaacgcagttgatgtagttccctcctctttttgtgtcaaacactgcaggaacctgcaaaaaatgtccctgcaggtgataaaagaaaacttacccgaaaacgttacagcctccgagtcagatgctgaggtggaacgatctcaggatgaccagcatatgctccctttttggaccgatttgtgttcaatcttcggctcgaacaaagatcttatgggcctggcgattaatgactcattcctgtccgcatctctcgtccggatcctgtgcgagcagatcgcatctgacacatgccacttacagcgggttgtattcaaaaacatctcacctgccgacgcccatcgcaacttatgtttagccttacggggacacaaaactgtaacttacttgacactgcagggaaacgatcaggacgacatgttcccagccctgtgcgaagtgttgagacaccctgaatgcaatctcaggtatctgggactggtgtcttgctctgcgacaacccagcagtgggctgatctaagcctagccttggaggtgaatcagtcactcacttgcgtcaacttaagcgacaacgagctcctcgatgagggcgctaagctactttatacaacccttagacaccctaagtgcttcctgcagcgtctgtctcttgagaactgtcaccttaccgaagccaattgcaaggacctggccgctgttctcgtcgtttctcgcgagttaacacatctctgtctggccaaaaatcctatcggaaatactggggtcaaatttctctgcgagggactgaggtatccggagtgcaagctgcaaacactggtactttggaactgtgacatcactagtgatgggtgctgcgatctcacgaagttacttcaggagaaatcttccctgctctgtctggatttgggattgaatcatattggcgtgaagggcatgaaatttctctgtgaggccctgcggaaacctctatgcaacctgagatgcctatggctgtgggggtgttcaatcccccctttctcctgtgaggacctttgtagcgcacttagctgcaaccagagtcttgtgacactggatctcgggcaaaatccattgggttcgagcggggtcaaaatgctgttcgaaaccttgacatgttcttctggcacactcagaacactaagactgaagatcgatgattttaatgacgaactcaacaagctactcgaggagatcgaagagaagaacccacaactcattattgacacggagaaacaccatccttgggctgaaaggcctagttcacatgatttcatgatctag

SEQ ID NO: 30564 - DNA, 390 bp, Artificial Sequence
  Description of Artificial Sequence: Synthetic coding sequence
atggctgaactaatccagaaaaagctgcagggcgaggtggagaaatatcagcagctacagaaggacttgagtaaatctatgagcggaaggcaaaagctggaggctcagctgaccgaaaacaatatcgtaaaggaagagctggccctgctagacggctccaacgttgtttttaagcttctcgggccagttctggtcaagcaggagctcggagaggcccgagcaacagtcggaaaacgcctggactacattaccgcagagatcaagcggtatgagtcccaactgagggacctggagagacagagcgagcagcaaagggagactttggcacaacttcaacaagagttccagagagcccaggccgcaaaggccggtgctccgggaaaggcgtag

SEQ ID NO: 30565 - DNA, 516 bp, Artificial Sequence
  Description of Artificial Sequence: Synthetic coding sequence
atggaggtggcagagccatcatcacctacagaggaggaagaagaagaggaagaacactctgcggaacctcggccaaggacgcggtccaaccccgaaggggcagaagatcgggctgtgggtgcccaggcttccgtgggctcacgcagtgaaggcgagggtgaggccgcatctgcagatgacgggtcgttaaatacctccggcgctggacccaaatcatggcaggtgcccccaccagccccagaggtccagatccgtactcctcgggtcaattgccctgagaaagtcattatctgcctggacctctcagaggagatgagcttgcctaagttggagtctttcaacggccagcaaaaaaccgaactgcctgttaccgagaacgtccaaaccattccacccccttacgtggtccgaaccatcctcgtctacagtcgtccaccatgtcagcctcagttttcactaacagagcccatgaaagttggggaagcatgggagagggaaggctgtctccagccatag

SEQ ID NO: 30566 - DNA, 1446 bp, Artificial Sequence
  Description of Artificial Sequence: Synthetic coding sequence
atggcctctgctgcctccgttaccagcttggccgatgaggtgaattgccctatctgtcagggtacgctcagggagccagtgacaatcgactgcggccacaacttctgcagagcatgtctgactagatactgtgaaatacccggacccgacctagaggagagcccgacttgtcctctgtgtaaggagccttttcgccctgggagtttcaggccaaactggcaactcgctaacgtggttgaaaatatcgaaaggctgcaattggtcagcaccctgggcctcggggaagaggacgtgtgccaggagcacggcgagaaaatctattttttttgcgaggatgacgaaatgcagctgtgtgtggtttgtcgcgaggctggggagcatgcaacacacaccatgcggttcttagaagacgccgctgcaccctatcgcgagcagattcacaagtgcttaaaatgtctgcggaaggagagggaagagatccaggagattcagtcacgcgagaataagcgcatgcaggtgttgctgactcaggtttcgacaaagagacagcaggtgatcagtgaattcgcccacttgcgaaagtttctggaggagcagcagtctattctgttggcccagttggagagtcaggacggcgatatattaaggcagcgtgatgaatttgaccttttggttgcaggcgagatttgcaggtttagcgcgttgattgaggaattggaggaaaaaaacgaacgacccgctcgagagcttctgacagacattaggtctactctaataagatgtgagacgagaaaatgtagaaaacccgtggccgtctcccctgagttgggacagcgcattcgagatttcccacagcaggccctccctctgcagagagagatgaaaatgtttctggaaaaactctgcttcgagttggattatgaaccggctcacatatccctcgacccgcagacttcacatcccaaactgctgctttctgaggaccatcagcgagcccaatttagttacaagtggcagaattctcccgacaacccacaaaggtttgaccgcgcaacatgtgttctcgcgcacaccgggattacaggtggcaggcatacttgggttgtttcaattgatctggcccacggcggttcctgtaccgtgggcgtggtaagcgaggatgtacagcggaagggcgaactccggctgcgacctgaagagggggtgtgggccgtaaggctcgcatggggctttgttagtgcattaggcagcttcccgaccaggttaacccttaaagagcagcccaggcaagtccgcgtgtcactggattatgaagttggctgggtaacgttcaccaacgccgtgaccagagagccaatatacactttcacggcttcttttacgcgcaaagtaatcccattcttcgggctctgggggcgtgggagttcgtttagtttgagcagttag

SEQ ID NO: 30567 - DNA, 1986 bp, Artificial Sequence
  Description of Artificial Sequence: Synthetic coding sequence
atgaataccgggcgagactcacagagtcctgactctgcctggcggtcctataatgacgggaatcaggaaacactgaatggagatgcgacttattcctcattggctgccaagggttttaggtccgtcagaccaaacctacaggacaagcgctcgcccacccagagccaaatcaccgttaatggaaatagtggtggggctgttagccctatgagttattaccaacgcccattttccccctccgcctactccctgccggcatcattgaattcaagcatcgtaatgcagcatgggacttcactcgattccaccgacacatatccacagcacgcccaaagtcttgacggaacgacatcgtcctcaatcccgctgtaccgcagcagcgaggaggagaagcgagtgacagtaatcaaggccccacactaccccggaattgggcctgtggatgagagcggcattcctaccgcgataagaaccaccgtcgatcgacctaaggactggtacaagacaatgttcaaacagattcatatggtgcataaaccagatgatgatactgatatgtataacactccctacacatacaacgccggattatacaaccccccatactctgctcaatcccatccagccgctaagacccagacatacaggccactgtcaaaatctcattctgacaattcacccaatgccttcaaagacgccagcagtcctgtgcctccccctcatgtcccaccacctgtgcccccattaagacccagggatcgttcctctacggagaagcacgattgggacccccctgacaggaaggtcgatacccgaaaattcaggagtgagcctaggtccattttcgagtacgaaccaggtaagtcatctatcctgcagcacgagaggcctcccccaaagaagcctcttgactatgtgcaagatcattccagcggggtgtttaatgaagccagtctgtatcagtcatccatagatagatcacttgagaggcccatgtcctcagccagcatggcatccgatttcagaaagaggcgaaagtcagaacccgcagttgggcctcctcgcggactgggtgatcagtccgcttctagaactagtcctggaagggtggatctgcctggatcaagtaccacccttaccaaatcattcacaagttctagtccctcgtcaccatcccgggcaaaagatagagagtccccgcgtagctactcttccaccctgacagatatgggcaggtcagcccctcgcgagagaagagggactcccgagaaggagaagctccccgctaaggcagtttacgactttaaggcccagacaagcaaagagctatcattcaaaaagggagataccgtctacatattgagaaaaatcgaccagaactggtatgagggcgaacatcacgggcgtgtgggaattttccccatttcttacgtcgaaaaactgaccccccctgagaaggcccagcccgctaggccacccccacctgcgcagcccggagagatcggtgaagcgattgccaagtataactttaatgcagacaccaatgtcgagctatcactccgaaaaggagatagagtgatccttctgaagcgggttgatcaaaactggtacgaaggaaagattccaggtaccaacagacaggggatctttccagtctcatacgtcgaggtcgttaagaaaaacactaaaggggcagaagattatccagacccgccaattccgcactcttatagctcagatagaatccacagcctgtccagcaacaaacctcagaggcccgtgtttacacacgagaatatccaggggggaggggaacctttccaggccttgtataactatacacccaggaatgaggacgaactcgagctgcgggagagtgacgttatcgacgtgatggaaaagtgtgatgacgggtggtttgtgggtacatctcggagaactaagttcttcggcaccttccctgggaactacgtgaagaggttgtag

SEQ ID NO: 30568 - DNA, 483 bp, Artificial Sequence
  Description of Artificial Sequence: Synthetic coding sequence
atggaggcggaaaggcctcaagaagaggaagatggcgaacaggggccacctcaggacgaggaaggttggccacctcccaattccacaacacgcccatggaggagcgcaccaccgtctccccctcctccaggtacccggcacaccgcactgggacctcgatctgcctctttgctatcgctacagaccgagcttctgctagacttggttgccgaggcacagagtcgtagactggaagaacaaagggcaactttctacaccccgcagaatccttcatcgctggcgcctgcaccactgaggcccctcgaggacagagagcaactgtactctaccatcctcagccaccagtgtcaacggatggaagcacagcggagcgaaccacctctgccacctggaggacaagagctgctggagctcttgcttagagttcaggggggtgggcgaatggaggagcaaagatctaggcctccaacgcacacttgttag

SEQ ID NO: 30569 - DNA, 717 bp, Artificial Sequence
  Description of Artificial Sequence: Synthetic coding sequence
atggattgtagagagatggacctctatgaagattatcagtcaccttttgactttgacgcaggagttaataaatcctacctgtatctgtcacccagcggaaattcgagtccacctggttctccaactctccagaagttcggcctcttgcggactgaccccgtcccagaagaaggggaggacgtggcagccactataagtgccactgagaccctgtcggaggaggagcaagaagaactgagacgggaactagctaaggtcgaggaggagatccagactctaagccaagtgcttgctgcgaaggagaaacacctagcagaaataaaaaggaagttgggtattaattcactccaggagctgaaacagaatattgccaaagggtggcaggatgtgacagctacctcagcttataagaaaacaagcgaaaccctgagccaggcgggtcagaaggcttccgccgcattctcatcagtgggctctgtgattacaaaaaagctggaggacgtgaatatcaggagcatccagcatagcattagcatgccagctatgcggaattcacctacttttaagtccttcgaggagaaagtggaaaatctgaagtctaaggtcggtggaactaagcccgcagggggtgacttcggagaggttttaaacagtgcagccaatgctagtgctacaactactgaacccttacctgagaaaacacaagagtcactctag

SEQ ID NO: 30570 - DNA, 108 bp, Artificial Sequence
  Description of Artificial Sequence: Synthetic coding sequence
atgcaaacatctagctcaaggagtgtccacctgtccgagtggcagaaaaattacttcgccattacttctggcatctgtactggacccaaggccgacgcctacagatag

SEQ ID NO: 30571 - DNA, 327 bp, Artificial Sequence
  Description of Artificial Sequence: Synthetic coding sequence
atgacccggggaaatcagagagaactcgctcggcagaagaatatgaagaagcagtccgattccgtgaaaggtaagcgaagggatgacggcttaagcgcggctgccagaaaacagtcagcgatcacttcatctcgcaatttcctgtatcctgcatatgtctactttccatcatcagtgccgagcccgcctaggaaatacacacaaacttattacgctgctgtgccggcaggatggtggggcagcggcggaggcccagcaacccagccggcagcgggtggcaggtggagatttcttcatattcttggcacacagccccagagtcactag

SEQ ID NO: 30572 - DNA, 846 bp, Artificial Sequence
  Description of Artificial Sequence: Synthetic coding sequence
atgggagctggtaatctgccccctattacacaggaggaagctctgcacatcctcggatttcagccaccgtttgaagacattaggtttggaccttttactggcaacacaacattgatgagatggttccgacaaatcaatgatcacttccacgtcaaaggatgcagttatgttctgtacaaaccacacggcaagaataaaaccgccggagagacagcctccggggctttaagcaaactgaccaggggactgaaagatgaaagtttggcatatatctatcactgccagaatcattacttctgtccaatcgggtttgaagccacgcccgtcaaggccaataaggcgttttcccggggacctctgtctccacaagaggtcgaatactggatcctcatcggggagtcaagcagaaagcaccccgcaattcactgcaaaaagtgggcagacatagtgaccgatctaaatactcagaaccccgaatacctggacatcaggcacctggagaggggtcttcagtacaggaagaccaagaagcccacatttttctcatctcaggtcgggggaaacctccactgtattatcgcttttcagcgcctgaactggcagcgctttgggctgtggaactttccgttcggtaccatacgccaagaaagtcagccaccaacccacgctcaggggatagctaagtccgagagcgaagataacatctccaagaaacaacacggcagactaggtagatccttctcggccagctttcaccaggactctgcctggaaaaagatgagtagcatacatgagagaaggaattccggttaccagggttacagcgattacgacgggaacgactag

SEQ ID NO: 30573 - DNA, 213 bp, Artificial Sequence
  Description of Artificial Sequence: Synthetic coding sequence
atgagagcattgacggtacagcgcgtgaagtttgccatggaccttcccctgctcaagcgcgctgggcaggacttagctgagaaaaccaagaattttgttagccgatccttggtgatcggggaagttttgtccatggcggacatggctaccggggtcaaatgtgggattatttactggctttttggaggagctatccgaaatctgggctcttag

SEQ ID NO: 30574 - DNA, 1644 bp, Artificial Sequence
  Description of Artificial Sequence: Synthetic coding sequence
atggcaggtacaaagaataagaccagggcccaagccaagaccgaaaagaaagccgcaattcaagcgaaggccggtgccgagcgggaggcaactggagtggtcaggcctgtggctaaaacgcgggctaaggctaaggccaaaacgggctcaaaaacagatgccgtcgccgagatgaaggctgtttcaaaaaacaaagtggtggcggagaccaaggaaggcgctctgagcgagcccaaaaccttaggtaaggccatgggagattttacaccaaaggcaggcaatgagagcaccagctctacatgtaaaaacgaagcaggtaccgatgcttggttttgggccggagaggaagcaacaatcaattcatggttttggaacggggaggaagccggtaacagtttttcaacaaagaacgacaaacctgagattggtgcgcaggtctgtgccgaggagctggaacctgccgctggcgctgattgcaaaccaagatccggggctgaagaggaggaggaggagaacgtgataggcaactggttttgggaaggcgatgacacctcttttgatcctaatcccaagccagtgagtagaatcgtgaagccgcaacccgtgtatgagattaatgagaagaatcgtccaaaagattggtcagaggtcaccatatggccgaatgccccagcagtgactcctgcggtattaggattccgaagccaggctccaagcgaggcaagccctccatcttatatcgttcttgccagcgctgaagagaacgcctgttcattgccagtggctactgcttgtagaccctcaaggaacacaaggagctgttctcagccaatccccgaatgcagatttgactcggatccgtgcattcaaactatagatgaaattcgtagacaaattcgaatcagggaggtcaacggcatcaaaccgttcgcatgtccttgcaagatggaatgttacatggacagcgaggagttcgagaagttggtctcactgctgaagtccacaacagacccactgatacacaagattgcccgaatcgccatgggagtccataacgtgcacccttttgcccaagaattcatcaatgaagtgggagtagtcacactgattgagtcgctcttgtcatttccatcccccgagatgaggaagaagacagtgattaccctgaatcctcctagcggggacgagcgacagaggaaaattgaactgcacgtgaagcacatgtgtaaggaaacgatgagcttccctctcaacagcccgggtcagcagtcaggccttaagatattgggccagttaacaacagattttgtgcaccattacattgtggcgaactacttcagcgaattatttcatctcctgagctctgggaactgtaaaactagaaatctggtgctcaaactgctgttaaacatgtctgagaatcccactgccgctagggacatgatcaacatgaaagccctggccgcacttaaattgatcttcaatcagaaggaggccaaggccaatcttgtatccggtgtggccatattcattaacattaaggaacacatccggaaaggctcaatagttgtggtcgaccatctgtcttataataccctcatggctatatttagggaggtgaaggagatcatagaaactatgtag

SEQ ID NO: 30575 - DNA, 489 bp, Artificial Sequence
  Description of Artificial Sequence: Synthetic coding sequence
atgtcttataactgctgtagccggaatttttcctcgtgttctcacgggggatacctccactatcctggctcctcttgtggctcgtcataccctagtaacttggtttacagtacagacctatgtagcccttctacttgccagttaggtagttcactgtaccggggttgccaggagacatgttggcggccaaatagttgccaaaccttttgttactacccacggacccatatgttgtgcaacagttgccttactatgcatgtgggtagcagagggttcggctctaattcttgttgcagccttagctgtgggtcacgcagctgcagctctctgggatgcggttccaatgggttccgctacttgaactaccgcattcacaccagtccatctcagagttataggagcagattctgccaccccatctactttcctcccagaaggtggttccacagctcctgttaccaacctttttgtcgctctggcttctattag

SEQ ID NO: 30576 - DNA, 495 bp, Artificial Sequence
  Description of Artificial Sequence: Synthetic coding sequence
atgttcatctcattttatgactttaagaacatcccccaagatagtcgatgtgacgggcagctgttcattaacggccgaaataataagaacaactcaatctccctctacttccaggggggactgcggcacgctagcgcgtctataggcggaagcgaggcgtataggcatatgaaattcgagggcggtgtgcatcgcgtgcaacgagtccctaagacggaaaagcaggggagagtacacacatcgactatgactgtggcaatcctgccgcagccgaccgagataaatttagtgattaaccccaaagacttacgtatcgatacaaaacgagcaagcggcgctggtggccagcatgtcaatacaacggattcggccgtcaggatcgtgcaccttcccacaggtgtagttagcgaatgtcagcaggagcggtctcaattaaagaataaggaactcgcaatgaccaaattgagggccaaactgtatagcatgcatctgtag

SEQ ID NO: 30577 - DNA, 2166 bp, Artificial Sequence
  Description of Artificial Sequence: Synthetic coding sequence
atggaagaggagctcaagtgtcccgtctgcgggtcactctttcgcgaacccattatcctgccctgctcgcataatgtctgccttccgtgtgcgcgtaccattgccgtgcaaacacctgacggaggatcagccgctggaggtctgggtggaggagccggaggcggaggtgaccatgccgataagttaagcctttacagcgaaactgactccggctacggaagctataccccaagcttaaaaagccccaatggggtaagagtactcccaatggtgcccgcacctcctggatctagtgccgctgcagctcgcggtgccgcatgcagtagcttaagcagctcatcatcttcgataacatgcccccaatgccatagatccgcctccctggatcacaggggccttagaggcttccagcggaacaggttactggaggccattgtgcagcgataccagcagggtcgcggagctgtccccggaacgagtgccgctgcagccgtcgccatctgccagctttgcgaccggaccccaccagagcccgctgcgacgctctgtgaacagtgcgatgtactttactgttctgcctgccagcttaagtgccatcccagtagggggccattcgcgaagcatagactgggagctcccagtggcggtggcggatgtaagagcccagggggagctggggcaggagcgaccggcggatctaccgccagaaaattccccacttgtccagagcatgaaatggagaactacagtatgtattgtgtctcctgtcggaccccagtgtgctatctctgcctcgaggagggtcgacatgccaaacacgaggtcaagcccttgggagccatgtggaagcagcataaggcccagctgtctcaggctcttaatggggtttccgacaaggccaaggaggccaaggagttccttgtgcagctcaaaaacatccttcaacagatacaggaaaacggactggattacgaagcttgtctggtcgcccaatgtgacgcgctcgtagacgctctaactaggcaaaaggcaaaattactgaccaaggtcaccaaggaacgcgaacataagctgaagatggtgtgggaccagatcaaccactgtacactcaagctcagacagagcactggtctgatggaatactgcctagaggttattaaagagaacgacccttccgggtttctgcaaatctcagatgcattgataaaacgcgtacaggtgagccaagaacagtgggtgaagggagcgctggagccaaaagtgtccgccgagttcgacctgacactcgacagtgaacccttactccaggcaatccaccaacttgactttattcaaatgaagtgcagggttcctcccgtgcctctgctgcagctggaaaagtgctgcaccaggaacaacagcgtaacactcgcttggcgcatgcccccttttacccatagcccggtggacggctatattctagagctagacgacggggcaggaggtcagttcagggaggtttacgttggaaaagagaccctgtgtacaattgacggtttacatttcaatagtacctacaacgccagagtgaaggcatttaactccagcggtgtcggcccatacagcaaaacagttgtgttacagacgagcgatgtcgcgtggtttaccttcgaccctaattcagggcatcgtgacataattctgtccaatgataatcaaaccgctacgtgctcttcttacgacgaccgggtcgtgctgggaaccgctgccttcagtaagggtgtacactattgggaattgcacgtggaccgttacgataatcatcccgatcccgcattcggagtggcgagagcaagcgtggttaaagatatgatgcttggcaaagatgataaagcctgggccatgtacgtcgacaacaatcggtcttggttcatgcactgcaactctcacaccaatcgcacagaggggggagtgtgtaagggggctactgtcggcgtcctgctggatcttaataagcacaccctcacatttttcattaatggccagcaacaagggccaaccgcattttcccatgttgatggcgtatttatgccagctctgtcactgaatagaaacgtccaggtaacgctccacaccgggctggaggttcccaccaacttgggtaggccgaaattgagtggaaactag

SEQ ID NO: 30578 - DNA, 1479 bp, Artificial Sequence
  Description of Artificial Sequence: Synthetic coding sequence
atggattttctgctgggtaatcctttttcatctccagtaggccagaggatcgaaaaggccacagacggttccctgcaatcagaggattgggcccttaacatggagatttgcgatattatcaacgaaactgaggaaggacccaaggacgcacttcgggcagtaaaaaaaaggatcgtgggcaataaaaacttccacgaggtcatgctggctttgacagtcctggaaacttgcgttaaaaattgtgggcatcgctttcatgtgctcgtggcgtcccaagatttcgtcgagtccgtgcttgttaggaccatcctccccaagaataacccacctaccattgtgcacgacaaagtcctgaaccttattcaaagctgggccgatgcgttcaggtcctcccccgatttaactggcgtcgttactatttacgaggacctgagacggaagggacttgagttccctatgactgatttggacatgttgagcccaatccacactccacagagaactgtctttaacagcgagacacagtcaggccaggactcagtgggtacagacagttcccagcaggaggactccggtcagcatgccgcacctctccctgcccctcccattctgtcaggggacacccccatagcccctactcctgagcaaataggcaagttaagatccgagttggaaatggtgtctggcaatgtgagggtgatgagtgagatgctcactgagctggtgcccacccaagctgagcccgcagacctggagcttttgcaagaactgaaccgcacttgtagagccatgcaacagcgcgtgttggagcttattccgcaaattgccaacgagcaattgaccgaagagctgcttattgttaacgacaatttgaataatgtctttcttcgacatgagcgatttgaacgattccggacaggccagacgacaaaggcgccatccgaggctgagccagccgctgaccttatcgatatggggcctgatcccgcagctactggaaacttgagttctcaactggctggtatgaacctgggaagcagtagtgttcgtgccggactccagtcattagaggcttctggtcggttggaagatgagtttgatatgttcgctctaacgcgcggttcctctttggcagatcaaagaaaggaggtgaaatacgaggctccccaggcaacagacggactggcaggagccttggatgccaggcaacagtctaccggcgcaatccccgttactcaggcctgtctaatggaagatatcgagcagtggctttcgacggacgtcgggaacgatgccgaagagccgaagggcgtgacctctgaggagttcgacaaattcctggaggaacgcgctaaggccgctgataggttgcctaatctcagcagtccctctgcggagggaccgcctggtccgcctagcgggccagccccaagaaagaagactcaagagaaggatgacgatatgctgttcgcgctgtag

SEQ ID NO: 30579 - DNA, 747 bp, Artificial Sequence
  Description of Artificial Sequence: Synthetic coding sequence
atggccacatctgctccattgcgctcccttgaagaagaagttacctgttccatatgtctggactatctgagggaccccgtgacaatcgattgtggacatgtgttttgtaggtcttgtacaaccgatgtccgcccaatatcgggatctcgtccagtctgccctttatgtaaaaagcccttcaagaaagaaaacatcaggcctgtgtggcagctggcgtccttggtagaaaacatagaaagactcaaggtggacaaaggacgccaaccgggagaggtaactcgtgagcagcaggacgctaagctctgcgagaggcaccgcgagaagctgcattattactgtgaggatgacgggaagctgctatgtgtgatgtgccgcgagtccagagagcacaggcctcatactgccgttttgatggaaaaggccgctcagcctcaccgggaaaaaattctcaatcacttatctactcttaggcgggatcgcgataagatccaggggttccaggcaaagggggaagccgacattctggcagctttaaagaagctacaggaccagaggcaatacatagttgcagagttcgaacagggacatcagtttctgcgcgagcgcgaagagcatctcctcgagcaactggccaaacttgaacaagagctgacggaagggagggagaaatttaagagccgaggggtgggggagttggctcggctcgcccttgtgatttccgagctcgagggtaaagcacagcaatag

SEQ ID NO: 30580 - DNA, 21 bp, Artificial Sequence
  Description of Artificial Sequence: Synthetic coding sequence
atgtccaggaggcgtttctag

SEQ ID NO: 30581 - DNA, 165 bp, Artificial Sequence
  Description of Artificial Sequence: Synthetic coding sequence
atgagtgagcagggtgacctcaatcaagctatagccgaagaagggggaacggagcaggagacagctacccccgagaatgggatcgtgaagtctgagagtctcgacgaggaagagaagctcgagctccagcgccgattagaggcccagaaccaggaaaggcgctag

SEQ ID NO: 30582 - DNA, 1446 bp, Artificial Sequence
  Description of Artificial Sequence: Synthetic coding sequence
atggcctccgcagcttctgtcacatcactggccgacgaggtcaactgtccaatttgccaggggacactccgggagccagtgaccattgactgtggacataatttctgtagggcgtgtctcacgcggtactgtgaaattcctggccctgacttagaggaatctcccacctgtcctctgtgcaaagagcctttccggcctgggtctttccgcccaaattggcagcttgcaaacgtagtggagaacattgagcggctgcaactggtcagcactctgggactgggcgaagaagatgtgtgccaggagcatggcgagaagatttattttttttgtgaagacgatgaaatgcagctctgcgttgtgtgccgggaagctggcgagcacgccacacacaccatgcggttcttggaggatgcagccgcaccctatcgagagcagattcataagtgcctgaagtgcctgcggaaagagcgcgaggaaattcaagagattcagagcagggagaataagagaatgcaggtgctgcttacccaggtctccaccaaaagacaacaagtcattagcgagttcgctcatctccggaagttcttagaagaacaacagtctattttactcgcccaattagagtcgcaggatggggatattctgaggcagagagacgagtttgaccttctggtggccggagaaatatgtagattttctgcactgatagaagaactcgaagagaagaacgaaagacccgcacgcgaactacttacagatatacgcagtacactgatcaggtgcgagaccaggaagtgccgaaagcccgtggcagtgagccccgaactgggccaacggataagggacttcccccagcaggcccttcctctgcaacgtgaaatgaagatgttcctagagaagctctgtttcgaattggattacgaacctgcccacatctcgcttgatcctcaaacctcccacccgaaactgctcctcagtgaggaccaccagcgggctcagttttcctataaatggcagaatagcccagataatccacaaagattcgaccgggcaacatgtgtcctggctcacacaggaattacaggcggaaggcacacatgggtcgtcagcatcgatctcgcacacgggggaagctgtaccgtgggagtagtatctgaggacgttcaaaggaaaggagagcttcgtctcaggccagaggaaggggtgtgggccgttcggctagcctggggatttgtatccgcgttggggtccttcccaacacgcctcactctcaaagaacagccgagacaggtgcgagtttccctcgattacgaagtaggctgggttaccttcaccaatgccgtcacacgtgagcctatctatactttcacagcttcttttacccggaaagttatacccttcttcgggctgtggggacggggttcttcatttagcctgtccagctag

SEQ ID NO: 30583 - DNA, 312 bp, Artificial Sequence
  Description of Artificial Sequence: Synthetic coding sequence
atgggacagcagtcttcagttagacgccttaagaggagcgtgccttgcgagagtaacgaagccaacgaagccaacgaggcaaataaaaccatgcctgaaaccccaacaggagatagcgaccctcagccagctcctaagaagatgaaaactagtgagtctagcaccatccttgtcgtacgttataggaggaatgtgaagcggacctcccccgaggaactcgtgaatgaccacgcaagggagaacagaatcaatccggaccagatggaagaggaggaattcatcgagatcacgactgagaggcccaagaagtag

SEQ ID NO: 30584 - DNA, 2919 bp, Artificial Sequence
  Description of Artificial Sequence: Synthetic coding sequence
atggagcgtatgaactggctgtcacgtctggcttccagggggccaggccataggataccccaaggcgcaaatttgcagactcccgtcatggctgacccagagacttgcctgatggtattcaaaaaccattggtcccaggtggtacgaatcttggagagacagggcccacgcgcagcacccggaggcgcagatgaccttagtgctgttcggaatcacacataccaaatgttaactctactggctgaagatagagccgtgccctccgctcccaccggtcccggaccactgcttgagttcgcattacatgaggatctccttaccagggtgctcacgtggcagcttcagtgggacgagctgggcgacggcgtggaagaaagacgagccgagcagctaaaactgttcgaaatgcttgtgtctgaagctagacagccccttctgcgtcacggccctgtgcgggaggccttgctgacattacttgatgcttgcggcagacccgtgccttcgtcacccgctctggacgaaggactagtgctgctcctatcacagctgtgcgtgtgcgtggcccaggaaccgtccctcctggagttcttccttcaacctcctccagagcccggagccgctcctagactgctcctattcagcaggctcgtgccgttcgtgcaccgggaaggcactctcggacagcaggcaagagacgccctcctgcttctcatggcactatcagcaggatctcccaccgtcggacgctatattgctgatcacagttatttctgtcctgtgctggccactgggcttagtgctctgtactctagtctgccgcgaaagatcgaagttcctggtgatgattggcattgcctacgaagggaggattggctgggcgttcccgcattagctctgtttatgtcgtccctggaattctgcaatgccgtcatacaggtggcacatcccctggtccagaagcagttagtggactacatccataacggatttctggtgcccgtaatggggcctgctctgcacaagacctccgttgaagaaatgattgcatccaccgcctacctggaactgttccttaggtctatctcagagccagctctgcttcgtacattccttagattcctcctgctgcatagacacgacacccatacaatcttagacactctggtagcgcgtattgggagcaacagcagactgtgtatggtgtccctgtccttgttccggactcttctcaatctgagctgcgaggatgtcctcctacaactggtgctccggtatctcgtgccctgtaaccatgtaatgttaagccagaagccagctgtacgggatgttgacctttacggaagggccgcagacaaattcctctctttgatccctcgttgttgtagacaccacgccccaagtcctccacgccctgaacatgccagctgggctcgcggaccaggctctccttcagtggattcatctagtgttaccaccgtgccgagaccgagtacgccctcccgcctcgccctttttcttcgccagcagtctctgggtggcagcgaatcgcctggacccgcaccctgtagcccagggctgagtgcaagtccagccagctcaccaggacggaggccaacccccgcagaagaacctggagagctggaggacaattacttggaatacctgcgcgaggctagacgaggcgtggatcgatgtgtaagggcctgtcgaacatggagcgcaccatacgatggtgagagaccgtcccccgaacctagtcccttcggaagcagaaccaagaaaagatctcttctgcctgaagaggatagaaacaacgtcggcgaaggcgaagaggaagaactcggcagaagaggccgtgcaggtggcgcaggggagggaccaggacatctacctcccccacagctaaacggtgtgcctggaagctggcccgagggagcaaaaaaggtgaggctcgttcctaaggagggcgctggggagctcctggaaggtatcagtgaaggcatggccggtctcgagggattcgggcaagaattgagggaattggaggtggcactcagcaatggcggtacaggatcagagagtcccttggagcctccactgccactcgaggaagaggaggcttatgagtctttcacctgcccacccgagccccctggcccatttttatccagcccattacgtacactgaatcagttgccatcgcagccattcaccgggcctttcatggcggtactgttcgccaaactggaaaacatgctacagaacagcgtgtatgtaaattttctgctgaccggccttgtggcacagctggcatgtcacccccagccactactacggtccttcctgctgaacaccaatatggttttccaaccctctgtcaaatctctcctacaggtgctggggagcgttaagaacaagattgaaaactttgctgcttctcaggaagacttcccagccctcctgagcaaggctaaaaagtacctgattgccagaggcaaacttgactgggccgaaggcccagctgctggccctgcacccagacgcagcgacccgctcgtcaaaagccgacgaccatccctgggagaactactcttgagacatgcacatagtccgacccgggctcgtcaggccgcacaactcgtcctgcaaccaggaagggatggcgcaggcctgggcctgagcggtggcagcccaggagcaagcacccccgtactattgactaggggcggagccccagagcgccagggagaggcgctgcgtgtgaaaaacgccgtctattgcgctgtcattttccctgagtttcttaaggaactggctgcaatcagccaagcacatgctgttacctcccctttcctcctagaaactagcgaggaaggtagcgggcctttgatcagcggctgcggacctctgaatccttag

SEQ ID NO: 30585 - DNA, 1929 bp, Artificial Sequence
  Description of Artificial Sequence: Synthetic coding sequence
atgaagatcttttgctccagggccaacccaactactggaagcgtggagtggttagaggaggacgaacattacgattatcatcaagagatagccagatcctcttatgccgacatgctgcacgataaggatagagttttcaagcccatggctgatgctgctgtgaaaattgtggagaaaaacggattctctgataaaatcaaagtgatcaataaacacagcacagaggtgaccgtgggcccagagggcgatatgccgtgcagggcaaatatcctagtgacagaactgttcgacactgaacttattggcgaaggagctctgccgagttatgaacacgcacataggcatctcgtggaggaaaattgtgaggctgtgcctcaccgcgcaacggtgtatgcacagctagtagagagcggccgtatgtggagctggaacaaactgtttcctatccacgtgcaaacatccctgggcgaacaagtcatcgtgccccctgtagacgttgagagctgccccggagcaccctccgtgtgtgatatccagctcaaccaagtgtcccctgctgactttactgtcttatccgatgtgcttcccatgtttagtattgacttttccaagcaggtgtcatcctctgcggcatgtcatagcagaagattcgagcccctgaccagtgggagggcccaagtagtattaagttggtgggatatcgagatggaccccgaagggaaaataaaatgcactatggccccattttgggcccactcagacccagaagagatgcagtggcgcgaccactggatgcaatgcgtgtactttttacctcaggaagaaccagttgtgcaggggtcagcactttacctggtcgcccaccacgatgactactgcgtttggtattctcttcagaggacctccccagagaaaaatgagcgggtgcgccagatgaggccggtgtgtgattgccaagcacacttgttgtggaatcgcccaagattcggcgagattaacgatcaggaccgtaccgacagatatgtccaggcactgcgtaccgtcctcaagcctgactctgtgtgtctgtgcgtgagcgatgggtcgctactgagcgtgcttgcccaccacctcggcgtggagcaagtctttactgtagaaagctccgccgctagccataagttactcagaaagatttttaaggctaatcacctggaggacaagatcaacatcatcgaaaagagaccagagctcttgacgaatgaggacctgcagggccgtaaagtaagcctgctgttaggcgagcctttcttcactacatctcttctgccatggcacaacctctacttctggtacgtccgtaccgcggttgatcaacacctgggaccaggagcgatggttatgccgcaggcagccagtctccacgcggttgtggtcgagttccgggatctgtggaggattcgaagcccatgtggggattgtgaggggtttgatgtgcacattatggacgacatgattaaacgtgcactcgatttcagagaaagccgggaggccgagccacaccccctctgggagtatccttgtagatccctgtctgaaccttggcagattctaacgtttgattttcaacagcccgtgccgctacagcctctgtgtgctgaaggcaccgtggagctccgacgcccaggccagtctcacgccgctgtcctgtggatggaatatcaccttaccccagaatgtactctttcaacgggactgctggaacccgcagatcctgaaggtggctgctgttggaatcctcactgtaaacaggctgtgtatttcttcagtcctgcccctgaccccagggcattgctgggagggcctagaacagtatcatatgcggttgaatttcatccagacacaggcgacattatcatggagttcagacatgctgacactcccgactag

SEQ ID NO: 30586 - DNA, 1935 bp, Artificial Sequence
  Description of Artificial Sequence: Synthetic coding sequence
atgagtgtgacccttacatccgtaaaacgggtccaatcctctccaaatctcctggccgcagggagagactcgcagtcaccagattctgcctggcgcagctacaacgacggcaaccaggagaccttaaacggtgacgctacctatagctcactggccgcaaagggatttcgctcagtccgccctaatctccaggacaaacgaagtccaacccagtcccagatcacagttaatggaaattccggtggtgctgtgagcccgatgtcttactatcaaaggccattctctccctccgcatattccctgccagcctcattgaactcatcgattgtgatgcagcacggcacaagcctcgattctacagatacctacccacaacatgcacaatctctcgacggcaccactagctcctcaatacctctgtacaggtcaagcgaagaggagaagcgtgtcacggtcatcaaggcaccgcattatccaggaattggccctgtggacgagtctggaatccctacagcaattcggacgacggtcgaccgcccaaaggactggtacaagactatgttcaaacagatacatatggtacacaaaccaggtctctacaatccaccatacagcgcccagtctcatcctgcggcaaaaacgcagacctacaggcctttgtcgaagtctcattccgataactctcccaatgcgttcaaagacgcctcatctccagtgccgcctcctcacgtgccgcctccagtgccccctctcagaccaagggatagatcatccaccgagaaacacgattgggacccaccggacagaaaagtcgacaccagaaagttccggtccgaaccccgttcaattttcgaatacgaaccaggtaagtctagtatcttacagcatgagcggccagcatcactgtaccaatctagcatagataggtccctggaacgaccaatgtcaagtgcaagcatggcgtcagacttcaggaaaaggcgcaaatcagagcctgccgtggggccaccgaggggactgggcgaccagtctgcctctcgaacatctccaggtagagttgatctgcccggaagctccacaaccttgaccaaatccttcacctcttccagtcccagctcaccaagtagggcaaaagaccgggaatcaccacggagctactctagcacactgaccgacatgggcaggtccgctccgcgagagcggagaggcaccccagagaaggaaaagttacctgccaaggccgtgtatgacttcaaggcgcagacatccaaggagctgagctttaagaagggtgacacagtttacatactgcgcaaaattgatcagaattggtacgaaggggagcaccacggcagggtgggtatctttcctatatcctatgtggagaagctgactcctcccgagaaagctcagcccgctagacccccaccaccagcccagcctggagaaattggagaggctattgctaagtacaacttcaacgccgatacaaatgtcgaactgagtctgagaaagggagatcgtgtaattctgctgaagcgagtcgaccaaaattggtacgagggcaagattcctggaaccaacaggcagggaatcttcccagtatcttatgtggaggtagtcaagaaaaataccaagggagcagaagactacccagacccacctattccccatagctacagctccgatcggatccacagcttgagttccaataagccacaaagacccgtcttcacacatgagaatatccagggtggcggtgaacctttccaagccctgtataattacaccccacgcaatgaagatgaattggaattacgcgaaagtgatgttatcgacgttatggaaaagtgtgacgatgggtggttcgtgggcaccagtcggagaactaaatttttcggcacttttcctggtaactacgtgaaacggctgtag

SEQ ID NO: 30587 - DNA, 294 bp, Artificial Sequence
  Description of Artificial Sequence: Synthetic coding sequence
atgggcaaaagctgcaaagtggtggtctgtgggcaggcaagcgtgggaaaaacctcaatactggagcagctgctctacggtaatcatgttgtgggttcagagatgatcgagacccaggaggacatatacgtgggctccatcgagaccgatcgtggcgttcgtgagcaaatcgctgaatctttgttctccgtatggtcatgttctagaagacggcttacaaacccaagaactcgccgacggtccccgtcatggtctctcgccacatctgttacataccgatcctctggtgtgtag

SEQ ID NO: 30588 - DNA, 915 bp, Artificial Sequence
  Description of Artificial Sequence: Synthetic coding sequence
atgagcaagacccatgaccaccagctggagtcttctctgtctccagttgaggtgttcgccaagacttctgcctccttagagatgaatcagggagtgagcgaagagagaattcatctcggcagctcccctaaaaagggcggaaattgcgacctgtcccaccaggagaggctccagtccaagtccttgcatctgagtccccaagagcaaagcgcttcttaccaggatcgccgtcaaagctggagaagagcctccatgaaggagaccaaccgaagaaagtctctgcaccctattcaccaaggaatcacagaactgtcccgctctatctctgtggacttagcagaaagcaaaagactcgggtgccttttgctgtcaagtttccagtttagcattcaaaagctcgagccctttcttagagatactaagggcttctccctggagagcttccgcgctaaagcgtcctcattgagtgaagaactgaagcactttgccgacggactagaaactgatggcaccctccagaagtgcttcgaggacagtaatgggaaggcatccgatttttcgctggaggcgagcgttgccgaaatgaaagagtacataactaaatttagcctggagcgacagacctgggaccaactcctactccactatcagcaggaggccaaggaaatcctgtcccgtggctctaccgaagcaaagattacagaagttaaagtggaaccaatgacttatctcggcagttcccagaatgaggttctgaacacaaaacctgactatcagaagatcctgcagaaccagtctaaagtgtttgactgtatggagcttgtcatggacgagctccaagggagtgtcaaacagctgcaggccttcatggatgagagcacccagtgcttccagaaagtgagtgtccagttgtag

SEQ ID NO: 30589 - DNA, 1842 bp, Artificial Sequence
  Description of Artificial Sequence: Synthetic coding sequence
atggctactattccggactggaaattacagcttctcgctagaagaagacaggaggaggcttcagtgcggggtagggaaaaggccgagcgagagcgactctcccagatgcccgcatggaagcgtggtctcttagagcgacggagggctaaattgggtttgagccctggggagccaagccctgtgctcggaaccgtggaagccggacccccagacccagatgagtctgcagtcctgctggaggctatcgggccagtgcaccagaatcgcttcatccggcaggagagacagcagcagcagcagcaacagcagagatcagaagagctcctagccgagcggaaacctgggcctctcgaagccagggagcggagaccaagtccaggtgaaatgcgcgaccagagccccaaaggcagagaatcacgcgaggagaggttatctccccgagagacaagggagcgcagactagggattggcggagcccaggagttatcattgagaccactcgaggctcgtgactggcgtcagagcccgggtgaagttggtgatcggtcttcgaggctgtccgaggcctggaagtggcgcctgagtcctggggagacccccgagcgctcactgaggctcgcagagtcacgcgaacagagtccccgacggaaggaagttgagtcgaggctctctccaggggaaagcgcctaccaaaagctgggactgaccgaggctcataaatggcgacccgattccagggagtcacaggagcagagcctggttcagctggaagccacagaatggcgattgcgctctggcgaggaacggcaggactatagcgaagagtgcggaagaaaagaagagtggcccgtgcccggtgtagcgcctaaggaaacggcggagttgagcgaaactctgaccagagaggctcaggggaactcatctgccggtgtggaagccgctgagcaaagacctgttgaagacggggagaggggaatgaaacccacagagggttggaagtggacactgaactcgggaaaggctcgggaatggacacctagggatattgaggcccagacccagaagcctgaacccccagagtcggcagaaaagctgttagagtcccccggtgtggaggctggtgagggagaagccgagaaagaagaagctggcgctcaggggcgaccccttcgtgcgctgcagaattgttgttcggtgccaagtcctctaccccctgaggacgctggaaccggcggattgagacagcaggaggaggaagctgtagagttgcaaccccctcctccggcacccctctctccaccccctcctgcccctacagccccacagccccctggcgatcctctgatgagccggctgttctatggggtgaaagcgggacctggtgtgggcgcacccagacgtagcggacatacgtttactgtaaacccgagacgttccgttccaccagcaaccccagcgacccccacatctccggcaaccgtcgatgcagccgtgcctggggctggtaagaagcggtaccctacggctgaggagatcctcgtgctgggcggatacctgaggctgagcagatcatgcctggctaagggttcaccggagagacaccataaacagctgaaaatatcgttctcagagacagcattagagacaacctatcagtatccttcggagtcctctgtgcttgaagaattgggtcctgagcctgaggtacctagcgcgcctaaccctccggctgcgcaacccgacgacgaggaggacgaggaagagctgctgctgctccagcctgagctgcaggggggattaagaaccaaggccctgatagttgacgaatcctgtcgtagatag

SEQ ID NO: 30590 - DNA, 1560 bp, Artificial Sequence
  Description of Artificial Sequence: Synthetic coding sequence
atggaaggtgtcctttataaatggacgaattatctgtccggatggcaacctcgctggtttttgctctgcggaggaattctgtcatactatgactcccctgaagacgcctggaagggctgtaaaggaagtattcagatggcggtttgtgagatccaggtccattctgtggataacaccaggatggacctgattattccgggagagcagtacttttacctcaaggcaaggagtgtggcagagaggcaaagatggttagtggcactgggctccgccaaagcatgcctgactgattctcgcacacaaaaggaaaaggagttcgccgaaaacacagaaaacctgaagaccaaaatgtctgagcttcgcctctattgcgacctcctggttcaacaagtcgataagaccaaggaagtcaccacaacaggtgtgtcaaactccgaagagggtatcgacgtaggcaccctgctcaagtctacatgcaatacctttctgaaaacactggaagagtgtatgcagattgcaaatgccgcatttacctccgaactgctgtatagaacccctcctggtagcccccagcttgctatgctcaaaagtagtaaaatgaaacatccaattattcctatacacaattcgttagagaggcagatggagctatcgacctgcgagaacggatctctgaacatggagataaacggagaagaggagatcctgatgaaaaacaaaaatagtttgtatctgaaatccgccgagatcgactgtagtatcagcagtgaggaaaacactgacgacaacataacagtgcagggtgaaataaggaaagaggatggcatggagaacctaaagaatcacgataataatcttactcagagtgggtccgactcttcatgctctccagagtgcttatgggaggagggtaaggaggtcattcccacctttttttccacaatgaacacttccttctccgatatagagctgctggaggatagtggcatcccaacagaggcttttctggcaagctgctacgccgtcgttccagtgctggataagttgggccctacagtgtttgctccagtgaaaatggacctcgtcgggaacattaagaaggtgaatcagaaatatatcaccaataaagaagaattcaccaccctacagaaaattgtcctgcatgaggttgaagctgacgtggctcaggtccggaatagcgctaccgaggccctcttatggctgaaacggggactgaagtttctaaaaggtttcctcactgaggtgaaaaacggggagaaggatatacaaacagcactcaacaatgcgtacgggaagacactgcgacagcaccacgggtgggtggtacgaggggtgtttgccctggccctcagagccgctccgtcctatgaggacttcgtggccgctctcacagtcaaagagggagatcatcaaaaagaagcattttcaatcggcatgcaacgcgatttgtcgctttacttgcccgctatggagaaacagctggcaatcttggataccctgtacgaggtgcacgggctggaatcggacgaggtggtgtag

SEQ ID NO: 30591 - DNA, 1446 bp, Artificial Sequence
  Description of Artificial Sequence: Synthetic coding sequence
atggccagcgccgcttctgtgacttctctcgcagatgaggttaattgtcccatttgtcagggcaccctgagggagccggttacaattgattgcgggcacaatttttgccgggcatgcctcacgaggtactgcgagatccccggaccagatctcgaggaatcgcctacttgccctctgtgcaaggagccatttcggccaggaagctttaggcctaactggcagcttgccaatgtggtagagaacatcgaacgactacagctggtgtccaccttagggctgggtgaggaggacgtgtgccaagaacatggcgagaagatatactttttctgtgaagatgacgagatgcagctttgtgtcgtctgtcgtgaggcgggagaacacgcaacccataccatgcgctttttggaggatgcagccgctccctatcgtgagcagatccacaagtgcctgaagtgcttaagaaaggaaagagaggagatccaagagattcagagcagggaaaataagcgcatgcaagtgctcctcactcaggtgtctactaaaaggcagcaagttatctctgagttcgcacacctcagaaaatttctcgaagagcagcagagcattttgctagcccagctagagagtcaggatggggatattttgcgccagagggacgagttcgatctcctggtggctggtgagatttgcagattttcagctttgatcgaagagttggaggaaaagaatgagcgccctgcccgagaattattaacggatatccggagcaccttaattaggtgtgaaacaaggaagtgtcgaaagcccgtggcggttagcccggaactggggcaacggatccgtgacttcccgcagcaggcactgcccctgcagagggagatgaagatgttcctcgaaaagctgtgcttcgagcttgactatgagcccgctcatatctcgctcgatccacagacttctcatcctaaactgctgttatctgaggatcatcagcgggctcagttctcctataaatggcagaattcccccgataatcctcaacgattcgaccgtgccacctgcgtcctggcacacacagggatcaccgggggacgacacacttgggtggtgtctatcgacctggcacacggaggaagctgtacagtgggggtagtgagtgaggatgtgcagcgaaagggcgaattgcgactccgacccgaagaaggtgtctgggcagtgcgactcgcctgggggttcgtgtctgcactcggaagtttcccaactaggttgacattgaaggagcagcccaggcaggtgcgggtgagcttggactacgaggtgggttgggtgacctttacaaatgccgttacaagagagccaatctatactttcacggccagcttcactcgcaaggtcatccccttcttcggattatggggtcggggtagctccttcagtttgtcaagctag

SEQ ID NO: 30592 - DNA, 1173 bp, Artificial Sequence
  Description of Artificial Sequence: Synthetic coding sequence
atgtctgccgcaaatcccgagacacctaatagtaccattagtcgcgaagccagcacccagagttcctcagctgccgctagtcagggttgggtgttgcccgagggaaaaattgtcccaaacactgtgtttgtgggtggcatagatgcacgaatggacgagaccgagatcggatcttgcttcggaaggtatggctccgttaaggaggtgaaaatcatcaccaacagaaccggagtgagcaaggggtacggctttgttagcttcgtgaatgatgtcgatgtgcagaaaattgtcggttcacagattcacttccacggcaagaagctcaaattaggccctgcaatcaggaagcaaaaactctgcgcacgccacgttcagccccgaccattggtcgtcaacccaccgcctcctcctcagttccagaacgtttggcgcaatcccaacaccgaaacttatctgcagccacagattacaccaaatcccgtcactcagcatgtgcaggcttatagcgcgtacccccactcccctggtcaggtgattactggttgtcaattgctagtatacaactaccaggaatatcccacatatccagatagcgctttccaagtaaccaccggttaccagctccccgtatacaattaccaacccttccccgcttatcccaggtcaccgtttcaggtaacggcaggctatcagttgccagtgtacaattaccaggcctttccggcttacccaaactctccctttcaagtagcaactggttaccagtttcctgtgtataactatcagccattccccgcttacccaagtagcccattccaggtcaccgcaggttatcagctgcccgtctataactatcaggccttcccagcctacccaaattccccctttcaggtggctaccggatatcagttccctgtgtacaactaccaggccttccccgcttaccctaacagcccggtacaggtgacgactgggtaccagctcccggtctacaattatcaggcttttccagcctatcccaactcagcagttcaagtgacaactggataccaatttcatgtttataactaccagatgccccctcagtgcccagtcggagaacaaagacggaacctctggacagaggcgtacaagtggtggtacctggtttgtcttattcagcgtcgcgattag

SEQ ID NO: 30593 - DNA, 1143 bp, Artificial Sequence
  Description of Artificial Sequence: Synthetic coding sequence
atggaaaaaaaaaagatggtgacccagggaaaccaagagcctacaactacccctgacgcgatggtccagccatttaccaccattccattcccccctccgcctcagaacggcattccaacagaatatggggtgcctcacacacaagattatgccggacagacaggagagcacaatcttacactctacgggtcgactcaggcccacggagaacaatcctctaattcacctagtacgcagaatggctcactgacaacagaggggggtgcgcagactgacggccaacaatcgcagacccagagctcagagaacagcgagtctaaatcaactcccaaaaggctgcacgtctccaatataccgtttcgattccgggatccggacctgaggcaaatgtttggtcagtttggcaagattctggatgtagagatcattttcaacgaaaggggcagcaaggggttcggctttgtgaccttcgaaaacagtgccgatgctgatagagcaagggagaaactccacgggaccgtggtggagggcagaaaaatagaggtcaacaatgccaccgcgagagttatgactaataaaaaaatggttacaccttatgccaacggctggaagttgtccccagtggtgggcgctgtatatggcccagaactatatgcagccagtagctttcaggccgacgtaagcttaggcaacgacgcagctgtgccacttagcggaagaggcggaattaatacttatatccccctgatttctctgcccctcgtccccggttttccataccccacagccgctaccactgccgctgcatttaggggagcgcacttgcggggacgaggaagaacagtgtacggcgctgtacgcgctgtgccaccaaccgctatcccagcgtaccctggcgtagtctatcaagacggattttacggcgcagatttatatggaggttacgcggcttataggtacgcacagcctgccactgctactgcagcaacagcagccgctgccgcagccgctgcctacagtgacggctacggtcgagtctacactgccgatccctatcatgccttggccccagctgcgtcatatggcgtcggtgcagttgcttcattgtaccgcggaggctactctcggttcgcaccttactag

SEQ ID NO: 30594 - DNA, 1614 bp, Artificial Sequence
  Description of Artificial Sequence: Synthetic coding sequence
atggaccctggagacgccgcaattctggagagctctctgcgcatcctttaccggttattcgagtccgttctcccccctctccccgcagcgctgcagagtcgtatgaatgtaatcgaccatgttcgcgacatggctgcggcaggcctgcattcgaacgtgcgcctattgtctagtctgctcctaactatgagcaataataaccccgagctgttctcgccccctcagaaataccagctgctcgtatatcatgctgacagtctgtttcatgacaaggaataccgaaatgcagtttccaagtacaccatggccttgcagcaaaagaaagccctgtcgaaaaccagcaaggtgaggccatccactggcaattctgcctctaccccacagagtcagtgtttgccgtctgagatagaagttaagtataagatggctgaatgttacactatgctgaagcaggataaagacgcgatcgctattttggacggaattcccagccgccaacgaacacctaagattaatatgatgttagccaatctctataaaaaggctggtcaggagagaccctccgtgaccagctacaaagaagtgctccgccagtgtcccttggctctggacgccattctgggcctgctgagcctgtcagtgaagggcgcagaggttgcatccatgacgatgaacgtgattcaaacggtgcctaacctagactggctctccgtatggattaaagcgtatgccttcgttcacacaggcgacaatagccgagcaatcagtaccatctgtagtttagaaaagaaatctctgctacgcgacaacgttgatctactggggagtctggccgatctgtattttagggccggagataacaagaatagtgtgctgaagttcgagcaggcacagatgctcgacccttacctgatcaaggggatggatgtgtacggatacctgctggctagggagggtcgccttgaggatgtggagaacctaggatgccgtctcttcaacatttccgatcagcatgcggagccttgggtggtcagcggttgccactcgttttacagcaaacgctactctagagccctgtatctgggggctaaggccattcagctgaattctaacagcgttcaggccctgctgctgaagggcgctgccctgcgtaacatgggcagggtacaggaggctataattcacttcagggaagccatccgcttagctccatgtaggctcgactgttatgagggactcatcgagtgttacctcgcttccaatagcatcagggaagcaatggtgatggctaataatgtgtacaagactcttggggcaaatgcacagacactcaccttgctcgccaccgtgtgtttagaggatcctgtcacgcaggagaaggccaagaccctactagacaaggccctgacgcaacggccagattatataaaggcagtagttaagaaagctgagttactgagcagagagcagaagtacgaggacggcatcgcactgctccgcaacgcactcgccaatcagtcagattgtgtgctgcatcgaatattgggcgattttctggtggctgtgaacgagtatcaggaggccatggaccagtattcaattgctctgcgatag

SEQ ID NO: 30595 - DNA, 351 bp, Artificial Sequence
  Description of Artificial Sequence: Synthetic coding sequence
atggcattcatgactaggaaactctgggacctggagcagcaagtcaaggctcagacggacgagatcctgtccaaagatcaaaagatcgctgcattagaggatctggttcaaacccttaggccccaccctgcggaagctacgttgcagcggcaggaagaactggaaactatgtgcgtgcaactccagaggcaggtccgcgagatggaacgctttctttctgactacggacttcagtgggtgggcgaacctatggatcaagaagattcagagtccaagactgtctccgagcacggcgaaagagattggatgactgcaaagaaattctggaaaccgggacgggcaggcaggtag

SEQ ID NO: 30596 - DNA, 285 bp, Artificial Sequence
  Description of Artificial Sequence: Synthetic coding sequence
atgaccggaagcagaaactggcgggcaacccgtgacatgtgcaggtataggcacaattatcctgaccttgtcgagcgcgattgtaatggagatacacctaatctctctttctatcggaatgagatccgttttctgcccaacggctgcttcatcgaggacatactccagaattggaccgacaactatgacctgctagaggataaccattcctacatacaatggttgtttcccttgcgcgaacccggagtgaactggcatgctaagcccctgacactgcgagagtag

SEQ ID NO: 30597 - DNA, 1029 bp, Artificial Sequence
  Description of Artificial Sequence: Synthetic coding sequence
atgcgattctgggccccttggggatctaggactccaagtggacggagtctgtggacggacccggtgacgtattatactgcccttcacatcgccgtccttagaaaccaacccgatatggtagaactgctggttcaccacggcgctgatgtgaatcggagagacagaatccatgagtcctcccctctggatctcgcctctgaagagccagagcgattaccttgcctgcagaggctgctggatcttggggcagatgtgaacgccgctgacaaacatggtaagactgcactcctgcacgccctagcctcctctgacggcgtgcagattcacaatacagagaatatacgcctgctactcgaaggaggcgcagatgtaaaagccacaacaaaggacggtgacactgtcttcacctgtataattttcctactgggagagacagtgggcggagacaaagaggaggcccagatgattaaccgtttttgcttccaggtgaccaggctcttgctagctcacggcgctgacccaagcgaatgccctgcgcatgagtctctcactcacatttgtctcaaaagctttaagctgcacttccctttattgaggttcttattagaaagcggcgctgcgtataactgctccctgcacggagcgagttgttggtctggattccacataattttcgaacggttgtgctcccatccaggctgtacagaagatgagtcgcacgcagacctgctgcggaaggcagaaaccgtcctcgacctcatggtgacaaacagtcagaagttacagctccccgagaatttcgatattcatccggtcggaagcctcgccgaaaaaattcaggctctacacttcagcctgagacagctagagagttatcctcccccactcaagcacctgtgccgcgtagccatcagattgtatctccagccatggcctgtcgacgtgaaggtgaaggcattgcctctccctgacagactgaagtggtatcttctgagcgagcacagcggatcagttgaggacgatatttag

SEQ ID NO: 30598 - DNA, 3192 bp, Artificial Sequence
  Description of Artificial Sequence: Synthetic coding sequence
atgccacatctgccactggcttcttttcgaccccctttctggggcctcagacatagccggggtctgcctcgcttccactcagtctcaacccaatctgagcctcacgggtctcccatttcccgacggaacagggaagccaagcagaagagacttagagaaaagcaggccacgttggaggccgagattgctggcgagtcgaaaagcccggcagaatccatcaaagcatggagaccgaaggaactcgtcttgtacgaaatccctactaagccgggtgaaaagaaggatgtgtcaggcccacttccacctgcctattcacctcggtatgtggaagccgcttggtacccttggtgggtcagggagggtttcttcaagccagaatatcaagcacgccttccacaggccaccggggaaacattctccatgtgtattccaccgccaaatgtgactggcagtttgcacattggccacgccctgacggtcgctatccaagacgcactggtccgttggcacaggatgaggggcgatcaagttctctgggtgcccggtagtgaccacgccggaattgccacgcaggctgtggtggaaaagcaattgtggaaggaacgcggagtaagaagacatgagctgtcacgcgaggcctttctgagggaggtctggcagtggaaagaagcgaaagggggagagatttgcgagcagctgcgtgccctaggcgcttccctcgactgggaccgtgaatgcttcaccatggacgtgggaagctccgtagccgtgacagaagcttttgttaggctctataaggcgggactgttatatcgcaaccaccagctggtgaattggagttgtgcgctgagaagtgcaataagtgatattgaagtggagaaccgcccactgcctggccacacacagcttcggctccctggttgtcctacacccgtgagctttgggctgctgttcagcgtggcgtttcctgtggacggagagccggacgctgaagtagtggtgggtacaaccagacctgaaactctacccggagacgtggcggtggcagtgcatccagatgacagccgttacactcacctccacggacgtcagctgaggcatcccctcatgggccagccattgccattaattacagattatgctgtgcagccgcacgtggggacgggggctgttaaggtgactcctgcacactctcccgcagatgcggagatgggtgctaggcacggattgtctcctctgaacgtaattgctgaagacggaactatgacttctctttgtggagactggttacagggactgcacagatttgtggctcgcgagaaaatcatgtctgtgctgtcagagagaggtctgtttagaggcttgcagaaccatcccatggtgctgccaatatgctctaggtcaggtgatgtgatcgaatacctgctcaagaatcaatggttcgtacgctgccaggaaatgggtgctcgggcagcaaaagccgtggagtctggcgctttagaactcagcccctcctttcaccagaagaactggcagcactggttttcacacattggtgattggtgtgtgtctcggcagttgtggtggggccaccagatcccagcctacctagtcgtcgaggaccacgctcagggagaagaagactgctgggtcgtcggaaggagcgaggccgaagcacgggaggtagcggcagaactcacaggacgacccggagcagaactgacacttgagcgtgatccagacgtgctggatacatggttcagctccgctctctttcctttttccgcattaggatggcctcaggaaaccccagaccttgcgcgattctatccactgagtctcctcgagacaggatctgacctgctcctgttctgggtgggccgaatggttatgctggggacccagcttactggacagctgcccttttctaaagttttgctccacccaatggtgcgggataggcagggcagaaagatgtcgaagagtttgggcaatgttcttgaccctagggacatcatatccggagtggaaatgcagttactgcaggaaaaactgcgcagcgggaacttggacccggcagaattagccattgtggcagctgcacaaaagaaagattttccacacgggatccccgaatgcggcactgatgctctccggttcacattatgtagccacggtgttcaggctggcgacctgcacctgtccgtcagtgaggtccagagctgtagacacttctgcaacaaaatctggaacgcactgcgatttattttgaatgccttgggcgagaagtttgttccccagcctgctgaggagctctctcctagcagcccaatggatgcctggatccttagcaggttggctctggccgcacaagagtgtgagcgaggcttcctgactagggagctcagtctggtcactcatgccctgcatcacttttggctgcacaacttgtgtgacgtttaccttgaggcagtcaaaccggtgttgtggcacagtcctaggccccttggccctccccaggtcctgtttagctgcgcagacttggggctcaggctgctcgcaccccttatgccattccttgccgaagaactctggcaacgactgcctcccaggccgggatgcccacctgcacccagcatttctgtcgccccatatccatccgcgtgctcgctagagcactggaggcagcccgaactggagagaagattctcgcgggtgcaggaagtggttcaggtcctgcgagctctccgcgctacttatcagttaactaaggccaggccgagggtgttgctgcaatcgtcagaaccaggcgaccagggcctgtttgaagcctttctagagcctctcggcaccttaggttactgcggagccgtaggcctgttgcctcctggaaccgcagcaccgtccggttgggcgcaggccccattgtccgacaccgcgcaggtgtatatggagttgcaaggtctggtcgatccccaaatacagttgcctctgttagcagcaagaagatataagcttcaaaaacagttagactcccttaccgctaggacacccagcgaaggagaggccggaacccaacgccaacagaagctttccagcttacagctcgagttaagcaaacttgacaaggccgcaagtcacttacggcagctgatggacgaacctcccgcacccggatcgcctgaactctag

SEQ ID NO: 30599 - DNA, 96 bp, Artificial Sequence
  Description of Artificial Sequence: Synthetic coding sequence
atgagcgatgaagtgttctctacaacgttagcatatactaagagcccaaaggttacaaagagaaccacatttcaggacgagctgatccgggcttag

SEQ ID NO: 30600 - DNA, 606 bp, Artificial Sequence
  Description of Artificial Sequence: Synthetic coding sequence
atgccactgcagttgaagaatccaagattgcgtcagaaatcaaggacgcgatgcaacaagtctcagaaaaaggctgagcttctggataacgagaagcctgccgctgttgtcgcccctataacaactgggtacactgttaagatctccaactatggctgggaccagagcgacaaattcgttaaaatctatattacactcaccggcgtgcatcaagttccaactgagaacgtgcaggtccatttcacagaacgctcgtttgaccttctggttaagaatctcaatggcaagtcatacagtatgatcgtgaataacctcctgaagccaatttccgtggaaggatccagcaaaaaagtgaagacagacacagtgttgatcttgtgccgaaaaaaagtagaaaacactagatgggactacctgacccaggtagagaaggagtgtaaggagaaagagaaaccatcctacgataccgagacagacccatccgagggtcttatgaatgtcttgaagaagatctacgaggacggggacgatgacatgaaacgtacaataaacaaagcctgggttgaaagtagggaaaaacaggctaaaggcgacacagaattctag

SEQ ID NO: 30601 - DNA, 480 bp, Artificial Sequence
  Description of Artificial Sequence: Synthetic coding sequence
atggccacctcggcaccactgagatctctggaggaggaagtaacttgtagtatttgcctagattacctcagagatcctgtgaccattgattgcggacatgtgttttgcaggtcttgcactaccgatgtgcggccaataagtggctcaaggccagtctgcccactgtgcaaaaagccctttaagaaggagaatatccgcccagtgtggcaactggaaaaaatcttaaatcacttgtccactttgaggcgtgaccgggacaaaattcagggatttcaggctaaaggtgaagcagatatcctggccgctttaaaaaaactgcaggaccagcgccagtatatagtcgccgagtttgagcagggacaccaatttctgcgcgagcgcgaggagcaccttcttgagcagctggctaaactggagcaggagttaaccgagggtagggaaaaattcaagtctcggggtgtcggggaactcgctcggtag

SEQ ID NO: 30602 - DNA, 4599 bp, Artificial Sequence
  Description of Artificial Sequence: Synthetic coding sequence
atgcagcgcgaattagtgtacgcccgaggggacgggcctggagccccacggccagggtctaccgcgcaccctcctcatgctatcccaaattcaccccctagtaccccggttccccactcaatgcctcctagcccaagcaggataccatatggagggacacgtagtatggtcgtccccggaaatgccacgattcccagagacaggatttcttcactccccgtttctcgccctatttcaccctctcccagcgctattttagagagacgcgacgtgaagccagacgaagatatgagtggaaaaaacattgccatgtatcgcaatgaggggttctacgcggatccctatctgtatcacgagggacggatgtcaattgctagcagtcacggaggacatccgctggacgttcctgaccatatcatcgcatatcaccgcaccgctattcggagcgcctccgcatactgcaatccaagcatgcaagcggaaatgcacatggagcagtccctatatcggcagaagtcccggaagtacccagatagccacctgccgacacttggctccaagacccccccagcctctccccatagggtctcggatctaaggatgattgatatgcacgcccattacaatgcccacgggcctccccataccatgcagccagaccgggcaagtccgtctaggcaagcgttcaaaaaagagccagggacgctcgtgtacattgaaaaaccaaggagtgccgcagggctctcctctttggtagatctggggccacctctgatggagaagcaggtttttgcttattccaccgcaacaatacctaaagaccgagaaacaagtgagaagatgatgaagaccaccgccaatcgtaatcatactgattctgccggtaccccacacgtttctggaggcaaaatgctatctgcactggaaagtaccgtgccccctagccaaccgccacctgtggggacatcagctatccacatgagcctgctcgagatgagacggagtgtggccgagcttagactgcagttgcagcagatgaggcagctccagttgcagaatcaggagttgctgcgtgcaatgatgaaaaaagctgagctggagataagtggtaaggtgatggagacaatgaaacggctcgaagatccggtccagcgtcagcgtgtgctggtggaacaggaaaggcagaagtacctgcacgaggaagagaagatcgtgaagaaactgtgtgagctggaggacttcgtggaagacctgaagaaggattccactgcagccagccgcctggtgacattaaaggatgtggaagacggggcatttctgctcagacaagttggcgaggccgtcgctactctcaaaggtgagtttcccaccctgcagaacaaaatgagggcaattcttcgcatcgaagtggaagctgtgcgctttttaaaggaagagccccataaactggattccctgttgaagcgggtgcgatcgatgacggatgtgctgacaatgctcaggaggcatgttacggatggccttctgaaaggcacagatgcggctcaggcagcccagtatatggcaatggaaaaggccactgctgctgaagtgcttaagtctcaagaggaggctgcgcacacgtccggccagccgttccacagcaccggagctcccggagacgctaagtcggaggtcgtacctttgtccgggatgatggttagacacgcccagagttcacctgtcgtcattcagcccagccagcattcagttgccctcctgaatcctgcccagaatctgccccacgtggcttccagcccagccgtgccccaagaggccacaagcacactgcagatgagtcaggcaccccagagcccacagatcccaatgaacggctctgccatgcagtctcttttcattgaagaaatccactccgtgtcggctaagaatagggcagtgtctattgagaaggcggaaaagaaatgggaagagaagcggcagaatttggatcactataacggaaaggagtttgaaaaacttttggaagaggcccaggctaacatcatgaaaagcatcccaaatctggagatgccacccgctactgggccactccctcggggagacgcgcctgttgataaagttgagctgagcgaggactcccccaacagtgagcaggatctggagaagctaggcggaaaatctcccccacccccaccccctccacctcggagaagctatctacccggatcagggctgacaacaactcgcagtggtgacgtggtctatactggccgaaaggaaaacatcaccgccaaggcctccagcgaagatgcaggacctagtccccagacccgagcaaccaagtatccggctgaagagcccgctagcgcctggacacccagtccccctcctgtaaccaccagcagctctaaggatgaagaggaggaagaggaagaaggagacaagatcatggcagagttgcaggctttccagaagtgctcatttatggacgtgaacagcaactcgcacgcggaacctagcagggctgattcccacgtcaaagatacgaggagtggagctaccgtgccacccaaagaaaagaagaacttggagttcttccacgaggatgttagaaagagcgacgtcgagtacgagaatgggcctcaaatggaatttcagaaggttaccactggggcagtacgcccatccgacccccctaaatgggaacggggaatggagaatagcatttcagatgcctcacgtacttccgaatacaaaactgagataatcatgaaagagaattcaatcagcaacatgagcctgctccgcgattctaggaattacagccaggagaccgtgcccaaggcaagttttggattctcagggatctcccctcttgaagatgagatcaataaaggcagcaaaattagcggattgcaatactcgatccccgacaccgagaaccagacgttgaactacggcaaaactaaagaaatggaaaagcagaacacagacaagtgtcatgtatcgagtcatactaggctgactgaaagtagcgtgcacgattttaaaaccgaggatcaggaggttattactacggattttgggcaggttgtattgaggccaaaggaagcacgacatgcaaatgtgaatccaaatgaggacggtgaatccagcagtagctctcccacagaggaaaacgccgcaactgacaacatagcatttatgattaccgagaccactgtccaagtcttaagcagcggcgaagtccatgatattgtgtcccagaagggtgaggatattcagaccgtgaatatcgacgctagaaaggaaatgaccccacgacaggaaggtacagacaatgaggatccggtggtttgcctcgacaagaagccagttattatcatttttgatgagcccatggacatccgatctgcctacaaacgcctatcgaccatatttgaagagtgcgacgaggagctagagaggatgatgatggaggaaaaaatagaggaggaagaagaagaggagaacggtgactccgtggtacagaataacaacactagccagatgagccacaaaaaagttgcccctggtaacttgagaaccggtcagcaggtcgagacaaagtcgcagcctcactctctcgcaactgaaactagaaaccccggagggcaggagatgaaccgaacagagctgaataagttctcacacgtggactctccgaacagcgagtgcaagggggaagacgccacagacgatcagtttgagtctccaaaaaaaaagtttaaatttaaatttccgaagaagcagctcgctgcgctcactcaagcaataaggactgggacaaaaacaggcaagaaaacgcttcaggtcgttgtatacgaagaggaggaggaagatgggaccctgaaacagcataaggaagctaaaaggttcgagatcgctcggtcccaacccgaagacacgccaacctcgataccgagcgccagtagaaagggcagcagtggggcaccccagactagtcgcatgccggtgcccatgagcgccaagaatcgaccaggaacactggacaagcctggtaagcaatcgaaacttcaggaccccaggcaatatagacaggcaaacggctccgccaagaagagcggaggggattttaaacctacatccccatctctccctgcaagtaaaatccccgctctcagtcctagctctggaaaatctagttctctgccgagcagctcgggcgatagtagcaacctccccaatccacccgctactaagcctagtatagcaagtaaccccctttcaccgcaaacggggcctcccgcacactcagcttccctaatccccagtgtgtcaaacggatcccttaagttccagagcttaacccacaccggaaaaggtcatcacctctcattcagcccccagtcccaaaatggacgggctccgccaccgctttccttttcttcttcccccccaagtcccgcatcttcagtgtcacttaaccagggagccaaaggcactcggacgatccacacaccatctctcacatcatacaaggcgcaaaatgggagctctagtaaggctacgcctagcacagctaaggagactagctag

SEQ ID NO: 30603 - DNA, 1566 bp, Artificial Sequence
  Description of Artificial Sequence: Synthetic coding sequence
atgacaagtgcttttaaactggactttctacctgatatgatggtggaggggaggctgctggtgcctgaccgaatcaacggtacggccaacaaaatgaacggggctctcgatcattcggaccaacccgatccagatgccattaagatgtttgtaggtcagattccacgtagttggtccgagaaggaacttaaggagctctttgaaccttatggcgctgtgtaccaaataaacgtgctgagagatagaagccaaaaccctccgcagagcaaggggtgctgttttgtgacgttttacacacgaaaagctgcactcgaggcccagaacgcgctacacaacataaagactctgcctgggatgcaccaccctattcagatgaaacccgctgacagcgagaaatccaacgctgtggaggaccgcaagctgttcatcgggatggtgagcaaaaaatgcaacgaaaatgatatacgagtcatgttttcgcctttcggccaaattgaggagtgtcgcatcctgcgcggacctgacggccttagtcggggttgtgccttcgtcacattcagcactcgcgctatggcccagaatgctataaaggccatgcatcagtcacagaccatggagggttgttcgagtcctattgtagttaagtttgctgatacccagaaggacaaggagcaacggcgactgcagcaacaactggctcagcagatgcaacagctgaacacagctacctggggcaatttgactgggctggggggactgactccgcagtatctggcccttttacagcaggccacaagctcttccaatctgggagccttttccggcattcaacagatggccggaatgaatgctctacagctgcagaatctcgcaacactggctgcagccgctgctgctgcccagaccagcgccacatcaacgaatgccaaccctctgtccaccacaagctcagccctcggagctctcacctccccagtggctgccagcactccaaattcaactgccggtgctgcaatgaactccctaacaagtcttggcactctccaaggactggccggagcaaccgtgggcctgaataacataaatgcccttgctgttgcacagatgctctccggcatggcagctctaaatggaggcctcggagctacgggcctcactaatggcactgccggtaccatggatgctcttacgcaggcgtactccggcatacagcagtacgcagccgctgctctgcctacattgtactctcagagtttgctgcagcaacagtctgccgcaggcagccagaaggagggcccagaaggggcaaacctgttcatctaccatctaccacaagaatttggcgaccaggatatccttcagatgttcatgcctttcggaaacgttatctccgctaaggtattcatcgacaagcaaacaaacctttcgaaatgttttgggtttgtgtcttatgacaacccagtctccgcccaggcagcaatacaggccatgaacggtttccagattgggatgaagcgtcttaaagtccaactcaagcggtccaagaatgattctaagccgtattag

SEQ ID NO: 30604 - DNA, 315 bp, Artificial Sequence
  Description of Artificial Sequence: Synthetic coding sequence
atgagtgaacagggcgacctcaatcaggctatagccgaggaaggaggcaccgaacaagaaaccgccacccccgagaacggaatcgtgaaaagcgagtccctcgacgaggaagagaagctggaactgcagagacgcctggaagctcagaatcaggaacgaagaaagtccaagtcaggcgctggcaagggtaagctgacccgctctctcgcagtgtgcgaagaatctagtgccagacccggaggggagtctctgcaggaccaagaaagtatccatttacaactctcgtctttctcatcactccaggaggaggactag

SEQ ID NO: 30605 - DNA, 1653 bp, Artificial Sequence
  Description of Artificial Sequence: Synthetic coding sequence
atggagccaccacaggagacaaatcggccttttagtaccctggacaatcggagcggacaggttcaggttctttcagctacaccattgctacagagaaacccttactctagcccagatatcatgcatattaagggctcggaagcctcaagtgtgccctacgcactaaatcagggaactaccgctttacctaagaataaaaatcaggaaggtaccggccataggctgttaaacatgctaaggaagaccctcaaggaatcagattctgaagagctggagatcactcaggagacccccaacctggtgccattcggggacgtggtgggatgcctaggcatccacattaaaaattgcaggcacttcatgcccaagataagtttgcagcattacgcaaatcttttcattcgtatctcaattaataaagctgtgaagtgcacaaaaatgtgcagccttctctccaaaaatgacgaaaaaaataccgtaatcaagttcgatgaagtcaagtacttttccgtgcaggtgcctagacggtacgatgataagcgaaacaatatcctgctggaactcattcaatacgacaaccgggagaaacgtgccttcttgttgggaagtgtgcagatccatctctacgaagtaatccagaaaggctgctttatcgaagaagtgcaggttctacatggcaatatctttgtctgtcggctagaggtggagttcatgttttcctacggcaattttgggtatgggttcagtcaccagctgaagccgttgcagaaaatcacagagccttcaatgttcatgaacctggcccctcccccagagcgaaccgatccagtgacgaaggtaatcaccccacagacagtagagtaccctgcattcctgtcccccgatctgaacgtaacagtggggacgcctgctgtgcaaagtagcaatcaaccctctgtcgtccggcttgagaagctgcagcagcagccccgagagcgcctggagaagatgaagaaggaatatcgaaacctaaatacctggatagataaagcaaattaccttgaaagtatcctgatgcctaagctcgaacacaaagacagcgaggaaacaaacattgatgaggcttccgaaaacaccaagtcaaatcatcccgaggaagaactggaaaatatcgtgggggtggacatccccttagtgaatgaggaggctgaaacaacagctaatgagctcctcgataatgactccgaaaagggcctcaccatccccacactgaaccagagcgaccaagataacagcaccgccgacgcaagcaaaaatgatgagtctacgccatcccccacggaggttcactcactctgcacaattagtaaccaggagactatcaaggccggaagaatccctccactgggggagcggcagagcgaatctatgcccgataggaagatgaaaaatgtcttttttcccttagaagtgaaactgaaagacaattaccccagtattttgaaggccgactcttctttatccgaagtgaatctgcgctctatctgcattaatcctaaaagtcgaaatttagacagctctccaactgagatctcttggcagaacaataatcttaatctggccgagcgcgaaaatacaggtctggtgtctacgcggctcaaaattaagcggtag

SEQ ID NO: 30606 - DNA, 363 bp, Artificial Sequence
  Description of Artificial Sequence: Synthetic coding sequence
atgagcatcagctctgatgaggtcaatttccttgtgtaccggtatttgcaggaatcaggcttctcacacagcgcattcacattcggcatagagagtcacataagtcaatctaacatcaacggagccctggtgcctccagctgctctgatctctataatacagaaggggttacagtatgtcgaagccgaagtgtcaatcaatgaagatggcaccctgtttgatggcaggccgatagagtctttgtcgctcatcgacgcggtgatgccggacgtcgtgcagacaagacagcaggcctaccgcgataagctggcccagcagcaggctgctgctgccgctgcagccgctgccgcagcttcccagtag

SEQ ID NO: 30607 - DNA, 222 bp, Artificial Sequence
  Description of Artificial Sequence: Synthetic coding sequence
atgagctactatcaacggccattcagccctagtgcatacagccttcccgcaagtctgaacagcagtattgtaatgcagcacgggacttcgctcgatagcactgatacatacccccagcacgctcaaagcctggatggtacaacatcatctagcattcctctctacaggtcaagcgaggaagaaaagcgagtgactgtcattaaagcccctcattacccatag

SEQ ID NO: 30608 - DNA, 717 bp, Artificial Sequence
  Description of Artificial Sequence: Synthetic coding sequence
atgactgaagactcccagcggaatttccgcagtgtttattatgaaaaagttggatttagaggagtcgaagaaaaaaagtccttagaaatcctgctaaaagatgaccgtcttggtatcttgcctccccatcatgagtcgcacgcaaaggtgatgatgtatcgcaaggaacagtatttggacgtgctgcacgcactcaaagttgtgcgcttcgtgagtgatgccacccctcaagccgaggtctacctgcgcatgtaccagctggaaagtggtaagctaccacgctcaccctctttccccctcgaaccggatgatgaggtctttctggccatcgcaaaagccatggaggagatggtggaagactccgtcgattgctattggattacccggcgtttcgttaaccagctaaatacaaagtatagagattctctgcctcagctccctaaagcatttgaacagtacctgaatctcgaggatgggagactcctgacacacctgcgcatgtgcagcgccgcacctaaactgccctatgacctctggttcaagcgctgcttcgccggatgcctgcctgagtcaagcctgcagcgggtgtgggataaagtagtgagtgggtcgtgtaaaatcttggtcttcgtggcggtcgaaattctcctgactttcaaaattaaggtgatggcacttaatagcgccgagaaaatcacaaagttcctagagaactag

SEQ ID NO: 30609 - DNA, 1620 bp, Artificial Sequence
  Description of Artificial Sequence: Synthetic coding sequence
atggccacctccgctccactgcgaagcctcgaggaagaagtgacctgcagtatctgccttgactacctgagggacccggtgacaatcgactgtgggcatgttttctgccggtcttgtaccacggatgtgaggcctatttcgggaagtcgcccagtctgcccactgtgcaagaagccattcaagaaggagaacattcgaccagtttggcaacttgccagtctagtagagaacatcgaaagactcaaagtggacaagggacggcagccaggtgaagtaacccgtgagcagcaagacgccaaactgtgcgaacgacaccgcgaaaagctacactactactgcgaagatgatggcaaactcttgtgtgtcatgtgtcgcgaaagccgggaacataggcctcataccgcggtgttgatggagaaagcagcccagcctcaccgggagaagatattgaatcacttaagcacactgcgccgtgaccgcgataaaattcaggggttccaggccaagggtgaggcagacattctggcagccttgaagaagctgcaggatcaaaggcagtatattgtagccgagttcgagcagggacaccagtttctgcgggagcgcgaggaacatttgctggaacagttggctaagctagagcaagagctcaccgagggacgagagaaatttaaatcacgcggagtgggagaattagccaggctggcccttgttataagtgagctagagggtaaagcccaacagcccgcagcagagctcatgcaagacactagggactttttgaatcgctaccctaggaaaaagttctgggtgggcaagcctatcgcacgcgtcgtgaagaaaaaaaccggagaattcagcgacaaactgctgtcacttcagaggggcctcagagaattccagggtaaactgctgcgggatctggagtataagacagtctccgtaactttggatccccaatctgcgagcggataccttcagctgagcgaagactggaagtgtgtgacatataccagcctgtataagtccgcctacttgcaccctcagcagttcgactgtgagcctggcgttcttggctccaagggatttacctggggcaaagtttactgggaggttgaggtggaaagagaggggtggtctgaagacgaagaagaaggtgacgaagaagaggaaggggaagaggaagaagaagaggaggaggccggttacggtgacgggtacgatgattgggagaccgacgaagacgaggaatctcttggtgacgaggaggaggaagaggaggaggaagaggaggaagtccttgagtcatgcatggtgggcgtggcccgtgactcagtcaaacgtaagggcgatctcagcctgcggccagaggacggggtatgggcactgcggctgagttccagcggaatctgggccaatacaagccctgaagcggaattgttccctgctttgcggcctagacgcgtcggcatcgctttggattatgaaggcggaaccgttaccttcaccaatgccgaaagccaggaacttatttacacgttcacagcaacgttcaccagacgcctggtgccattcttgtggttgaagtggccaggtactcgtctcctcctgcgcccatag

SEQ ID NO: 30610 - DNA, 609 bp, Artificial Sequence
  Description of Artificial Sequence: Synthetic coding sequence
atgggacagaaagtcactgggggaattaaaaccgttgacatgcgcgacccaacttaccgccctctcaagcaagagctccagggtctggactattgcaagccaactcggttagatcttctgctggatatgccgccagtgtcctacgatgtccagctgctacattcttggaataacaacgatcgcagcctaaacgtctttgtgaaagaggacgataaattgattttccaccgacaccctgtggctcagagtacggacgctattcgtgggaaagtgggttacactcggggtttgcatgtctggcagattacctgggctatgaggcaacgtggcacccacgctgtggtgggcgtggcaacggcagacgccccactccattcagtggggtacacgacattagtcggcaataatcatgagtcttggggttgggatctgggcaggaaccggctgtatcacgatggaaaaaatcagccatcaaaaacctatcccgctttcttagagccagacgaaacttttatcgtccctgactcattcctggttgcactcgacatggatgacggcactctgtccttcattgtagacggacagtacatgggggtggcatttcgctag

SEQ ID NO: 30611 - DNA, 174 bp, Artificial Sequence
  Description of Artificial Sequence: Synthetic coding sequence
aatctgcctatctgtatggcaaaaacccacctaagcctgagccatcaacctgataaaaagggcgtacccagggatttcatcctgcctatcagcgatgtcagggcctctatcggagccggttttatttaccccctggtcgggaccgggggacgggaggcacctttgtggctgtag

SEQ ID NO: 30612 - DNA, 468 bp, Artificial Sequence
  Description of Artificial Sequence: Synthetic coding sequence
atgaacaatcagaagcagcaaaaaccaaccctctctggccaaaggttcaaaacccgcaagcgcgatgaaaaagagcgctttgacccaactcagtttcaggattgcatcattcagggactgactgagacaggtactgacctggaggcggttgctaaatttctcgatgccagtggcgctaaactggattatagacgatacgccgagaccctgtttgacatattagtggcaggcggtatgttagcgccaggcggtaccctggccgatgatatgatgcgtactgacgtgtgcgtgtttgccgcacaagaggatttggaaaccatgcaggcatttgctcaggtcttcaacaaattgattaggcgttacaagtacttagaaaaagggtttgaagacgaagtaaaaaaactcctgctgtttctgaaaggattctcagagagcgaaaggaataaactcgccatgctgacggggtag

SEQ ID NO: 30613 - DNA, 528 bp, Artificial Sequence
  Description of Artificial Sequence: Synthetic coding sequence
tagttcgatgatcaaaggcggatgagcttgcatctgcacggtgctgactgcgatccgaaaacccagaatgagatgaacatctgtgaagaagagtttgtcgagtacaaaaatagggatgcaatttctgctctcatgccactgttcagtgaagaggagtctagtgatggttccaaacataacaatggtcttccagaccacatcagcgcccagctgcagaacacctacactctgaaagcctttactgtcggatcaaagtgtgtagtctggtcttctctacgcaacacatggtctaagtgtgagattctggaaacagccgaggagggaacgagagtactgaacctatccaatggtatggaagaaattgtcaaccccgaaaacgtctggaacggtatccctaaacttgacaagagcccgcctgaggctgtgtcacagagggtggggaaggacctgtatttcatgagtgttggggacacaactattaaggaaaaaggttttggtggggatggcgacctgactgtggacctctag

SEQ ID NO: 30614 - DNA, 2814 bp, Artificial Sequence
  Description of Artificial Sequence: Synthetic coding sequence
tagctgagatcacagcccggatgtgggtgcttgtggcaggaagctccgacccattctacagggccaagcgtggaaggggaggccccatcctccgaaaccggtacctcattagattcaccatcagcttatcctcaggggcctctcgtacctggctctagcttatcccctgatcattacgagcatacatctgtgggcgcttacgggttatattcaggtccgcctggccagcagcagcggacgcgcagaccaaaattgcagcattccacttctatcctcagaaaacaggctgaagaagaggccattaagaggagccggtcactgagcgagagttacgagctgagctccgatctgcaagataagcaagtggagatgctggaacgaaaatatggcggtagactcgtcacccgtcatgccgctagaaccatccaaacagcatttaggcagtatcaaatgaataagaacttcgagcgactacgttcttctatgtccgagaacaggatgagccgcaggattgttcttagtaatatgaggatgcaatttagcttcgaaggccctgagaaagttcactcttcctatttcgaggggaagcaggtcagtgttaccaacgatgggagccagctgggtgccctggtaagccccgaatgtggggacttgagtgaacccaccacgcttaaatcgcctgccccatcctccgatttcgctgacgctattacggagctggaggacgctttctctcgccaagtgaaatctctggcagagtccatcgatgatgcattgaactgccggtctctgcatacagaagaggcgccagccctcgatgctgccagggccagagacacagaaccccagactgccttgcatggaatggatcaccgtaagctggatgaaatgactgccagttatagcgacgtaacactgtacatcgatgaggaagaactgtccccccctcttcccttgagccaagctggagatagaccctccagcaccgagagcgatctccggttgcgtgccggtggcgctgcgcctgactactgggctctggcacataaggaggataaggcagatacggatacatcttgtagatctacaccttccctggaaagacaggagcagcgacttagagtcgaacacctgcctctactcacaattgagcctcccagtgattcctccgttgacctctcagatcgtagcgagagaggctcactgaagaggcagtccgcctatgagcgctccttaggcggacagcagggaagccccaaacacggcccacactcaggggcaccaaaaagcctacctcgagaggagccggagctgcgtccacgaccacctcggcctcttgacagccatctcgctattaatggatcagcgaataggcagtcaaaaagcgagagcgactatagtgatggagataatgattccatcaacagtacttccaatagcaacgacaccataaattgctcttctgagagctctagccgggattctcttagggaacaaacactgtctaaacagacctatcacaaagaggctaggaattcttgggatagtcccgcattctcaaatgacgtgatccggaaacggcattacagaattggtctgaatctctttaataagaaacctgagaagggcgtgcaatacctgattgagcgcggatttgtgcccgatacaccagtgggggtagctcatttccttttgcagcggaaagggctgtctcgtcagatgattggagaattcctgggtaataggcagaagcagttcaaccgcgatgtgcttgactgtgtggtcgatgagatggacttctccactatggaactcgacgaggccctgcgaaaatttcaggctcatatacgagtgcagggggaagcacagaaagtggaacgcctgattgaagctttttcccagcgttactgtatctgtaacccaggagtggtgcggcaattccggaaccccgataccatttttattctggccttcgccatcatccttctgaataccgacatgtacagccccaatgtcaagccagagcggaagatgaaactggaagactttattaagaacctccgcggagtggatgacggtgaggatattccaagagagatgttgatgggcatctacgagcgaatccggaagagggagttaaagacaaacgaagaccatgtttcccaggtgcagaaagtggagaaactgatcgtaggtaaaaagccaatcggcagtctgcaccccggacttggctgcgtactgagtcttccccacaggaggctggtttgttattgtaggctctttgaggtccctgacccgaacaaaccacagaaactgggtctgcatcagcgagagatttttctctttaacgatctgctggtcgttaccaagatttttcagaagaagaaaaacagcgtcacatactcctttaggcagtcattctctttgtacggcatgcaggttcttctgttcgagaaccagtactatcccaacggcatcaggctcacaagctccgtccccggagccgatattaaggttttgatcaactttaatgcacccaaccctcaagatcggaaaaagttcactgatgacctgcgcgaatctattgcagaagtgcaagagatggagaaacatagaatcgagtccgaactcgaaaagcagaagggagtagtgcggccaagcatgtcgcagtgttcttctctgaagaaagaatctggcaacggcactctgagtcgcgcatgcttggacgatagttatgcctccggagaggggctgaagcgtagcgccttatcctcttcgctgcgggacctttccgaggccggagtccatcactag

SEQ ID NO: 30615 - DNA, 198 bp, Artificial Sequence
  Description of Artificial Sequence: Synthetic coding sequence
atggtggaggccgcagatcgagaaaaagtcgagctgctcaatcaacttgaagaagaaaaacgcaaggtcgaggatcttcagtttcgagtcgaagaggaaagcattaccaaaggtgatctggagcaaaagtctcagatctcagaggacccagaaaatgtcgccaccgtatcggagaagtctcggatcatggagctgtag

SEQ ID NO: 30616 - DNA, 630 bp, Artificial Sequence
  Description of Artificial Sequence: Synthetic coding sequence
atggattttctgctggggaacccgttttccagtccggtggggcagcgaatcgaaaaggccactgatggctcattgcagtctgaagactgggcactgaatatggagatctgtgacatcatcaacgaaactgaggagggtccgaaagatgccttaagggctgtcaagaagaggatcgtgggcaataagaatttccatgaggtaatgctcgctctaacagtgctcgagacctgtgttaagaattgcggacatcggttccatgtcctcgtggcatcccaagacttcgttgagagtgttctcgtccgaacgatccttccaaagaacaaccccccaaccatcgtccatgacaaggtgttaaacctaattcaaagctgggctgacgcattcaggtcatcacccgatcttactggcgtggtgactatctatgaagatctgaggcgcaaaggcctcgagttccctatgacggacctggacatgctgagcccgatccataccccacggggtccctgctctacccagagacacaaccaggatagaattctctgggctctgacccccgcttcaaaacggacactggcctcgatgctccccctctgccctccacggccatactctccagttacgcgcccatag

SEQ ID NO: 30617 - DNA, 255 bp, Artificial Sequence
  Description of Artificial Sequence: Synthetic coding sequence
atggctgatacggatttattcatggagtgtgaggaagaagagctggaaccatggcagaagattagcgatgtaattgaggactccgtggttgaggactataactccgtcgacaagacaactactgctggcaaccccttggttcagcagggtggacagcctcttattctgacccagaatccagccccaggtctcggcaccatggtaacccagcctgtgttacgccctgtgcaggtgatgcagaatgctaaccattag

SEQ ID NO: 30618 - DNA, 618 bp, Artificial Sequence
  Description of Artificial Sequence: Synthetic coding sequence
atggctacccccctgggttggagcaaggcgggttctgggtctgtctgcctggcactcgaccagttgagagatgttattgagtcacaggaggaactgattcaccagctgagaaacgtcatggtgctgcaggacgaaaatttcgtgagcaaggaggaattccaagccgttgagaaaaagctcgtcgaagaaaaggctgcccacgccaagacaaaggtgcttcttgcgaaagaagaggaaaagctgcagttcgccctgggagaagttgaagtactctctaaacagcttgagaaggagaaattggccttcgagaaagcattgtcttctgtgaagagtaaagtgctgcaggagagtagcaagaaagaccaactcataacgaaatgtaacgaaattgagagtcacataattaagcaggaggacatcctgaatggtaaagaaaacgagattaaagagctgcagcaggtgatcagtcaacaaaaacagatctttcgaaaccacatgtccgacttcaggatccagaaacagcaggagagttacatggctcaggtgctggaccagaaacataagaaagcgagcggaactaggcaggccagatctcaccagcacccgagagagaaatag

SEQ ID NO: 30619 - DNA, 330 bp, Artificial Sequence
  Description of Artificial Sequence: Synthetic coding sequence
atggaaccaagtgcacagcaactgcagctggctgcctcactacctgctaacctcagcaacttttgccaaggcagcgaaatgccgacaacctctcggccagccctggacgttaagggaggaacatctccagctaaagaggacgccaaccaggagatgtccagtgtagcttactctaacctcgccgtgaaggatcgcaaggccgtggcaatactccactaccctggcgttgcttctaatggaactaaagccagcggcgcaccaacgagcagttccggtagcccaattggtagtcccacaaccactcctcccacgaagccgccatccttttag

SEQ ID NO: 30620 - DNA, 1737 bp, Artificial Sequence
  Description of Artificial Sequence: Synthetic coding sequence
atgccagaaattcgggtgacgccattaggggctggtcaggatgtggggaggtcttgcatcctggtttcaatcgctggaaaaaatgtgatgctcgattgtgggatgcacatgggctttaacgacgaccgacggttcccggatttctcttacattacacagaatgggcgtttaacagactttctagactgtgttattatctctcatttccaccttgaccattgcggtgcactcccgtacttctccgaaatggtcgggtacgacggacccatttacatgacgcacccaacccaggcaatatgcccaatcctgctcgaggattatagaaagattgcagtggacaagaagggggaggccaactttttcacttctcaaatgattaaggactgcatgaaaaaagtggtcgccgtgcacctgcaccagactgtccagatcaaggtggggtccgaaagcgtggtgtacactggagattacaatatgacccctgatcgccacttgggagccgcatggatagataagtgtcggcctaatttgctgatcacggagtcaacatacgctactaccattcgtgacagtaaacgctgtcgggagagagacttcctcaagaaagttcacgagacggtcgagcgagggggaaaagtccttatccctgtgttcgccctaggacgagcgcaggagctgtgtatccttctagagacattttgggagagaatgaatctgaaggtgccgatttacttctctaccggcctcacagagaaggctaaccattactataagctgtttatcccctggactaaccagaagattcgcaaaactttcgttcagcgtaacatgtttgagttcaaacatataaaagcattcgacagggcatttgccgacaaccctggtcctatggtagtctttgcaactcctggcatgctccacgccggacagagtctgcagattttccgcaaatgggctggaaacgaaaaaaatatggttatcatgccaggatattgtgtgcagggcactgtaggacacaaaattctctctggacagcgcaagctggaaatggaggggaggcaggtacttgaagtgaaaatgcaagtcgagtacatgtccttttcagcgcatgccgacgccaaggggataatgcagctggtcggccaggctgagccggaaagtgtgcttttggtgcacggtgaggccaaaaaaatggagttcctgaagcagaaaattgagcaggagttgagggtaaactgttatatgcccgctaacggcgagaccgtgactctccctacaagcccttctatccccgtgggcatctccctgggattactgaagagggaaatggcgcaaggactgttgccggaggcgaagaaacctcggcttctgcacggtaccttaataatgaaagatagtaactttcgtctggtcagcagcgaacaggcactgaaagagctgggcctggcagaacatcagctgcgctttacttgccgcgtccacctccacgacacgaggaaagaacaggagactgccctgagggtctattcccatttaaaatcagtgcttaaagatcactgtgtccagcacctgccggacgggtccgttactgtcgaaagtgtgctgcttcaagcggcagctccttctgaagacccgggaacaaaggtactactggtcagctggacttaccaggatgaggaactgggctcttttctgacatctttgttaaaaaaaggcctgcctcaggcccctagttag

SEQ ID NO: 30621 - DNA, 570 bp, Artificial Sequence
  Description of Artificial Sequence: Synthetic coding sequence
atgcagccaatgtcattcggctgggatcatagtctacataaacgcaagaggttgccacccgtcaaacggagtctggtttactatctgaaaaatcgggaagttcgcttgcaaaacgaaaccagctactcgcgggttcttcatggctacgccgctcagcagctgccttcgctcctaaaagaacgtgaattccatcttggcacccttaacaaggtgtttgcttcacagtggctgaaccatcggcaggttgtgtgcggtacaaaatgtaacactttgtttgtcgtagacgtccaaacctcgcagattaccaaaatccccatcttgaaggacagggaaccaggaggagtgacacagcaggggtgtggcattcacgccattgaactgaatccttcccggactctgcttgctactggtggagacaaccccaattcacttgccatctaccgccttcccactcttgatcccgtgtgcgtgggagatgacgggcataaggattggatattcagcattgcttggatctctgacaccatggctgtgagtgggtcacgcgatggatccatgggcctctggtag

SEQ ID NO: 30622 - DNA, 2289 bp, Artificial Sequence
  Description of Artificial Sequence: Synthetic coding sequence
atggcaagtctactgcaggaccaactcacaactgaccaggaccttttgctaatgcaggaggggatgccaatgaggaaagtgagaagcaagtcttggaaaaagttgaggtattttaggctgcagaacgatggaatgacggtctggcacgcacgacaagccaggggcagcgccaagcctagctttagcatttccgatgttgagaccattcgaaacggacatgacagcgagttgttaagaagcctggccgaggagttgccactggagcagggattcactatagtcttccacggaaggagaagcaatctcgacctgatggcaaactccgtggaggaggcccagatctggatgcgcggactccagctgctggtcgatctggtgacatccatggatcaccaggagcgactggaccagtggctgagcgattggttccaacggggtgacaagaatcaggatgggaagatgtctttccaggaagttcaacgcctactgcatctgatgaatgtggagatggatcaggagtacgcattcagtttgttccaggccgctgatactagtcagagtggaacgctggagggcgaagaatttgtccaattttataaagccttaacaaagcgggctgaggtacaggagctgtttgagtccttcagtgccgacggacaaaagttaactttactcgagttcctggactttctccaggaggaacagaaagaaagggattgtactagtgagctggccctggagttgatcgaccgatacgagccctccgacagtgggaagttacgtcacgtgttgagtatggatggtttcctgagctatctctgcagcaaggatggtgatatattcaatccggcatgtctgcctatttatcaggacatgacacagcctttgaatcattacttcatctgcagttcccacaacacctatctcgtaggcgaccagctctgcggccaatcttccgttgaggggtatattcgagcccttaaacggggatgccggtgtgtcgaggtggatgtgtgggatggccctagcggcgaacctgttgtctatcacggccacacactgacgtctaggatcctgtttaaagacgtagtggccacagtggcccagtacgcatttcagacgtccgactaccccgtgatcctgagtctggaaacccactgctcttgggaacagcagcagacgatggccaggcatctcacggaaattctgggggaacaactgctcagcacgactttagatggggttttgcctactcaattgccttcgcctgaagagctgcgccgaaagatactcgtgaaaggcaagaagctcacactggaggaggatttggagtatgaggaagaggaggctgaacctgagttagaagagtccgaactggctctggaatctcagttcgaaactgaacccgagccccaagagcagaatctccagaataaggacaagaagaaaaagagcaaacctatactctgcccggctctgtcaagtttagtaatctacctgaagtcagtatcgtttcgctcattcacacactcgaaggagcactaccatttttatgagatctcgtccttttctgaaacaaaggccaagcgcttaatcaaggaagccggaaacgagttcgtgcagcacaatacctggcagctgtccagggtgtaccccagcggcttgagaaccgatagttctaactataatcctcaggagctctggaacgccggttgtcagatggtcgcaatgaacatgcaaacagcaggactagaaatggacatatgcgacggacactttagacagaacggcggatgcggttacgtgctgaagcctgacttcctgcgggacatccagtcctcgttccatcctgagaagcccattagcccctttaaggcccagacacttttgatccaggtgatctcaggccaacagctgcccaaggtcgataaaacgaaagagggaagcatcgtggatccactggtcaaagtgcaaatttttggtgtgaggctcgacaccgctcgacaagagacaaattatgtcgaaaacaatgggtttaatccttactggggccagacgctgtgttttagagttctggtgcccgagctcgccatgctgcgattcgtggtaatggactatgattggaagtcacggaatgattttatcggccaatacactctgccttggacatgcatgcagcaggggtatagacatattcatctattgtccaaggacggaatatctctacgacctgcttccattttcgtctacatctgcatccaagagggactagagggggatgagagttag

SEQ ID NO: 30623 - DNA, 1362 bp, Artificial Sequence
  Description of Artificial Sequence: Synthetic coding sequence
atggccggagccgcaggccgtgtgcaggacagagccttgcggcgatttcccataaccttaccagtgggagatttatcaaatttacatttaaaagaggaaaaaataaaacctgacaccaacggcgcagttgtcaaaactaatgcaaatgctgagaaaacggacgaagaggaaaaagaggatcgcgctgctcagtcactgctgaacaaattgattcgtagcaatttagtagacaacaccaatcaggtagaagtgctgcaaagagatcctaacagtccgctgtactctgtaaagtccttcgaagagttgagactgcctcagaaccttatagctcagtcccagtcagggactgggaagactgccgcattcgtcttggccatgctttcccaggttgagcccgcaaacaagtacccacagtgcctctgcctgtcaccgacttacgaactggccctgcagacagggaaggttatagaacagatgggaaagttttacccagagctgaaactggcctacgccgtacgtggtaacaagctggagcgaggccagaagatctcagaacaaattgtgattggcaccccaggcacagtgctggactggtgtagtaaactaaagttcattgatccaaaaaaaatcaaagtattcgtgctggatgaagctgatgtaatgatagctacccaaggccaccaagatcaatccatcagaatacagaggatgttgcctcggaattgtcagatgctactgttctccgctacatttgaagactccgtgtggaagtttgcccagaaagtggtgcctgatcccaacgtgataaaattaaaaagagaggaagaaactctcgatactatcaaacagtattatgtgctttgctcatcccgggatgagaagttccaggccttatgtaacctgtacggcgcaataactatcgcacaggccatgatattctgtcacacccggaaaactgcgtcctggctggccgcagagctgagtaaggagggccatcaggtggccctgctgtccggggagatgatggtggagcagagagcagctgtgattgagagatttagagaggggaaggaaaaagtccttgttacgaccaatgtgtgtgcacgcggaatagacgtggagcaggtgtctgtggtgattaactttgacctcccggttgacaaggatggcaatccagacaacgagacctacctgcacaggatcggcagaaccggacggttcgggaagcgcggtctggctgttaatatggttgacagtaagcactcgatgaatatcttaaatcgcatccaggagcattttaacaaaaaaattgaaagattggataccgacgatttggatgaaatcgaaaaaattgccaattag

SEQ ID NO: 30624 - DNA, 921 bp, Artificial Sequence
  Description of Artificial Sequence: Synthetic coding sequence
atggctcgtgtgccccttggcaggtcactcaccctgagtcctcgcttggagcacaacggcatgacaagcgcgcatcataactttaggctgccagggagccgggacagtccggcttctgcatctcaggtggcggagatcatcgacctggagtggtacgaaaaaagcgaagagactcatgcctcgcagatcgagctccttgagacgtccagcactcaagaacctctgaacgcatccgaggcattttgccccagggactgtatggttcctgtggtgttcccaggccctgtaagccaggaggggtgctgccagtttacatgtgagttgttgaagcacatcatgtaccagagacagcagctgcctttgccctacgagcagcttaagcacttctataggaagccttctcctcaagccgaggagatgttaaagaaaaaaccacgagctaccactgaggtgagtagccgcaagtgccagcaagcgctggccgaattggaatccgttctgtcacacctcgaagatttttttgccagaacattggttccaagagttcttatcctgctgggaggcaatgcgctgagccccaaggaattttacgagctcgatctgtccttgctggccccatactccgtggaccagagcctttctacggcagcttgtctccgacggctgtttagagctatttttatggcagatgctttctcagaattgcaggctccgccactaatgggaaccgtggttatggcccagggccatagaaattgtggtgaggactggtttagaccaaagcttaattacagagttccctctaggggccacaaacttactgttactctgtcctgtgggagaccttccatcaggacaacagcttgggaagactatatctggttccaggcccctgttacctttaaggggttccgcgagtag

SEQ ID NO: 30625 - DNA, 426 bp, Artificial Sequence
  Description of Artificial Sequence: Synthetic coding sequence
atgcctcagctccttcagaatatcaacggaataattgaggcattccggcgttacgccagaacggagggcaattgcacggctctgacaaggggcgagcttaaacgcttgctggaacaggagtttgcggatgtcatcgtgaaacctcatgacccggctacagtggacgaggtgcttcgattgttggatgaggaccatacaggcactgtagagtttaaggaatttctcgtgcttgtgttcaaagtggctcaggcatgtttcaagacactgagcgaatccgccgagggggcttgtggcagtcaagagtctggcagcctgcactctggagcatcacaggagctggggttcaggcccagagtgcgtcctctcgccttaaggggttctgctgcaatgaccggaaagttgtctcccagagcacggaaggagtag

SEQ ID NO: 30626 - DNA, 480 bp, Artificial Sequence
  Description of Artificial Sequence: Synthetic coding sequence
atggcgactagcgcgccactccgatctttggaggaggaagttacctgttcaatatgtctggactatctccgcgatcctgtaacaattgactgtgggcacgtgttttgtcgatcatgtaccaccgatgtgcggccaatctcaggatcccggccagtgtgccccttgtgtaagaaaccgttcaaaaaggaaaacatcaggcctgtgtggcagctagagaaaatcttgaaccatctctctactctgcgaagagatagggataaaatacaaggcttccaggccaaaggggaggctgatatcttggcagcacttaagaaacttcaggatcagcgacagtacatcgtcgccgagttcgagcagggccaccagttcctgagggaaagagaggaacacctgctcgaacaactggcaaaactggaacaggagctaacagaagggagggaaaagtttaaatcaagaggggttggagaattggccagatag

SEQ ID NO: 30627 - DNA, 1506 bp, Artificial Sequence
  Description of Artificial Sequence: Synthetic coding sequence
atggattttctcctggggaatcctttcagtagcccagtcggccagaggattgagaaggccacagacggttccttacagtccgaggactgggccttgaacatggagatctgcgacataattaacgaaactgaagagggcccaaaagacgcccttcgagcggtgaaaaaacgcattgtgggcaacaaaaacttccacgaagtcatgcttgctcactccgcccgacggcatctcagtgcactacaggttctggaaacatgcgtgaagaactgtggacatcgctttcatgtccttgtggcctcgcaggacttcgtggagtcagtgctagtgcggactattctcccaaaaaataatccaccgaccatcgtacatgacaaagtcctgaatctgattcagagctgggccgacgcttttcgctcatcacctgacctgaccggggtggtgacgatatacgaggacttgcggagaaaggggttggagttccctatgacagatttagacatgctttcgcccatccatacccctcagaggacggtcttcaattccgagacacagtccgggcaggattccgtgggtaccgattcctcacagcaggaggactccgggcagcatgcagcgccactccccgcacccccaatactgtctggagatacccctattgcacctacaccagaacagattggcaaacttcggtcggaactggagatggtgagcggaaatgtgagagtcatgagcgaaatgctaaccgagttggtccctacccaagcagagcccgcagatttggagctgctacaggagctgaatagaacctgtcgagctatgcagcagcgtgtgctggaactgatcccccaaatcgctaatgaacagttgacagaagaacttttgatcgttaacgacaacctcaataacgtgtttttgcggcatgaacggttcgaacgtttccgcaccggccagaccaccaaagccccaagcgaggccgagcccgctgcagacttgatcgatatgggtcccgaccccgctgcgacaggcaatttatcgagccagctcgctgggatgaatcttggctcgagttcagtgagggccggtctgcagagccttgaagcatcgggccgtctggaggatgaatttgacatgttcgctctcacgagggggtctagtctggcagaccagaggaaagaggtgaagtatgaagctccccaagccactgatggcctggccggagcgttagacgctaggcaacagtccaccggagccattccagtaacccaggcttgcctgatggaggatattgagcagtggctcagcaccgatgtggggaacgacgctgaagagcccaaaggggttaccagcgaagagttcgacaaattcctggaagagagggccaaggccgcagaccgcctgcccaatctgagctctccttccgctgaagggcctccgggacctccctctggtcctgcacccagaaaaaaaacccaggagaaagacgatgatatgctgtttgcgttatag

SEQ ID NO: 30628 - DNA, 117 bp, Artificial Sequence
  Description of Artificial Sequence: Synthetic coding sequence
gaacccgtttactttgctgagaaggtgatgtcactggggcgaaactggcacaggccctgtctacggtgccagcggtgtcacaagaccttgactgctggatcccatgccgaggtgtag

SEQ ID NO: 30629 - DNA, 1122 bp, Artificial Sequence
  Description of Artificial Sequence: Synthetic coding sequence
atggcacaggagtcccccaagaactctgctgccgaaatcccagtcacaagcaacggggaagttgacgattctcgcgagcattcatttaatagggacctaaaacactcccttccctccggattaggactgtccgagacccaaattaccagccacgggtttgacaacaccaaggagggagttatcgaggctggcgcatttcagggctctcccgcaccacccctcccttctgttatgagtccatctagggtggccgcaagccgtctcgcccagcagggcagcgatctcattgtacctgcaggaggccaaaggacccagaccaagagcgggccagtcattcttgcagacgagatcaaaaacccggcaatggagaagctggaactggtaagaaagtggagtctgaacacttacaagtgcaccagacagatcatcagtgagaaactaggcaggggttccaggactgtggatttggagctggaggcacaaatcgacatcctgcgcgacaataagaagaagtacgagaacatcttaaagcttgcacagacattgagcacccagctgtttcaaatggtgcacacccagagacagttgggggacgccttcgccgatttgtctcttaaaagcttggagctgcacgaagagtttggttataacgccgacacccagaaactgttagccaaaaatggtgagaccctcctgggcgcaatcaatttcttcattgcctcagtgaatacgctcgtgaataagaccattgaagacactttaatgacagtcaaacagtacgagagtgctcgcatcgaatacgatgcatacagaaccgacctcgaagaactgaatttaggcccaagagatgctaatacactgcctaagattgagcagtcgcagcatttgtttcaagcccataaggagaaatatgataaaatgcgcaacgatgtgtccgtaaaacttaaatttctggaggagaacaaagtcaaggtcttgcacaatcagctggtactatttcataatgctattgccgcatactttgcgggaaaccaaaagcagctggaacagaccctgaaacagttccacattaagctgaagaccccaggagtcgatgctccatcttggctcgaagaacagtag

SEQ ID NO: 30630 - DNA, 453 bp, Artificial Sequence
  Description of Artificial Sequence: Synthetic coding sequence
atgcacacaggcgatcccaagcaagacttggcctatgaacggcaatacgaacagcagacttaccaggtcattcccgaggtgattaagaattttattcagtatttccataagactgttagcgacctgatcgaccagaaggtctacgagctgcaagcctcccgcgtgagcagcgacgtgattgaccagaaggtgtacgaaatccaggacatttatgagaatagctggactaaattgaccgagaggtttttcaagaataccccatggcctgaagccgaggctatagcaccacaggtgggtaacgatgctgtctttctgattctgtacaaggagctgtattacagacacatctacgctaaggtgtctggcggaccctcactggaacaacgctttgagagctactataactactgtaacctgttcaattatatcctcaacgctgatggccctgcctag

SEQ ID NO: 30631 - DNA, 2136 bp, Artificial Sequence
  Description of Artificial Sequence: Synthetic coding sequence
atggcaatgcaggagaaatatcctacagaagggatcagtcatgtgacatcaccgaatttttgttcttcaagtggatcccctccgttccagcctattaagtcccatgtcaccatccccaccgctcacgttatgcctagtaccctgggaacttctccagccaagcccaactccacacctgtgggtccatcatcttccaaattgcctctttcaggcttagcagagtccgtaggcatgacacggaatggggacctgggtgcaatgaagcacagccctggactaagtcgcgacttaatgtacttcagtggggcaaccggcgagaacggaatagaacagtcatggttccctgcagtggggcacgaaagacaggaagaggccaggaagtttgacatacccagtatggaatctacactgaaccagagtgcaatgatggagactctctattctgacccgcaccatagggtaaggttccataacccgaggacaagcacatctaaggagctgtacagggtgcttcccgaggcaaagaaggctcccggttctggcgcagtgttcgaaaggaatgggccacactccaactcatcaggtgtgctaccgctagggttgcaacccgctccaggtttgtcgaagccgctgccaagtcaggtgtggcagccatccccagacacttggcaccctagggagcagtcatgcgagctgtccacctgcaggcaacaactggaattgatccggttgcagatggaacagatgcagctccagaatggtgctatctgtcaccacccggctgccttcggtccatccctgccaatcctcgaaccggctcaatggatctcaatcctgaattccaatgagcatctgctgaaagagaaagagcttttgattgacaagcagaggaagcacatctctcagctcgagcaaaaagttcgcgagtccgaactacaggtccactccgccttgctgggaaggcctgcacccttcggtgatgtgtgcttgcttaggctgcaggagcttcagagagaaaacacttttctaagagctcagtttgcccagaaaaccgaggccctcagccgggagaaaatcgatctcgagaagaaacttagcgcgtccgaagtagaagtgcagctcataagagaaagcctaaaggttgccctgcaaaagcattcagaggaagtgaaaaaacaggaggaacgcgtgaagggcagagataaacatatcaacaatcttaagaagaagtgccaaaaagaatccgaacaaaatagggagaaacagcagcgaattgaaacactggaaagatacctggcagatttgccaacccttgaagaccaccagaagcaatcacagcagttgaaagactctgaattaaagtccactgagctgcaggaaaaagtcacagaactggaatctctgctcgaagagactcaagctatctgtagggagaaagagatccagctggagtcccttcgccagagagaggcggagttttcatcagccggtcattctctgcaagataaacagtctgtggaggaaacatcaggagagggacccgaagtcgaaatggagagctggcagaaacgctatgattcgctgcaaaagatagtggaaaaacaacagcagaaaatggaccaactcaggtcccaggtgcagagtcttgagcaggaggtggcacaggaggaggggaccagccaggcgctcagggaagaagcccagaggagggacagtgcgctccagcagctgcgtacagccgtgaaggaactctcagtgcagaaccaggacttaatcgaaaaaaacctcaccctccaagaacaccttcggcaggctcagcccggttccccgccttcgcctgacacggcccagttggctctagagctgcatcaagaactggcctcgtgtttgcaggacctgcaggccgtgtgctcaatagtgacacagcgcgctcaaggccacgatcccaacctctctctgttgttggggatccattcggcacagcaccccgaaacccaactcgacctccagaagccagacgtgattaaacggaagctcgaagaagtgcaacagctaaggcgtgacatagaggatctgaggactaccatgtccgataggtacgcacaggatatgggcgagaattgcgtcacgcagtag

SEQ ID NO: 30632 - DNA, 531 bp, Artificial Sequence
  Description of Artificial Sequence: Synthetic coding sequence
atggccgctgcaacaggagatccaggcctctctaaattgcagttcgcccctttttcctctgccttggatgtaggattctggcatgaattaactcagaagaagctcaatgagtaccgcttggacgaagcgccaaaggacataaaggggtattactacaatggggatagcgctggactccctgctcggctgactctggaattctcagctttcgatatgtccgcaccaacgccagccagatgttgtccggctatcggaactttgtataacaccaacaccctagagagctttaaaactgcggacaaaaaactcctgctggaacaggccgctaatgaaatttgggagagtatcaaaagcggaactgcattggaaaacccagtcctcttgaacaaattcctgctcctgacattcgcagacctcaagaaataccacttttattactggttctgttatcccgcactgtgtctgcctgagtcactcccactcattcagggacctgtcggcctggaccagcgcttcagtcttaaacaatag

SEQ ID NO: 30633 - DNA, 1443 bp, Artificial Sequence
  Description of Artificial Sequence: Synthetic coding sequence
atgaagctgaaggagctggagagaccagccgtgcaggcttggtcccccgcttcacagtatcccttatatttggcaactggaactagcgcccaacaactcgactctagcttctccaccaacgggaccctggaaatcttcgaagttgacttccgcgatccgagtctcgatctgaagcacagaggcgtgctaagcgccctgtcacgctttcacaaactggtgtggggctcttttggctccgggttgctcgagtctagcggcgtgatagtgggcggaggcgacaatggcatgctgattctgtacaacgttacccacatactctcctcaggcaaagagcctgttatcgcccagaagcaaaaacatactggggctgtgcgagcactggatctgaatccctttcagggtaacctactcgcctccggagctagcgactccgaaatctttatctgggatctgaacaatctgaacgtgcccatgactctcggtagtaagtcccagcaaccgcctgaagatataaaggccctatcttggaatcgccaggcccagcacatcctgagttcggctcaccctagcggcaaagccgtcgtttgggatctcaggaaaaacgagccgatcatcaaggtgtccgaccactcaaatcgtatgcattgtagtggtctggcctggcatcctgacatcgctacccagctggtgctctgcagcgaggatgaccgacttccagtaattcagctctgggatcttcgcttcgccagcagtcctctgaaggtactggaaagtcatagccgcggtatcctgtccgtgagctggtcacaggcggacgccgaactgcttctgacatcagccaaggactcccagattctgtgccgcaacttgggtagttcagaggtggtgtacaagctgccgacccagtcctcatggtgctttgacgtacagtggtgcccccgtgatcctagcgttttctccgccgcttcgttcaatggatggatctcattgtacagcgtcatgggaagatcctgggaggtccagcatatgagacaggcagataaaatctcgtcttccttctcaaagggtcagccacttcccccactgcaagtgcctgagcaagtggcacaggcccctctaattcctcctttgaagaagcccccaaagtggattcgcaggcccaccggcgtttcattcgcttttgggggaaaactggtgactttcggcctcccttcaactcccgcacacctggtaccacaaccatgtcccaggctggtgtttatctctcaggtgaccacagaatcagagttcctgatgcgcagcgccgaattacaagaggcactgggaagcggaaatttactgaattactgccagaacaagtcccagcaggcacttctccaaagtgagaaaatgctttggcagttcctgaagcctgcacgagactcgagcggcgctcgtcgctag

SEQ ID NO: 30634 - DNA, 1842 bp, Artificial Sequence
  Description of Artificial Sequence: Synthetic coding sequence
atggcaaccataccggactggaaactacagctattggccagaaggcgtcaggaagaggcgagcgtgagaggcagggaaaaggccgagcgcgagagactgtctcagatgcctgcctggaagaggggcctgctggagaggcgcagggccaaactggggttgtcacctggggagcccagtccggtcctggggactgtggaagccggacctccagaccccgatgagtctgctgtcctgctcgaggctatcggccctgttcaccaaaacagattcataaggcaggagcgacagcaacaacagcagcagcagcagcggtccgaggaattacttgccgaaaggaagcctggcccactggaggctcgagagcgacggccttcaccgggagaaatgagggatcagagccccaaagggcgtgaaagtagagaggagcgactaagtccgcgagagactcgagagcgccgtctgggaattgggggagctcaggagctatcattacgtccattggaagctcgtgactggaggcagtctccaggcgaagtcggcgacagaagcagccggctgtcagaggcctggaagtggagactgagcccaggcgaaacacctgaacgatccttacggctcgccgaatccagagagcagtccccccgtcgaaaggaagtcgaaagtcggcttagtcccggtgagagcgcctatcagaaactcgggttgaccgaagcccacaaatggcgaccagactctcgagagtcacaggaacagtccctagtgcaattagaggcaacggaatggcgcctccgctctggagaggaacggcaagattattctgaagaatgcggcaggaaggaagaatggcctgtgcccggagtcgctccgaaagaaacagcagaactctccgaaacattgacccgtgaggcacaaggtaatagcagcgccggagtggaggctgcagagcagcgacccgtggaagacggggagagagggatgaaacctaccgaggggtggaaatggactctgaactctgggaaggcgagggagtggacccctcgggatatcgaggcacagacccagaagcctgaaccacctgagtctgcggagaagcttttggaatccccaggagtggaggccggagagggcgaggcggagaaggaggaagctggggctcagggtcgccctctgagagctttgcagaattgctgttccgtccctagtccacttccccctgaggacgcaggaactgggggactgcgccagcaggaagaggaagcagtggagttgcagcctcctcctcctgcgcctctgagccctccccctcccgcaccgacggcaccacaaccccctggggatcctcttatgagcaggttattttacggcgtcaaagctggacctggtgtgggggcaccaaggaggagcgggcatacctttaccgtcaatccaaggaggagtgtgccacccgcaaccccggctacacccacaagccccgcaacagttgacgcggctgtgcccggagccggaaaaaaacgctaccctactgctgaggaaatcctggtgctaggaggctatctcaggctcagccgtagctgcctagctaagggttcccctgagcggcaccacaagcagctgaagatctccttttcagagactgccctagaaaccacctaccagtacccctccgagtcctccgtactcgaagagcttggaccagaacctgaagtgcctagcgctcctaacccccctgccgcacagcccgacgacgaagaagatgaagaggagctgttactgttgcagcccgaattgcagggcggtctgagaacaaaggctctgattgtagacgagtcatgccgacggtag

SEQ ID NO: 30635 - DNA, 1446 bp, Artificial Sequence
  Description of Artificial Sequence: Synthetic coding sequence
atggctagcgctgcttctgttacctctcttgcagacgaagtgaattgcccaatctgccagggcactctccgggaacccgtgactatcgactgtggccataatttctgtcgcgcatgcctcacaagatattgcgagatccctggaccagatctcgaggagtctcccacctgtccactgtgcaaagaacctttccgcccaggatccttccggccaaactggcagctagcaaatgtggtcgagaacatcgaaaggctgcaactggtttccacattggggctgggcgaagaagacgtgtgtcaagagcatggcgaaaagatctatttcttttgcgaggacgatgagatgcagttgtgcgttgtctgccgggaggccggagaacatgccacacatacaatgagatttctggaggacgccgcagcaccctacagagagcagattcacaaatgcctaaagtgtttgcgcaaagaaagagaggaaatccaggagatacagagtcgggaaaacaaacgaatgcaggtcctcctgacacaagtatccaccaaacgtcagcaagtcattagtgaattcgctcatctacgtaaatttttggaagaacagcaatctattctcctagcccaactcgagagccaggacggtgacatcctccgtcagcgagacgaattcgacctgctcgtagccggagagatatgtaggtttagtgcattgatagaagagctggaggagaagaatgaacggccagccagagagttgctgactgacattaggagtacactgatccggtgcgaaaccaggaagtgccggaagccggtggccgtttccccagaacttggacagagaattagagattttccacagcaggcccttccccttcagagggagatgaagatgttcctggagaagttgtgtttcgagcttgattatgagcccgctcatatttcactcgacccgcagacctcccacccgaagctgcttttaagtgaggaccatcagagagcccagttctcttataaatggcagaacagccccgataaccctcaaaggttcgacagagccacatgtgtgttagctcacaccggcataactggtggacgacacacctgggttgtgagcattgacctagcacatggagggagttgtaccgtgggcgtagtgagcgaagacgtgcagcggaagggtgaactgcggttgaggcccgaggagggcgtgtgggccgtgcgtctcgcatggggcttcgtgtccgccctgggcagcttccctactaggctgacacttaaagaacagccacggcaggtccgggtcagcctcgactatgaagtgggatgggtaaccttcactaatgccgtgacaagagagcctatttatacgttcactgctagctttactaggaaggtgatcccgtttttcgggctgtggggtaggggctcttccttttccctgagtagctag

SEQ ID NO: 30636 - DNA, 537 bp, Artificial Sequence
  Description of Artificial Sequence: Synthetic coding sequence
atgtcgagtaatgagtgcttcaagtgtgggcgtagcggacattgggcacgggaatgccctaccgggggaggccgtgggagggggatgcggagcaggggaaggggcggttttacttccgataggggctttcagtttgtgtcctcctcactccccgatatttgctacaggtgcggggaatccggacatttggctaaagattgcgatctacaagaggatgaagcctgctacaattgcggtcggggtggacacatagccaaagattgcaaagaacctaaacgtgaaagagaacagtgctgttacaattgtggaaaaccgggtcatctggcccgagactgtgaccacgccgacgaacagaaatgctatagctgcggagaattcggccatatccaaaaggactgcacgaaagtgaagtgctataggtgcggcgagacaggacacgtggcgatcaactgttccaaaacctctgaagttaattgctatagatgtggagaatcaggtcacctggcgagggagtgcacgattgaagccacagcatag

SEQ ID NO: 30637 - DNA, 87 bp, Artificial Sequence
  Description of Artificial Sequence: Synthetic coding sequence
atggcaatggctccttcgccaagtctagtgcaggtgtacacaagtccagctgccgtagccgtgtgggaatggcaggatgggctctag

SEQ ID NO: 30638 - DNA, 603 bp, Artificial Sequence
  Description of Artificial Sequence: Synthetic coding sequence
atggctgccactgctcgtgaggatggggcttccggccaggaacgtggtcagagaggttgtgaacactacgaccgcggatgcctgctcaaggcaccatgctgtgacaagctctatacctgtcgattgtgccatgataataatgaagaccaccagcttgatcggtttaaagtgaaggaggtacagtgtattaactgtgagaagatacagcatgcacagcagacctgtgaagagtgtagcacattattcggtgagtactattgcgacatctgtcacctgtttgacaaggataaaaagcagtaccactgcgagaattgcggaatatgtcggattggacctaaagaggacttcttccactgtctgaaatgcaacctgtgcctggctatgaatctccaaggacgacataagtgcattgaaaatgtgtcgcgacagaactgcccaatttgcctggaagatatccatacttcacgcgtggtagctcacgttctgccctgcggacatttgctgcatcgcacctgctatgaagagatgcttaaggaattgcagatgagtataatgtatgctttgtgttttagatatgaccaggttctggaaacggcaggttag

SEQ ID NO: 30639 - DNA, 567 bp, Artificial Sequence
  Description of Artificial Sequence: Synthetic coding sequence
atggcaacgccactcgggtggagtaaggcaggatcgggttctgtatgtttagccttagaccaacttagagatgttattgagtctcaggaagagctgattcaccagctgcgaaacgtgatggtgcttcaggatgaaaatttcgtgagcaaggaagaattccaagctgttgaaaaaaagctggttgaggagaaggccgctcatgccaaaaccaaagtgctgctggcaaaggaggaggagaaactgcaattcgctctgggcgaagtcgaagttctcagtaaacagctggagaaggaaaagctcgccttcgagaaggctctgtctagtgttaagtcaaaagtactacaagaaagttcaaagaaggaccaattgattactaagtgcaacggcaggcgcgaggcacgggcactgcatcatggatacataaacggcctgttcccgaatcaccccgtccctgtatccaaagctgggttccacagcaacacttgcccacaacttcgaattcaggccggtcctggcggaccccacctgaggaaagggctgaaagggccaggaaggccgaggaagtag

SEQ ID NO: 30640 - DNA, 381 bp, Artificial Sequence
  Description of Artificial Sequence: Synthetic coding sequence
atggacagatcaaaacggaatagcatcgccggatttccacctcgtgtcgagcgactcgaggaatttgaggggggaggagggggagaggggaatgtgagccaggtcggtcgagtgtggcctagtagctaccgcgctcttatctccgcattttctcgactgacccgcctggatgacttcacatgcgaaaaaatcggcagcgggttcttctcagaggtcttcaaagtcaggcacagagcctctggacaagtgatggcattaaagatgaacactctgagcagtaatagagccaatatgcttaaagaggtgcagctgatgaacagactgtcccaccctaacatcctgaggtgtagatccatgaatcagaatttcagtccaaattag

SEQ ID NO: 30641 - DNA, 1443 bp, Artificial Sequence
  Description of Artificial Sequence: Synthetic coding sequence
atggagacagatctgaattcgcaggatagaaaggatttggataaattcattaagtttttcgccctgaaaactgtccaagtgattgtgcaggcaagactcggtgaaaaaatctgcacccgttcctcctccagcccaaccgggtccgactggttcaatcttgctatcaaagatattccggaggttactcacgaggcgaaaaaggcgctcgccggacagctgcctgcggttggacggagcatgtgtgtggagatctctctaaagacaagtgagggcgattcaatggaactggagatctggtgcctggagatgaacgagaaatgcgataaagagattaaggtcagctacacggtgtataatcggctatcgctgctcctcaaatctctgttggccattacccgggtaacccctgcatatagactcagcagaaagcagggtcacgagtatgtcatcctttatcgtatctattttggggaggttcagttatcaggcctgggcgaggggtttcagacagtcagagttggaacggtggggaccccggttggaactattaccctatcttgcgcatatcgaattaacctggcctttatgtccacaagacaattcgaaagaacacctcccattatgggcatcatcatcgatcattttgtcgatagaccttaccctagtagctctcccatgcacccttgtaattatcggactgccggagaggacactggcgtgatctacccgagcgtggaagacagccaggaagtctgtacaacctcgttctcgacttcgcctccttcgcagttaatggttcccggaaaagagggcggagtgcctctggcacccaaccaaccggtgcacggaacacaggcggaccaggaaagactagccacatgcaccccctcagacaggactcactgcgccgctacgccttcaagcagcgaagacacagagacggtgtctaactcctcggaaggacgggcaagccctcacgatgtgctcgagacaattttcgtgaggaaggtgggtgcattcgtcaacaagccaatcaaccaggttaccctcacatcgctggatattccattcgctatgttcgccccaaagaacttggagttggaggacactgacccaatggtaaacccccctgatagtccagagacagaatctccactgcaaggatcgttacactctgacgggagcagtggaggctcatctggcaacacccatgacgactttgtgatgattgactttaaacctgcgttctctaaggatgacatacttccaatggatctggggacattctacagggaatttcaaaatccccctcagctcagttccctctcaattgatatcggtgcacaaagcatggccgaggatttggacagcctgcccgaaaagctggctgtacacgagaaaaatgtacgcgagtttgacgccttcgtggagaccctgcaatag

SEQ ID NO: 30642 - DNA, 390 bp, Artificial Sequence
  Description of Artificial Sequence: Synthetic coding sequence
atggccgagctgatccagaaaaaacttcagggggaggttgagaaataccagcagctgcaaaaagacctctccaaatctatgtcgggccgtcagaagctggaagcccagcttactgagaataacatcgtgaaggaggagctggccctcctagacggaagcaacgtcgtgttcaagttgctcggtcccgtgctggtaaagcaggagttaggcgaagcgagggcaaccgtcggtaagcgactcgattacattactgcagaaatcaagagatatgagtctcagctcagagatctggaaagacagagcgaacagcaacgggagaccctggcacagctccagcaggagttccagcgagctcaggccgcaaaggcaggggcacccggaaaagcatag

SEQ ID NO: 30643 - DNA, 348 bp, Artificial Sequence
  Description of Artificial Sequence: Synthetic coding sequence
atggtggaggacgaattagccctgttcgacaaaagtatcaatgagttttggaataagtttaaatcaactgatacatcatgtcaaatggccggattacgcgacacctataaagacagcattaaagcattcgccgagaaactctcagtcaagctgaaggaagaggaacgcatggtagagatgttcctggagtatcaaaatcaaatcagtcgccagaataagctcatccaggagaagaaagacaacctgctcaaactgattgcggaagtcaaagggaaaaagcaggagctggaggttctgaccgcaaatattcaggacctaaaggaggaatactcacggaagaaggaatag

SEQ ID NO: 30644 - DNA, 402 bp, Artificial Sequence
  Description of Artificial Sequence: Synthetic coding sequence
atggccagcagtgccagggagcatctgttattcgtgcgaaggcgcaatccccaaatgcgatatacattaagtccggaaaacctacaatcgctcgccgcacagagctctatgccagaaaatatgaccctgcagagagccaatagtgacactgacctcgtgacttccgaaagccgctcaagtctcacagcctcaatgtatgagtacactctaggtcaggctcagaatctcattatcttctgggatatcaaggaagaagtagatccctctgactggatagggctctaccatattgatgagaactcacccgctaacttttgggactccaagaacaggggggtgactggcacccaaaaaggtcagattgtgtggagaattgagcctggcccttacttcatggagtag

SEQ ID NO: 30645 - DNA, 264 bp, Artificial Sequence
  Description of Artificial Sequence: Synthetic coding sequence
atgtcactattcggaacgacgtccgggtttggtacgtctggtacaagcatgtttggctcagccaccaccgataaccacaaccccatgaaagacattgaagtaacttcctcgccggacgattctatcgggtgtctcagcttttcaccacccacgctgccaggtaactttcttatcgcaggttcctgggccaacgatgtaaggtgctgggaggtgcaggatagcggacagactattcccaaagcacaacagatgcacaccggatag

SEQ ID NO: 30646 - DNA, 1329 bp, Artificial Sequence
  Description of Artificial Sequence: Synthetic coding sequence
atggccaacagtttcgccgctaggatctttaccactctgtctgacctccaaacaaatatggccaatctgaaagtaattggtatcgtgattggaaaaacagatgttaaaggtttccctgaccggaaatccattggctctgagaggtatacgttttcctttaccatcagagactctccagcacattttgtaaatgccgctagttggggcaacgaagattacattaagtctctctccgatagctttagagttggagactgcgtcatcatcgagaaccctctcattcagcgcaaagagattgaaagggaagaaaaattcagccctgccactcccagtaattgtaagctgcttctgagcgaaaatcactcaaccgtcaaagtatgctcctcgtacgaggtagacacgaagttgctgagtctgatccacctgcccgttaaagaatcccacgactattacagtctgggcgacatcgtggctaacgggcatagcttaaacggaaggatcatcaacgtcctcgctgcggtgaagagcgtcggggagcccaagtacttcacaacttcggaccgaagaaaaggacagagatgtgaggtgagactctacgacgaaacagaaagtagctttgcaatgacttgttgggataacgaaagtattcttctggcccagtcttggatgcccagagaaaccgtgatctttgcgagcgacgtaaggatcaacttcgacaaatttcgcaattgtatgacagctaccgtgatcagtaaaactataattacgactaacccagatattccagaagccaatattctgctcaatttcattagagagaacaaggagactaacgtgctcgacgatgagatcgacagctactttaaggagtctattaatctcagtactatagttgacgtgtataccgtagagcagctgaaaggtaaagcactaaaaaatgaaggtaaagccgacccaagttacggtatcctctatgcctatatttctacactgaacatcgacgacgagacaaccaaagtagtccgcaatcgttgctcctcctgcggttatattgttaacgaggcttccaacatgtgcaccacatgtaacaagaactctctcgattttaagagcgttttcctgagttttcatgtactgatcgacctcacagaccatacagggacactccatagttgttctctgaccggctcagttgccgaagaaacactgggatgcacattcgtgctctctcaccgagctcgctccggcctgaagatctcagttttaagttgtaagctggcggatcctaccgaggccagtaggaacctgtcaggccagaaacacgtttag

SEQ ID NO: 30647 - DNA, 651 bp, Artificial Sequence
  Description of Artificial Sequence: Synthetic coding sequence
atgaacaaccagaaacagcaaaaacccacattatccggccagagatttaaaacccggaagcgtgacgagaaagaacgctttgaccctacacaattccaggattgtattattcaggggctcaccgaaaccggcacagatttagaggccgttgccaagtttttagacgccagcggcgctaaactggattaccggaggtatgcagagaccctattcgatattcttgtggcagggggaatgctggctccgggaggtactctggccgacgatatgatgagaacggatgtctgcgtgttcgccgctcaggaggatttggaaacgatgcaggcctttgctcaagtctttaataaactcatccgaaggtataaatacctggagaaggggtttgaggacgaggtaaaaaagctcctgctctttctgaagggattctctgaaagtgagcgaaacaaacttgcaatgctaactggagtgctgctggccaacggaacactcaacgccagcatcctaaattccctgtataacgaaaatctcgtgaaggagggggtttctgccgctttcgcagtgaagctttttaagtcttggataaacgagaaggacattaatgcagtggcagccagcttaaggaaagtgtctatggacaaccgtctgatgtag

SEQ ID NO: 30648 - DNA, 429 bp, Artificial Sequence
  Description of Artificial Sequence: Synthetic coding sequence
atgaatgaggtggtgcacaccagtcctactataggaagtaacgtggaggagatcgtgatcaacaataccaggttccttatgtgggacattggaggccaggaatcactccggagctcatggaatacctattacaccaacactgaatttgtcattgtcgtagtggactccacagatagggagcgaatttcagtaactagagaggaactttacaaaatgctggcgcatgaggatctcaggaaagccggactactcatctttgccaacaaacaggacgtgaaggaatgcatgacagtcgccgagatcagccagtttctgaagttgacaagtattaaggaccaccagtggcacatccaagcctgctgtgcactgacgggcgagggactttgtcagggactagagtggatgatgagtaggttgaaaatccgctag

SEQ ID NO: 30649 - DNA, 447 bp, Artificial Sequence
  Description of Artificial Sequence: Synthetic coding sequence
gccattcacatcctggacgtcctggtgttgaatggcaccgacgtccgggagcagcacttcaaccagcgcatacaactggctgagaagttcgtcaaagcagtgtcaaagcctagccggccagacatgaaccctattcgagtgaaggaagtctatagactggaggagatggaaaaaatattcgtgcggctggaaatgaaaatcatcaagggatcgagcggcactcccaagctgtcatatacaggtcgggatgacagacatttcgtgcccatgggcctctatattgttcgtaccgtgaatgaaccctggacgatggggttctccaagagctttaagaagaagttcttctataacaagaagactaaggattccacttttgacctcccctattatccatttccaagctttttttttccaaatcgccgatacaatttgctgttgtttgtgtag

SEQ ID NO: 30650 - DNA, 300 bp, Artificial Sequence
  Description of Artificial Sequence: Synthetic coding sequence
atggaggagattcccgctcaggaggccgcaggcagtccacgcgtacagtttcagtcacttgagacccagtctgagtgtctcagccccgagccacagtttgtgcaggatacagacatggagcagggcttgactggcggtatactgctgagacttccaactaccaggatacacagcgtgaattcatgcccagcgctctctcacacccaggcttcagccttctccggagagaccctggccgtactgaccgcaggaatcagcaaaaggtggccaaagtatagactgcccatagacattgcctag

SEQ ID NO: 30651 - DNA, 2493 bp, Artificial Sequence
  Description of Artificial Sequence: Synthetic coding sequence
atgaagcggggacggctcccctcatccagcgaagattccgacgataacggatctctgagcacaacatggtctcagaacagcagaagtcagcataggcgttcttcctgctcgcgacacgaagaccgcaagccctctgaggtgttccgtaccgatctgattacagctatgaagctgcacgattcctaccaactaaaccccgatgagtattatgtgttagccgatccttggcgacaggagtgggagaagggagtccaagtccccgtcagtccgggtacaattcctcagccggttgctcgccctaaaaagtacattgttagttcagggagtgagccacccgagctgggttacgtggatatcagaaccctggccgattccgtttgccggtacgatctcaatgatatggacgcagcatggctagagctaactaatgaggaattcaaggagatgggcatgcccgagctcgacgaatatactatggagagagtactcgaggaatttgagcaacgctgttacgataacatgaaccacgctattgaaactgaagagggcctgggaatcgaatatgatgaagacgtggtatgtgacgtctgtcagtcgcctgacggggaggacggcaatgaaatggtcttctgcgataagtgcaatatctgcgttcaccaggcttgctacggaatactgaaagtgccagaggggagctggctgtgccgcacatgtgctctcggtgtacagcccaagtgcttgctgtgcccaaaaaaaggaggagctatgaaacccacccgctctggaactaaatgggtgcacgtgtcgtgtgcgctgtggatccctgaagtcagtataggatctcctgagaaaatggaaccaattacaaaagtcagccacatccccagcagcagatgggccctggtgtgctctctgtgcaatgagaaatttggggcatcgatccaatgctcagtgaaaaactgcagaactgcatttcatgttacctgcgcgtttgacagaggattggaaatgaaaacgatcttggctgagaatgacgaggtcaaatttaagtcctattgccccaaacatagcagtcaccgcaagcccgaagaaagtctgggtaagggcgcagcccaggagaatggcgctcccgagtgctcccctcggaatccgttggagccctttgcctccctagagcaaaacagggaagaagcgcaccgggtctcagtgaggaagcaaaaactccagcagctggaagacgaattctacacctttgttaatctgctggacgtggcaagggccctccgcctcccagaggaggttgtggacttcctgtatcagtattggaagcttaagcgcaaggttaactttaataaaccgttgatcacgccaaaaaaggacgaagaggataatcttgcaaagcgcgagcaggacgtccttttccggcgtctgcaactgtttacccatctgcggcaagacctggagagggtgcggaacctgacttatatggtaacccgtagggagaaaatcaagcggtccgtatgcaaggtgcaggaacaaatctttaacctttacacgaagctccttgagcaagaacgcgttagcggagttccttcctcctgctcctctagctctctggagaacatgctcctattcaattcgccatcagtggggccagacgcacccaagattgaggatctgaaatggcactccgccttcttccgcaaacagatgggtactagcctggtgcattcgctgaagaaacctcacaaacgtgatcccctccaaaattcccctggctcagaagggaaaacattgctcaagcaacctgacttgtgtggacggcgtgaagggatggtcgttccagagtcttttttgggcttagaaaagactttcgcggaggcgcgtctgatcagcgcacagcagaagaatggggtcgtgatgcctgatcacggcaagagaagggataatcgctttcattgcgacttgattaaaggagatctgaaagataagtccttcaaacaatcacataaaccactgcgaagtacagatgtctcccagagacatctggacaacactagagcagctacatcccccggagtgggccaatctgctccgggaactcggaaggagatcgtgcctaaatgtaatggaagcctcattaaagtgaactacaatcagaccgccgtcaaagtgccaaccactcctgctagcccagtcaagaattggggcggattccggatccccaagaaaggagagcgtcagcagcaaggcgaggcacatgacggggcttgtcatcagcattcagactacccctatttaggtcttggacgcgttccagcaaaggaacgggcaaaaagtaaattgaaaagcgataacgagaatgatgggtatgtgcctgacgtagaaatgagcgattcagagtcagaggccagcgaaaagaagtgtatccatacctcctccaccatctcacggagaaccgatataatccgaagatctatcctggcttcctag

SEQ ID NO: 30652 - DNA, 402 bp, Artificial Sequence
  Description of Artificial Sequence: Synthetic coding sequence
atggcctccgaagatattgccaagctggcggagaccctggcaaagacccaggtggcaggcggtcagctcagcttcaagggcaagtctcttaagctgaacacagccgaggacgctaaagatgtgattaaagaaattgaggattttgactcactcgaggctctccggttggaaggtaataccgtcggcgttgaggctgccagagtaattgctaaagcgttagaaaaaaaaagcgaactgaaaaggtgtcattggtcagatatgttcactggccgtctgcggaccgagatccccccagctctgatatctttgggagaggggctcattactgcaggagcacaactggtggagctcgacctttctgataatgctttcggtcctgacggagtgcagggctttgagtag

SEQ ID NO: 30653 - DNA, 390 bp, Artificial Sequence
  Description of Artificial Sequence: Synthetic coding sequence
atgagtcccggatcaggcgttaaatcagaatacatgaaacggtatcaggagccaagatgggaggagtacggcccatgctaccgggagctcctgcattacagactagggcgacgtctgcttgagcaggcacatgccccatggttgtgggacgattggggcccagctggctcttccgaagactcagcatctagtgagtcaagcggtgccggaggacccgcacccagatgtgcgccacccagccctcctcctcctgttgaacccgctacccaagaggaggccgaaaggcgggcaaggggcgcacccgaggaacaggatgccgaagccggtgatgctgaagctgaggacgcagaggacgctgcccttcccggaaatgcctggctcagaacctag

SEQ ID NO: 30654 - DNA, 390 bp, Artificial Sequence
  Description of Artificial Sequence: Synthetic coding sequence
atggcagaattaattcagaaaaaactccagggggaggtggagaagtaccagcagttgcagaaggatctgagcaagagtatgtccggcagacagaagctggaggcccagctcacagaaaacaatattgtgaaagaggagttggccctcctggatggctcgaacgttgtgtttaagctgctgggtccagtcctcgtgaaacaggaactgggcgaagctcgcgctacagtgggaaaaagattggattacatcaccgcagagataaaacgatacgaaagtcaactcagggacctcgagagacagagcgaacagcagcgcgaaacattggcacaactgcagcaagaattccagcgggcacaggcagcaaaggccggagcacctggcaaggcctag

SEQ ID NO: 30655 - DNA, 402 bp, Artificial Sequence
  Description of Artificial Sequence: Synthetic coding sequence
atggctgagaaacttattacacaaaccttcagtcaccataatcagctcgcccaaaagacccgccgagaaaagcgcgctcgacaggaagccgagagaagggagaaggccgaaagagccgctcgcctcgcaaaggaagcaaaaagcgaaactagtggacctcaaattaaagagctgactgatgaagaggcagagcggctacagctggagatcgaccagaaaaaggacgcagagaaccatgaggctcagctgaagaatgggtcactggactcaccgggaaagcaagatactgaggaagatgaggaggaggacgaaaaggataaaggtaaacttaagccaaatttaggcaacggagccgacctccccaattatcggtggacacagaccctgtccgagctggactag

SEQ ID NO: 30656 - DNA, 2373 bp, Artificial Sequence
  Description of Artificial Sequence: Synthetic coding sequence
atggggacccgtaaaaaggtacacgcatttgtgcgcgtaaaacccacagacgacttcgctcatgaaatgattcggtacggtgatgacaaaaggagtattgacattcacctcaaaaaggatatacggcgtggggtcgtaaacaatcagcagacagattggtctttcaagctggacggagtcctgcacgatgctagtcaggatctcgtgtacgagaccgtagccaaagacgtggtgtcccaggccctggatggctacaacggcactataatgtgctacgggcagacgggagccggtaaaacatacacaatgatgggagcaaccgagaactataaacatagaggtatactaccacgtgccctgcagcaggtttttaggatgatagaagagagacccacccacgcaatcaccgtgagggtaagttatctggaaatatataacgagtccctattcgatctactttctactctcccgtatgtaggcccttctgtgactcccatgacaatcgttgagaacccccagggagtttttatcaaagggcttagcgtccacctgacctctcaggaagaggacgccttctccctactctttgagggtgagacgaaccgcatcatcgcatctcatactatgaacaaaaactcttcgcgctcacattgcattttcaccatctatctcgaagctcacagccgcacgcttagcgaggagaaatatatcacctctaaaattaatctggtggacctggcgggatccgagagattgggcaagtcggggtctgaaggccaggtactaaaagaggccacatacatcaataaaagcctctccttcctggaacaggcaataatcgcccttggtgaccagaagagggaccacattccattcaggcagtgcaagttaactcatgctctgaaggactctctgggcggaaattgcaacatggttttggtgactaatatttacggagaagcagcccaacttgaagaaaccttatcttcattgcgatttgcgagcaggatgaagctagtgacaaccgaacccgctatcaacgaaaagtacgacgcggaacgcatggtgaaaaatctcgaaaaggagctcgccttgctaaaacaggagttagcaattcatgattccctgacaaaccggacattcgttacttatgatcctatggacgaaatccaaatcgctgaaattaatagccaagtgagacgataccttgaggggaccctcgacgagattgatatcatttcactccgacagataaaggaggtttttaaccagtttcgagttgtcctgagtcagcaggaacaagaggttgaaagtacgctccggaggaaatacacgctgattgaccgaaacgactttgcggcaatctctgcaatccaaaaagccggtctcgtggacgtggatggccatttagtgggcgagcccgaggggcaaaacttcggcttgggagtagccccattctcaaccaaacctgggaaaaaggctaaatctaaaaagactttcaaggagccgttgagctccttggctcgtaaagagggggcttcatcccctgtcaacggaaaagatctcgactatgtgtcaaccagcaagactcagctcgtcccttccagcaaggatggcgatgtaaaagatatgctatcgcgcgacagggagacttccagcattgagcctcttccgtccgacagccccaaagaggaactgcggccaatcagacctgatacaccgccatccaaacctgtcgctttcgaggagtttaaaaatgagcagggctccgagatcaatcgaatttttaaggagaacaagtcaatcctcaatgagcggagaaaacgggctagcgagacgacacagcacatcaacgccattaaaagggaaattgatgtaacaaaggaggccctgaattttcagaagagcttacgcgaaaagcaaggaaagtatgaaaataaaggactcatgatcattgatgaagaagagttcctactcatcctgaaactcaaggaccttaagaagcaatatagatccgaataccaggatttgcgggacctgcgagcagaaatccagtactgccagcaccttgtcgatcaatgtcggcatcgactgctcatggaattcgacatttggtataacgagagctttgtcattcctgaagacatgcagatggcccttaagccaggaggaagtatcagacctggcatggtgcctgtgaatagaatcgtgtcgctaggtgaagacgatcaagataaattcagccagctccaacagcgggtgctgcctgagggaccagattccatatctttctataacgcaaaagtgaaaattgagcagaaacataactatctgaaaacaatgatgggcctgcagcaggcccaccggaaatag

SEQ ID NO: 30657 - DNA, 1356 bp, Artificial Sequence
  Description of Artificial Sequence: Synthetic coding sequence
atgtatggcgcacccggtgctccagctcagtctgcgagtgtgaccgtggtgaggtctcttcgaagaccacccccacaggccactggcgtttccttcatgaacaatcaaaaacagcagaaacccaccctatccggacagcgatttaagacccgtaagcgtgacgagaaagagcggttcgatcctacccagtttcaagactgtataattcagggtcttactgagaccgggacggacctggaggccgttgccaagtttcttgatgcaagcggagccaagctggactacagaagatatgccgagaccctgttcgatattctcgtggccggtgggatgctggccccagggggtacgctggccgatgacatgatgagaactgacgtgtgcgttttcgccgctcaggaggatctggagacaatgcaggcatttgcacaggtctttaataaactgatcagaaggtataaatatttggaaaaagggtttgaggacgaagtcaagaagttactcctgtttctcaaaggcttctccgagagcgagcggaacaaattagcaatgttgactggagtactgcttgccaatggaacgttaaatgcaagtattctcaatagcttatacaatgagaatttggtcaaagagggggtctccgcagccttcgcagtgaagctttttaagtcctggattaacgaaaaggacatcaacgcagtggcggcaagtctccgaaaggttagcatggacaacaggcttatggagctgtttcccgctaataagcagagcgtcgaacactttactaagtacttcactgaggctggtctgaaggagctaagcgaatacgtccgcaatcagcagactatcggggctcgtaaggaactgcagaaggagctgcaggaacaaatgagtcgcggagacccattcaaggatatcattctgtacgtgaaggaggagatgaaaaagaataatatccccgagcctgtggttatcggcatcgtctggtcatctgtcatgagcacggtcgaatggaacaagaaagaggagctggtcgccgagcaggctattaagcaccttaagcagtattcacccctcctggccgcattcaccacccagggccagagcgaattgacccttctgttgaaaatacaggagtattgttacgacaatatccattttatgaaagcttttcagaagattgtggtcctcttctacaaagcggaagtgctatccgaggagccaatcttaaaatggtacaaagatgcccacgtggccaaaggcaagtctgtgtttctggagcagatgaagaagttcgtggagtggcttaagaatgctgaagaggaaagcgaaagtgaagccgaagagggcgactag

SEQ ID NO: 30658 - DNA, 948 bp, Artificial Sequence
  Description of Artificial Sequence: Synthetic coding sequence
atggccggaggagcaagggaagtactaactctgcagctgggtcactttgctggttttgtcggtgctcactggtggaaccagcaggacgcggcactgggccgagcaacagattctaaggaacctcctggtgaattgtgtccagacgtgctgtataggacagggagaactctccatggccaggaaacttatacacctagactgattctgatggatctgaagggctcactttcatctcttaaggaagagggcggactatacagagacaagcagctggacgctgcaatcgcttggcaaggtaaattgactactcataaggaagaactctaccccaagaatccctatctacaggacttcttgtcagccgaaggggttttatcttccgacggggtttggcgcgtcaaatcgatccccaacggcaagggttcttcacccctccctaccgcaactactccaaagcctcttattccaacagaggcctccattcgagtgtggagcgacttccttcgggtccatctgcaccccaggagtatatgcatgattcagaaatacaatcacgatggcgaggccggtcgcctggaggcttttgggcagggggagagcgtgctaaaagaacctaagtaccaggaagaactcgaagacagactacacttctacgtcgaagaatgcgactatctccaggtggttgcttggcagtgcgcgcttcaaggaggatctagctcacacccagctaattatttgtctagtctgaccccagcccagggatttcagatcctgtgtgatctgcacgacggcttttcaggggtgggcgctaaagctgcagagctgctacaggacgaatattctggccgaggtatcataacctggggacttcttcccggaccctaccatcgcggtgtgtcgggaacttggcgctccaagcattctaatccgataggcagagtcgcatag

SEQ ID NO: 30659 - DNA, 285 bp, Artificial Sequence
  Description of Artificial Sequence: Synthetic coding sequence
tgtacttctagttgtacaccgtcctgctgtcaacagtccagctgtcagccggcttgttgtacatccagcccttgccagcaagcttgctgtgttcctgtctgttgtaaaacggtatgctgtaagccgtcctcctgtcaaccagcttgttgtatcagttccccatgtcagcagtcttgttgcgttccagtgtgctgtaagcccatttgttgtgtcccaccagcctgctgtaccacctcatgctgccggccttctagtagcgtgagtctgctctgtagaccagtgtag

SEQ ID NO: 30660 - DNA, 1221 bp, Artificial Sequence
  Description of Artificial Sequence: Synthetic coding sequence
atggccgctaacctcagccggaatggccctgctttgcaggaggcctatgtgcgcgtcgtgacggagaagtctccaacagactgggccctttttacatacgaaggcaacagcaacgatatacgcgtggccggaacgggtgagggagggctggaggaaatggtcgaggagttaaatagcgggaaggtaatgtacgccttttgtagagtgaaggacccaaacagtggcctgcccaaattcgtcctgataaattggggagcacacgtgactatcaacgcacgggctgaagaggacgtggaaccggagtgcattatggaaaaggtcgcaaaggccagcggtgctaactactcttttcataaggagagcgggagattccaggatgtgggaccacaggcccctgtgggatccgtctaccaaaaaacgaatgccgtcagcgaaattaaacgcgtaggcaaggacagcttctgggctaaggctgaaaaagaggaggagaacagacgtctcgaggagaagcgaagggccgaagaagctcagagacagttagaacaggagcggcgagaaagggaactgcgagaggctgcaaggagagagcaaaggtaccaggaacaaggcggagaggctagtcctcaaagccgtacatgggagcaacagcaggaggtggtgagccgcaaccggaatgagcaggagagcgctgtccatccaagagagatcttcaaacagaaggaacgtgctatgtctactacgtccatttcatcccctcagcccggaaagctcaggagtccttttctgcagaaacagctcacccagccggagactcactttggccgtgaacccgctgcagccatcagccggcctagggccgatcttcccgctgaggaaccggcaccttcaaccccaccttgtcttgtccaagccgaagaggaggccgtgtatgaggaaccacctgaacaggagactttctacgaacagccacccctggtgcagcagcagggtgccggatccgagcacattgaccaccatatccaggggcaaggactcagtggtcaagggttgtgtgcacgggctttatacgattaccaggccgcagacgacaccgaaatctcattcgatcccgaaaacctcattacagggatcgaggtgatcgatgaaggttggtggcgcggatatggaccagatggtcactttggcatgttcccagctaactacgtcgagcttatcgaatag

SEQ ID NO: 30661 - DNA, 981 bp, Artificial Sequence
  Description of Artificial Sequence: Synthetic coding sequence
atgccccatcttcctctggcaagctttcgtccacctttctgggggctgagacattcacgaggattgcctcgctttcattccgttagtacacagtctgaaccccatggctcacccattagccgcaggaatagggaagccaagcagaagcggctcagagaaaaacaggcaactctggaagccgagatagcgggagaaagcaaatcacccgctgagtctatcaaggcgtggagaccaaaggaactggtcctttatgaaatccccaccaagccaggcgaaaagaaggatgtatccggccctcttcctcctgcctatagtcctcgatatgtcgaggccgcttggtatccttggtgggtcagagagggattttttaaacctgagtaccaggccaggctcccccaggcgacgggtgagactttttcaatgtgcatacctcctccgaacgtaacaggctccctacacatcgggcacgctttgaccgtggctattcaggatgctttggtccggtggcatagaatgcgtggggaccaagtgttgtgggtgcccggaagtgatcatgccggtatagcaacccaggccgttgtggaaaaacagctttggaaggagagaggagtgaggcggcacgaactgtctcgcgaagcatttctccgcgaggtgtggcagtggaaggaagctaagggaggagagatatgcgagcagcttcgggcactgggtgcatccctggattgggatagggaatgcttcactatggatgtcggctctagcgtcgccgttacggaagccttcgtacggttgtataaggcagggctattgtaccgtaatcaccagcttgtgaactggtcctgtgctctccgctcagcaatatctgatatcgaagtcgagaatcggccactgcccggtcacacacagctgcggctgccaggctgtccaacccccgtgtccttcgggttgctcttctcggtggcttttccggtggatgggtag

SEQ ID NO: 30662 - DNA, 684 bp, Artificial Sequence
  Description of Artificial Sequence: Synthetic coding sequence
atgctgtgctggggctactggagcctcgggcagccgggaatttccactaacctgcaaggcatcgtcgctgagccccaagtttgtggttttatctccgatcgatcagtaaaggaagtcgcctgtggcggtaaccactcagtgtttctgctggaagacggcgaagtttacacttgcggcctgaacaccaagggacagttagggcatgagagagagggaaacaagcctgagcaaatcggggcattggctgaccagcacattatccatgtggcatgtggagaaagtcacagcctggccctcagcgatagaggacagctcttcagctggggagcgggatctgatgggcagttgggactgatgactacagaggacagcgtcgcagtgcctcgtctcattcaaaagttgaaccagcagactatcctgcaagtgtcctgcggtaactggcactgcctggcactcgcggcagacggccagtttttcacctgggggaaaaattcccacggacagctgggactggggaaggaatttccttcccaagcctcccctcaaagagtaagatctttagagggcatccctcttgcgcaggtggccgctggcggagctcattcctttgccttgtccttaagcggcgcagtctttgggtggggaatgaataatgcaggccagctcggtctctcggacgaatag

SEQ ID NO: 30663 - DNA, 624 bp, Artificial Sequence
  Description of Artificial Sequence: Synthetic coding sequence
atgagctctcctctggcttccctctcgaaaaccagaaaagtcccccttccgagcgagcccatgaatccaggcaggcgaggcatcagaatttacggggacgtgcccgcaagtcacgactcagagctcatggcatttatgacacgaaaattatgggatctggagcagcaagtgaaagcccagacagacgaaatcctttccaaggaccaaaagatcgcagccctagaagatctcgtgcaaactctgcggcctcatcccgcagaggccaccctccagagacaggaggaattagagaccatgtgcgtgcaactacaacgtcaagtacgggagatggagaggttcctctcggattatggactccagtgggtgggagagccaatggaccaagaagatagcgagtctaagactgttagtgagcacggagaacgagattggatgactgctaaaaagttctggaagcccggagattcccttgccccaccagaggtggactttgatcggctgttggcgtctttgcaagacttgagcgagctggtcgtggagggcgatacccaggtgactcctgtcccgggaggagcgaggctgaggactttggaaccgatacccctgaagttataccgtaactag

SEQ ID NO: 30664 - DNA, 717 bp, Artificial Sequence
  Description of Artificial Sequence: Synthetic coding sequence
atgacagaggatagccagcgaaacttcagaagcgtctactacgagaaggtgggctttcgaggggtggaggaaaagaagtcactggagattcttttaaaggacgatagattgggaatactgccacctcatcacgagtcgcatgcgaaggtaatgatgtacagaaaggaacagtaccttgatgtcctgcacgcactgaaggtggtgcgattcgtctcagatgctactccgcaggctgaagtctaccttcgtatgtatcagcttgaatcaggtaagcttccacgcagtccgtctttcccgctagaaccggatgacgaggtctttctcgctattgccaaggccatggaagaaatggtggaagattctgtcgactgctattggataaccaggaggttcgtgaatcagctcaatacaaaatacagggattccctgccccagttgccgaaagctttcgagcagtatctgaaccttgaagatggtcgattgcttacccacctgagaatgtgcagcgccgcacccaaactcccttacgacctatggttcaagagatgttttgcaggctgcctgccagaatcatcactgcagcgagtatgggataaagtggtgagcggatcctgcaaaatattggtatttgtcgcagtcgaaatccttttaacattcaaaatcaaggtgatggctctcaactccgctgaaaagattactaagtttctggaaaattag

SEQ ID NO: 30665 - DNA, 369 bp, Artificial Sequence
  Description of Artificial Sequence: Synthetic coding sequence
gttcgggagcttgaggccgagttggacgctgaacagaagaaacacgcggaagcactaaagggggttcggaaacacgagcgcagggtgaaagagctcgcctatcaggccgaggaggatagaaaaaatttagccaggatgcaggacctggttgacaagctgcaatctaaggtgaagtcgtacaagaggcagttcgaggaggctgagcaacaggccaacacaaacctggcaaagtacaggaaagcccagcacgaactggacgacgcagaagaaagggcagacatggccgagacccaggccaataagctgcgagcacgaacaagggatgccctagggccaaagctgtccctttcaccacagcataaagaatag

SEQ ID NO: 30666 - DNA, 483 bp, Artificial Sequence
  Description of Artificial Sequence: Synthetic coding sequence
taggaatcgttagtcggtctccaggaaggtaaaagcactgagcagggtaaccatgatcagcttaaggagctgtactcagccggtaaccttacggtgctggccactgatccactactccaccaagatccagtgcagctggacttccatttcaggttgacgtctcagacctctgcgcattggcacggccttttatgtgaccgccgtctatttctcgatattccgtatcaggccctcgatcagggtaacagggagtccttgactgccaccttggagtacgtcgaggagaagaccaatgtagattctgtctttgtgaattttcaaaacgaccgcaacgatagaggggctctgcttcgagccttcagttatatgggtttcgaggtggtgcggcctgatcaccccgctctacctcctctcgacaatgtcatttttatggtctaccccttagaacgagacgtgggacacttacccagcgaaccaccctag

SEQ ID NO: 30667 - DNA, 102 bp, Artificial Sequence
  Description of Artificial Sequence: Synthetic coding sequence
atgagtgtgacttatgacgacagcgtgggcgtagaggtgtccagcgattcattctgggaggtgggcaattataagcgtactgtaaagcgcatagatgactag

SEQ ID NO: 30668 - DNA, 402 bp, Artificial Sequence
  Description of Artificial Sequence: Synthetic coding sequence
atgtggtccttaactgcttccgagggcgaatcaaccaccgcacactttttcttgggcgctggcgatgaagggctgggcaccagggggatcggtatgcgccctgaggaatcggatagtgaactgctcgaagatgaggaggacgaggtgccccctgaaccacagatcattgtcggaatatgcgcaatgaccaagaagtccaaatccaagccaatgactcaaattctggagcggctgtgtaggttcgattatctgactgtggtaattctcggtgaagatgtcatactgaatgagcctgtcgaaaactggccttcttgtcactgcttaatctcattccacagtaagggctttcccttagataaggccgtggcttattccaagctgagaaatcctttcctaatctag

SEQ ID NO: 30669 - DNA, 939 bp, Artificial Sequence
  Description of Artificial Sequence: Synthetic coding sequence
atggcgcagccttatccgcctgcacagtatccccctccccctcaaaacggcattcccgctgagtacgctccccctccaccacatccaacgcaagactacagtgggcagacgccagtgccgactgagcacggaatgaccctgtacacacccgcacagacccacccagaacaaccaggctctgaggcgagcacccagccaatagccggtacacaaaccgtgccccagaccgacgaagccgctcagaccgactcgcagcctctgcacccttccgatcccacggaaaagcagcagcctaagaggctgcatgtcagtaacatcccgttcagatttagagaccccgatctgaggcaaatgtttggccagttcggcaaaattctggatgtcgaaataatcttcaatgaacgcggatcgaagggcttcgggtttgttaccttcgaaaccagttccgacgccgatcgggcacgcgagaagttaaatggcactatcgtggagggccgaaagatagaagttaacaatgcaacagctcgagtaatgacaaacaaaaaaactggcaacccctacaccaacggctggaagctcaatccagttgtcggcgctgtttacggcccagaattctacgcagtgacaggcttcccctatccaacgactgggaccgcagtggcttaccgcggagcccatctcagaggccgtgggcgagccgtgtacaacacgtttagggctgcacctccaccccctcccattccgacttatggggctgtggtctaccaggatggcttctacggggcagagatatacggtggatacgcagcctacaggtacgctcagcccgctgcagctgcagccgcatattcggattcatacggaagggtgtatgccgcagccgatccataccatcacacaattggaccggcagccacatactctattggcactatgtag

SEQ ID NO: 30670 - DNA, 1308 bp, Artificial Sequence
  Description of Artificial Sequence: Synthetic coding sequence
tgaagcattcttaacagcaatgaacacctactgaaagaaaaagagttgctgattgacaagcagagaaagcatatcagtcaactggagcagaaggtgcgggaatctgaactgcaagtccatagcgcactgcttgggcgtccagcccctttcggcgatgtgtgtctgcttcgcctgcaggagctgcagcgcgaaaatacttttctccgagctcagttcgcgcaaaaaaccgaagccctgagcagagagaaaatcgacttggaaaaaaaacttagcgcatccgaagtggaagtgcaactgattagagagtcgctcaaggtagcgttacagaagcacagcgaagaagtgaagaaacaggaggaaagggttaaaggtagggacaagcatatcaacaatctcaagaaaaagtgtcagaaggagagcgaacagaacagagagaagcagcagcggatcgagacgctagagcggtacctcgccgatctcccgactctcgaagatcatcagaaacaatcacagcagctgaaagacagtgaactgaagtctacggagctccaggagaaagtgacggaactggaatccttactcgaggaaacgcaggctatctgtcgcgaaaaagaaattcagctcgagagcctccgtcagcgagaggcagagttctccagcgccggacactcactccaagacaagcagtccgtcgaagagacgagcggcgaaggcccagaggtcgaaatggagtcatggcagaagcgttatgactcacttcagaagattgtggagaaacaacagcaaaagatggaccaactgcgctcacaggtacaatctctggagcaggaggtggctcaagaggaggggacttctcaggctctccgcgaggaagctcaacgcagggacagtgcactccaacaactccgcacagctgtaaaggaattatccgtgcagaatcaggatctgatagagaagaatcttactctgcaagagcacctccgccaggcccagcctggatccccgcctagccccgacacagctcagcttgctctcgaactccatcaggagttagccagttgtctgcaggatctgcaggcagtatgtagtatagtgacacagcgtgcacagggtcatgacccgaatctctcactacttcttggcatccactcccagcaccccgaaactcagctcgatctgcagaagccagacgtgatcaagcggaagctggaggaggtccaacagctgcgcagagatatagaggatttacgcactacaatgagcgacagatatgctcaagacatgggcgaaaactgtgtgacccagtag

SEQ ID NO: 30671 - DNA, 474 bp, Artificial Sequence
  Description of Artificial Sequence: Synthetic coding sequence
atggagctcaggtgtggtgggctgctgtttagttcgcggttcgactccgggaacttggcacatgttgagaaggttgagtcactcagcagcgacggtgagggcgtagggggaggggctagcgcgcttacatcaggaattgcgagcagccccgactacgaattcaatgtgtggactaggcctgattgcgcagagactgagttcgagaacggcaacaggtcgtggttctactttagcgtgagaggaggtatgcctgggaaattgatcaagatcaatattatgaatatgaataaacaaagcaaattgtactcacaggggatggcccctttcgtccggacattgcccacccggcctcgttgggagcgaattcgagacagacctacgttcgaaatgactgagacacagtttgtgctgtctttcgttcacaggttcgtcgagggaagaggtgccaccacatttttcgcattctgctattag

SEQ ID NO: 30672 - DNA, 1620 bp, Artificial Sequence
  Description of Artificial Sequence: Synthetic coding sequence
atggcgacctccgcaccccttcgctcgctggaggaggaggtcacttgttcaatatgtcttgactacttgagggatccagtgacgatcgactgtggccacgttttctgtcgaagttgcacaacggacgtgcgcccaatctccggaagcagacccgtatgcccactgtgcaagaaaccatttaaaaaagaaaatatccgcccagtgtggcagttagcctctttagtcgagaatatcgaaagattaaaggtagataaggggcgtcagcccggtgaggtgacgcgggagcagcaagacgcaaaactttgtgagcggcaccgcgagaagctgcactactactgcgaggacgacggtaagcttttatgtgtcatgtgcagggagagtagggaacatagaccccataccgccgttcttatggaaaaagccgctcagccacaccgagagaaaatcctcaaccatctgtctactctgcggagggatcgggataaaattcagggcttccaggccaagggagaagccgatatcctggcggcactgaagaaactgcaagaccagcgtcagtatattgtcgcagagttcgagcagggacaccagtttcttcgggagcgcgaggaacatctcctggagcaactcgccaagctggagcaagagcttacagagggtcgtgaaaagtttaaaagccgtggggtgggcgagctggcgcgtctcgcattagtgatcagcgaactggaaggtaaagcccagcagccggctgccgaactgatgcaggatactagggattttttgaacagatatccgagaaagaagttctgggtgggaaagcccattgcaagagtggttaagaagaagacaggggagttttctgataagttgttaagcctgcagcggggtctgagagaattccaaggcaagcttctgagagaccttgagtacaagaccgtgagcgtgactctggatccacaaagcgcttctgggtacctccaactatctgaggattggaaatgtgtcacttataccagcctgtataagtcagcatatctgcatccacaacagttcgattgtgagccgggtgtactcgggtctaaagggttcacctggggaaaggtttattgggaggtggaggttgaacgcgaaggttggtcagaggacgaggaggagggagatgaggaagaggaaggggaagaggaggaggaggaagaagaggccggttacggtgatggctacgatgattgggagaccgacgaggacgaggagtcactgggtgacgaggaggaggaggaagaggaagaggaagaggaggtcctagaaagctgcatggtaggtgtcgccagagactccgtgaagagaaagggagacctctctttgaggccggaggatggagtgtgggctcttcgtctgtcatcgtctggtatttgggctaacacctccccggaagctgagctttttccagcactgaggcccagacgggtggggatagccctggactatgaggggggaactgtcactttcacgaacgcagagtctcaggaattgatctacacttttaccgccaccttcacccggcgtttggtgcctttcctgtggcttaaatggccgggaacccggctacttttaagaccttag

SEQ ID NO: 30673 - DNA, 6140 bp, Artificial Sequence
  Description of Artificial Sequence: Synthetic coding sequence
atggatgaagtcgagcaggatcagcatgaggccaggctgaaggaactctttgactcctttgacaccacaggcactggctccttgggccaggaggaactaaccgatctgtgtcacatgctgtccctggaggaggttgccccagtactgcaacaaacccttctgcaggataaccttctgggcagggtgcacttcgaccagttcaaggaagccctgatcctaatcctgtcccggaccctgagtaacgaggagcactttcaagaaccagactgcagcctcgaggctcaacccaagtatgttagagggggaaaacggtatggacgacgttctctgccagagttccaggagtctgtagaggaatttccggaagtgacagtgattgagccgctggatgaagaggctagacctagccatatcccagccggtgactgcagcgagcattggaaaacccagcgtagcgaggagtacgaagccgaaggtcagctaagattttggaaccctgatgatctgaatgcctcccaatcaggctccagtccccctcaggactggatagaggagaagctgcaggaagtgtgcgaggatctgggcattaccagggatggccacttgaatagaaagaaactcgtcagcatctgcgagcaatatggcctgcagaatgttgatggggaaatgctggaagaggttttccacaatctggacccggatggcacaatgtctgtcgaagatttcttttacggcctgttcaaaaatggtaagagcctcactccctcagcttcaacaccatacaggcaactgaaacggcacctgtcaatgcagtctttcgacgaatcggggaggagaacaacaactagttccgccatgacatccaccatcggttttcgcgtgttttcctgtctggatgacggcatggggcacgcatcggttgaaagaatcctggatacctggcaggaggaggggattgagaattctcaggaaatcctgaaggcactcgatttcagcttagacggaaatatcaaccttacagagcttactttggcacttgaaaacgaattgctggttaccaaaaacagtatccatcaggccgcactggcatccttcaaggccgaaattaggcacctgttagaaagggtggaccaagtagtgagggagaaggagaagctgcgctccgatctggacaaggcagaaaagctcaaaagcctcatggcctcagaagtggacgaccaccatgctgccattgagcgaaggaatgagtacaatctgcgaaagctggatgaagagtacaaggaaaggatcgctgccctgaagaacgaattacggaaggagagagagcagattcttcagcaggccggtaaacagaggttagagctggagcaagaaatcgaaaaggcaaagaccgaagagaactatatccgcgacaggcttgcgctttccttaaaagaaaactcgagactcgaaaatgaactgctggagaacgcagaaaagttggccgagtatgagaacctcactaataaacttcagcggaatttagaaaacgtccttgcggagaaattcggcgacctggatcccagctccgcagagttttttctgcaagaggaacggttgactcaaatgcgcaatgagtatgaacgccaatgtagagtgctgcaggaccaagtggatgaactccagtcagaacttgaagagtaccgtgcacagggcagagtgctccggctgcctctgaaaaactctccatccgaagaagtcgaagccaatagcggaggcatcgaacccgagcatgggctcggttcagaagagtgtaaccctctcaatatgtccattgaggccgagttggtgatcgaacagatgaaggaacaacatcacagggatatttgctgcctcaggttggaactggaagataaggtcaggcactacgaaaagcagctggacgaaacagtggtttcgtgtaagaaagctcaagaaaatatgaaacagcgtcacgagaacgagacacatacactggaaaagcaaatctcagatttaaaaaacgaaatcgccgagctacagggccaggctgcagtcttgaaagaagcccaccatgaggccacctgcaggcatgaagaggagaaaaagcagctacaagtcaaattagaggaggaaaaaactcacctccaggaaaaactgcggctccagcatgagatggaacttaaagcacgcttaactcaggcacaggcatcattcgagagggagcgcgaaggcctgcagagctcggcctggactgaagaaaaagtgagggggctcacccaggagcttgaacaatttcatcaagagcagctgacatctctggtggaaaagcatactttggagaaagaggagctgcgaaaggagctccttgaaaaacatcaacgcgaactccaggagggacgagaaaaaatggagaccgagtgcaacagacgcactagccagattgaagcacaatttcaaagtgactgccagaaggtgactgagagatgcgagtccgctttgcagtcactggaaggccgttaccggcaggagctgaaagatttgcaagagcagcagagggaagaaaagtcccagtgggagttcgaaaaagacgagctgacgcaggaatgtgccgaggcacaggagctgttaaaagagaccctgaagcgggagaaaacgacatccctggtcctgactcaggagagggaaatgttagagaagacatacaaggagcacctaaactctatggtggtggagcggcaacagttgctccaagacttggaagatctgagaaacgttagcgagacccagcaaagcctcctttccgaccagatcctggaactcaaaagctcccacaagagggagttgagagagagagaagaggtgctgtgtcaggctggagcaagtgagcagcttgccagccaaaggctggaacgcctggaaatggaacatgaccaggagcgacaggaaatgatgtcaaaactactggccatggagaatatccataaggcaacctgcgagacggcagacagggaacgcgctgagatgtctacagagatatcacgccttcagtctaaaatcaaagagatgcagcaggcgacttcgcctctcagcatgctgcaaagcgggtgtcaggttatcggagaggaggaggttgaaggggatggcgcactgtctctgcttcagcagggtgagcagcttcttgaggagaacggggatgtcctgttatcacttcagcgcgctcatgaacaggcggttaaggaaaatgtgaaaatggctaccgagattagcaggttgcaacagcgactgcaaaaactggaaccaggactcgtcatgtcttcttgcctcgatgagcccgctactgaatttttcggaaataccgcagagcagaccgaacaattcctgcagcagaatcgcacaaaacaggtggaaggcgtcaccagacggcatgtcctttctgatcttgaggacgatgaggtgagggacctcgggtccactgggacaagttccgtacaaaggcaagaggtgaaaatcgaggagtctgaggcctccgtagaaggcttcagcgaacttgaaaactccgaagaaacacgtacggaaagttgggagctgaagaatcagatctcgcagctccaggagcagttaatgatgctgtgtgccgactgtgatcgcgctagtgagaagaaacaggatctgttgttcgacgtctccgtcctcaagaaaaaactgaaaatgctggagcggattcccgaagcgagcccaaaatacaaactgctatacgaagacgtgagtagggagaacgattgtctgcaggaggagttgcggatgatggaaacgcgctatgacgaggctctcgagaataacaaggaattgacagccgaggtgttcaggttacaggatgaattaaaaaaaatggaggaggtgaccgaaacttttctgagccttgaaaagtcatacgacgaggtcaaaattgagaatgagggcctcaacgttctggtgctcagactccagggcaaaatcgagaagctgcaggaaagtgtggtacagcgatgcgattgctgcttgtgggaggcctctctggagaatcttgaaatcgagcccgacgggaatatattacaactgaaccagaccctggaggagtgtgtgcccagggtgagaagtgtgcatcatgtgattgaggaatgcaaacaggagaatcagtacctcgaggggaacacccagctgctcgagaaagtgaaggcccacgaaatcgcctggctccacggaacgatccagacacaccaggagagacccagagttcagaatcaggttatacttgaagaaaataccacactcctcggatttcaggataagcactttcaacatcaggcgactattgctgaattggagctcgaaaaaactaagctccaagagctcacccggaagctgaaggagagggtcaccatcctcgtgaagcagaaagacgttctgtcccacggcgaaaaggaagaggagcttaaggcaatgatgcatgatctgcagatcacatgttccgagatgcagcaaaaagtggaattgctccgatacgaatcggaaaagcttcaacaggagaacagcatactgcggaacgaaattacaactctcaatgaggaagatagcatctcaaatttaaagctcggcactctaaacggctctcaggaggaaatgtggcagaagacagaaactgtgaaacaggaaaatgctgctgttcaaaagatggtcgagaacctgaaaaaacagatcagtgaactgaaaataaagaaccagcagttggatttagagaacactgagctgagtcagaaaaacagtcagaatcaagaaaagttgcaggagctgaaccagaggctgacggagatgctctgccaaaaagagaaagaaccaggtaactccgccctagaggaaagagagcaggaaaagtttaatctgaaagaagaactggaaagatgcaaggtgcagagttctacactcgtttcctccctggaagcggaactctcggaggtaaaaattcaaactcatatcgtgcagcaagagaatcaccttcttaaagatgaactggagaaaatgaagcaacttcataggtgcccagatttaagtgattttcagcagaagattagctctgtgctcagctataacgagaaactgctgaaagagaaggaagccttgtcagaggagctgaactcttgcgttgataagctggccaagtcgtcactgctggaacaccgaattgctacaatgaagcaggagcagaaaagttgggagcatcagagcgcttcgttgaaaagtcagctggtagcaagccaagagaaagtccagaatcttgaggacacggtgcaaaatgtcaacctgcagatgagtaggatgaagagcgatctgagagtcactcaacaggaaaaagaagcactgaaacaggaagtgatgtccctgcacaagcagctgcagaatgcaggtggcaagagctgggctccagaaatcgcgacccacccgtccggactgcataaccagcagaagagactgtcctgggataagttagatcacctcatgaatgaggaacagcagctactgtggcaggaaaacgaacgtcttcagacaatggttcagaacaccaaagcagagctaacccatagtagagaaaaggtaagacagctggagagtaatctccttcctaagcatcagaagcacctgaacccgtcggggaccatgaatccaactgagcaggagaaactttccctgaaaagagaatgtgaccaattccagaaggaacagtctccagctaatagaaaagttagccaaatgaattccctcgaacaagaacttgaaaccattcatctggagaatgagggcctaaagaaaaaacaggtgaaactggacgaacagctaatggaaatgcagcatttaaggtctacggcaactcccagtcccagtccccatgcctgggatttacaactcttgcagcaacaggcatgcccaatggttccaagagagcaatttctgcagttgcaaaggcagctgctccaagccgaacggataaatcagcatttgcaagaggaactggaaaaccggaccagcgaaacaaacacaccgcaggccctgcttcccgagcagcgggctgtgcatgcagactcctatcgccgaatagggcacctgta

SEQ ID NO: 30674 - DNA, 1203 bp, Artificial Sequence
  Description of Artificial Sequence: Synthetic coding sequence
atggcaggcgagaatcatcagtggcaagggtccatcctttataatatgctgatgagcgctaagcaaaccagagctgctccagaggctccagaaacaagactggtcgaccaatgctgggggtgctcttgtggggacgagccgggtgttggtcgggaaggcttacttggtggacggaatgtggccctcctgtataggtgctgtttttgcgggaaggatcacccacgccaggggtccatcctttactctatgttaactagcgcaaaacaaacctatgccgcacctaaggcgccagaggccactttaggcccttgctgggggtgcagttgcggatcagaccctggggtgggtcgggcaggcttacctggtggccgtcccgtggcgcttctgtatcgatgttgcttctgtggcgaggatcaccccagacaaggatccattctgtacagccttcttacttcttcaaagcaaacccatgtagccccagctgcacctgaggcccgaccaggaggggcatggtgggaccgcagttactttgcccagaggcctggaggcaaggaggccctgcctgggggaagagctactgccctgctttaccgatgttgcttctgcggggaagaccacccgcagcaaggttctaccctatattgcgtaccgactagcaccaatcaggctcaggctgctcccgaggagagacctagagccccttggtgggataccagcagcggagcccttcgcccagtggctctgaaatctcctcaggtagtgtgtgaagctgctagcgcaggactcctgaaaaccctaaggtttgtcaagtacttgccctgcttccaagtcctgccactcgatcagcagctagtgctagtgaggaactgttgggctagtttgttgatgctggagcttgctcaggataggctgcagttcgaaacagtggaagtgagcgagccatcgatgttacagaagatcctgactaccagaaggagagagacgggcggaaatgagccgctcccggtccccaccttacaacatcacctggctccgcctgcggaggctagaaaggtccctagcgcctctcaggttcaagcaattaagtgcttcctgagtaagtgttggtcactgaatatctctactaaagagtatgcttaccttaagggcaccgtactcttcaacccgggtaaaggtaaagagaacgactgtaatcatcattag

SEQ ID NO: 30675 - DNA, 627 bp, Artificial Sequence
  Description of Artificial Sequence: Synthetic coding sequence
atgaagcaactggaagaccatgaggcctttgagacctcctccttaattggtcacagcgctagggtgtacgcgctctactacaaggacgggctgttgtgtaccggatctgatgacctcagtgccaagctgtgggatgtgtcaaccgggcagtgcgtgtacggcatccagacacatacatgcgccgcagtcaagttcgacgagcagaaactggtcacgggctccttcgataatacggtggcctgctgggaatggagctccggagcgaggacccagcattttcggggtcatactggcgctgtcttttctgttgactacaacgatgaattagacattctggtgagtggcagtgcagatttcacggtaaaagtgtgggccctgtccgccggtacttgcctcaacacgctgaccggccacaccgagtgggttaccaaagtagtcctccagaagtgtaaggtcaagtctctgctccactcacctggggattacatcctgttatctgccgacaagtacgaaatcaaaatatggcctattgggagggagattaactgtaaatgcctgaaaaccctgagcgtgtccgaagacaggtccatatgtttacagccaagattgcattttgatggaaagtag

SEQ ID NO: 30676 - DNA, 639 bp, Artificial Sequence
  Description of Artificial Sequence: Synthetic coding sequence
atgttcggggtgacgaagttcggggataatatcgaggatgagtggttcattgtatatgtgattaagcagattaccaaggaatttccagaactagttgccaggattgaggacaatgacggggagtttctcctgatagaagctgctgactttcttcccaagtggttagaccccgaaaacagcaccaaccgggtttttttttgccacggagaattatgcataataccagccccacgaaaatcaggagctgagtcctggctgcccaccacccctcctaccatccctcaggctctgaacatcatcacggctcatagcgaaaagatattggcctctgaatccatccgggctgccgtgaatcgacgaattagaggatatcccgagaagattcaagcctcattacatagagcccactgttttttgccggctggcattgtagcagtgctgaagcagcgccctcgcttagtcgccgcagctgtgcaagccttttacctccgcgatcctatcgatctgagagcctgcagagttttcaagaccttcttgcccgagacgaggataatgactagcgtcacgttcacaaaatgcctgtatgcccaactggtccagcagcgcttcgtccctgaccgtcgctcagggtacagatag

SEQ ID NO: 30677 - DNA, 474 bp, Artificial Sequence
  Description of Artificial Sequence: Synthetic coding sequence
atggctacgtcagcaccactgcggtctttagaggaggaggttacatgctccatatgccttgattacttaagggacccggttacgatcgactgcgggcatgtcttctgcagaagctgtactaccgatgttcggccaatcagtgggtctcggccagtgtgtcccctttgtaagaagccatttaaaaaagaaaacatccgtcctgtctggcagctggcttcccttgtagagaacattgagcggttgaaagtagataaaggcaggcagcccggtgaggtgacccgcgagcagcaggacgccaaactttgcgagaggcacagggagaagctgcactattattgcgaggacgacgggaagttactctgcgtcatgtgccgtgaaagccgagagcatcgaccacacacagcggtcctgatggagaaggccgcacagccacacagagaaaagatcctcaatcatctcagtactctccgctag

SEQ ID NO: 30678 - DNA, 4773 bp, Artificial Sequence
  Description of Artificial Sequence: Synthetic coding sequence
atgtccgcgacgagctggtttctcgtgtcttcatccggagcacgccatcgtttgccacgcgagctcattttcgtcgggagagaggaatgtgagctgatgctgcaatcacggtccgttgacaaacagcacgcagtcataaactatgaccaggaccgcgatgaacactgggtgaaggacttaggcagcttgaatggcaccttcgtgaatgacatgcgaatacctgaccagaagtacgtcacattgaaactaaacgacgtgatccggtttggatacgatagcaatatgtacgtcttggagcgagtccaacacagggtgcctgaagaggcactcaagcatgagaagtacacttctcagctccaggttagcgttaagggcctggcccctaagagatctgaggctctgcccgaacacactccctactgcgaagcttcaaaccctagacctgagaaaggcgacaggaggccaggcaccgaggctgcctcatatagaaccccactgtacggccagcccagctggtggggggaagacgatgggtcaacactccccgatgcccagagacagggagaaccctacccagccgagcggcctaaggggcctgtgcaacaggatggcgagctgcacgggtttcgcgctccggcagaaccgcagggctgtagtttccgccgagagccctcttatttcgagatccccacgaaagagaccccacagcccagccagccaccagaagtgcccgctcatgaaatgccgaccaaggatgcagaagccggagggggaggcgctgctccagtggtccaatcacacgcctccttcacaattgagtttgacgactgttctccaggcaaaatgaaaattaaggaccatatcacaaaattctccctgaggcaaaggcgtcctccaggcaaagaggccacgccaggggagatggtcagcgctgaaaccaaggtcgcagattggctggtccaaaacgatccatccctgttacatcgtgttggcccaggcgacgaccggcactctaccaaatccgacctaccagtgcatacccgtactttgaagggtcacaaacacgaagacgggacgcagtctgatagcgaagacccacttgccaaagcagcatccgcagctggggtcccccttgaagccagcggagagcaggtgcggctgcagcgtcagataaagcgcgacccccaggagctgctgcacaaccagcaggcatttgtgatcgaattctttgatgaagacacccccaggaagaaacgttctcagagcttcacccactccccttccggtgatccgaaagccgacaaaagaaggggccctactcctgcagatcgcgatcgcccaagcgtgcctgcacctgttcaggcagggggtagatcttcgggccctcagcgcgctggctctctgaaacgcgagaagacagaggagcggttggggtccccatccccggctagtaggactcctgctagaccattcggcagtgtgggccgtcgctcacgcctcgcacaggacttcatggcccagtgcctccgggagtccagtccggctgctaggccctcacccgagaaggtccctcccgtgctgccagcacccctaaccccgcatgggacctcaccagtgggccctcccaccccaccacccgcaccaaccgacccacaactaactaaagctagaaaacaggaagaggatgacagtctgtctgacgccggaacctatactattgaaaccgaagctcaggatactgaagtggaggaagctagaaaaatgattgaccaggtcttcggcgtgcttgagagtcctgagctttcacgggcaagttcggcaacctttcgtccagtgatccgtggagatcgagatgagagcgatgatggcggtgtcgcccaacggatggctcttctgcaggagtttgcttctaggcccctgggagccgctccacaagccgagcatcagggtctgcctgtgcccggatcccccggaggtcagaagtgggtgagccggtgggcttccttggccgactcatactctgatcccggtctaactgaggacggtctgggccgtaggggtggagagcctgaaggcagcttacccgttcggatgagacgacggctaccacaactgccgtcagagagagccgatagccccgctggtcctgagagctcaaggcgaagcggccctggtccgccagagctagactcagagcagccaagcagacttttcggacaggaggaattggatccggatagcctgtcagatgcctctggctcagatgggggaagaggacctgaacccggagtggagcctcaggattctcgccgtaggtctccacaggaggggccaacgtggtcccgagggagaaggtcgccaagggcaccaggagagcctaccccagcatccttctttattggcgaccagaatggtgacgcggtactgtcacggaaacccttggccgcacccggagatggggaaggactgggacaaacagcacagcccagccctcctgcacgggatggagtgtatgtgagtgctaacgggaggatggtgattcaactgcggcctggaagatcacccgaacccgatgggccagctcctgcattcttacgccaggaaagttttaccaaggagcccgcaagcggaccacccgctccagggaagcctccacatatttcctcacaccccctacttcaggatttggcagctacaagagcggctcgcatggacttccactcccaggacacacacctgatcctcaaagagacggaaactgcactggccgcacttgaggctcgattgctgtctaattcagtagacgccgagtgcgaagggggatctacccctcgaccgcctgaagatgcactgagcggagacagtgacgtggatacagcatccaccgtctcactgcgctcaggaaagagcggccctagtcccaccacgccacagcccctgcgcgctcagaaagagatgtcaccaagcccccctgccgcacaggacccaggcggaactgcgctggtttccgccagagaacagtcctcggagagacagcatcaccctctcggccctaccgacatgggcagaggcgaacccgtgaggaggagcgctatcagacgagggcaccggccacggggtagtcttgattggccctcagaggagaggggaccagtgttggcccacctcccatcaagtgacgttatggcaagcaatcacgaaacacctgaagctaccggtgccggtaggttgggctcacgcagaaaacccgcagctcctccgcctagtcctgccgcacgggaagagcaatcgcggtcaagcgctagcagtcagaaggggcctcaggcattgactaggtctaacagtctgtctaccccgagaccgacccgggcatctcgccttaggcgtgcccgtctcggggatgcgtccgataccgaggccgcagacggagagagggggtctctggggaacccagagcccgtgggaaggcccgctgccgagcaagccaagaaactgtcgcgcttagacatcctcgctatgccaagaaagcgcgcaggaagttttaccggaactagtgacccagaggcggcacccgctaggaccagcttttccggaagatccgtcgagctgtgctgtgcttcccgtaaacctacaatggcagaagcaagggctgtgagccgcaaagcggctaacaccgccaccacaacaggacctagacaaccgttctctagagcacgctctggatcagcgcgatacactagtaatacccggagaagacagcagggaagcgactacacctctacatcggaggaggagtatggatcccgccacggatcccccaagcatacgaggtcccatacttccactgccactcaaacgcccagagcgggttccagcagtcgtgccagatccagagcgccaggccctcgagatacagatgatgacgaggaggagccggacccttatggttttatcgtccagaccgcagaaatcgccgagatagctcgcctctcacaaaccctcgtaaaagacgtcgccattctggcacaggagatccacgacgttgccggagacggagatacactaggctcaagcgagcccgcacactctgcatccctctccaacatgccttcgactcctgcctcgacaatctctgcgagagaggaattagtgcagagaatccccgaggcttccctcaattttcaaaaagtccctcctggttctctcaattcccgcgatttcgaccagaatatgaatgattcatgcgaggacgccttggccaacaaaaccagacctcggaacagagaggaggttattttcgacaatctcatgctgaaccctgttagtcaactaagtcaggccatcagagaaaacacggagcatctggccgaaaaaatgaaaatcttgtttcagaatacgggaagagcctgggaggatctcgaagcacgtatcaatgctgaaaacgaagtccccatattaaaaacatccaataaagaaattagttccattctcaaagagttgcgtcgggtacagaaacagcttgaagtgatcaacgccattgtggacccctcaggatcactcgatctgcttacagggaatcggtcactggcatctagcgcccagccagggttggggaaaggcagggtggccgcacaatcccctccctcccctgcgtcagctgaggccctcctccctgccttgcccctccgcaattttccccagcgcgcatcctgtggtccacctagccttccagatccaacgtttctgccagacgccgaaaggttccttatatag

SEQ ID NO: 30679 - DNA, 1452 bp, Artificial Sequence
  Description of Artificial Sequence: Synthetic coding sequence
atgtctggcggaggcccttccggcggaggccctggaggttcaggcagggcaaggacctccagtttcgcagagcccggtgggggaggcggtggaggcggaggcggtccaggcggatccgcctctggcccaggcggaacaggaggtgggaaggccagcgttggggctatggggggaggcgtcggagcaagctcttccgggggaggtcctgggggtagtggtgggggtggaagcgggggaccaggcgctgggacgtccttccctcccccaggcgtcaagttaggcagagactcaggcaaagtgaccaccgttgttgcaaccttgggtcagggacctgaacgatcacaggaggtggcatacacagatataaaggtgatcgggaacggatctttcggggtggtgtaccaggccagactggctgaaaccagagagctagtggcaatcaagaaggttctccaggacaaaaggtttaagaatcgcgaactgcagattatgcggaagctggatcactgtaatatcgtcagactacgctacttcttttactcctccggtgaaaagaaagacgagctctatctgaaccttgtgctggaatacgtgcccgagaccgtttaccgggtggctcgtcatttcaccaaggctaagctcactatacccatcctgtacgttaaggtgtacatgtaccagctttttagaagtctagcctacattcacagccagggcgtctgccacagagacatcaagccgcagaacctcctggtggacccagacaccgctgtgctaaaactgtgtgacttcggcagcgccaaacaactcgttcgcggtgagcccaatgtgtcctacatatgtagtcgttactaccgggctcctgaactgatcttcggagccaccgactacacctcaagcatcgacgtgtggagtgcgggatgcgtgctggcggagcttctactgggtcagcccatcttcccaggggattctggcgtggatcagctggtcgagataatcaaggtgctaggaacccctactagggagcagattcgcgagatgaacccaaactacacagagtttaagtttccgcagataaaagctcatccttggactaaggtgtttaagagcaggacccccccagaagctatcgccttgtgttcctcgctcctggagtacactcctagtagccggctgagtcccttggaggcttgtgcgcactctttttttgacgagctacgatgtctgggaacacaattgccgaataatcgccctctgcccccactgttcaatttctcagctggcgagctctctattcagccaagtctgaatgctattctcattccccctcatcttagatcaccagctggtactacaacactcacaccatcctcccaggctctaacagaaacccccaccagcagcgattggcagagtactgacgcaacaccaacactcaccaacagctcatag

SEQ ID NO: 30680 - DNA, 1389 bp, Artificial Sequence
  Description of Artificial Sequence: Synthetic coding sequence
atgggcggagctgaagcagagccttgggggcgagcacctggcccagcaatcggtgggcgtagagcaggggacagttgtcccggttggagaagaaggagcagatctcggggacgcggacagcggttgtcgcacggtccacgcaggaggccacagctgctaacagcagcccctccactgcaggcacgcggagcctttcgctctttcccccattcatggggagaggattttctagcttctctgatgtttaagatccagctcgaacccttgaaactccgagcctggacactcaacgggtttgtgaaatttagaaataaagaaaccagcgccggaccagttgccgtaatggggaaagactactacaaaattcttggcatacccagtggggctaatgaggatgaaatcaagaaagcctataggaagatggccctgaagtatcaccccgacaagaacaaggaaccaaacgctgaggaaaaatttaaggaaatagccgaagcctacgatgtcctgtctgatcctaaaaaacgaggtctgtatgaccagtatggagaagaaggcctcaagaccggcggaggaacgtcaggcggttcaagtggttctttccattacacatttcacggtgatccacatgccaccttcgctagtttctttgggggatcgaatccctttgatattttctttgcctcctccagatctaccagacccttctctggattcgatccggacgacatggatgtcgacgaagatgaggatcctttcggcgcttttggacgatttgggtttaatggcctttcccgcggaccaagaagggcacctgagcctttgtacccccgtagaaaagtgcaggatcctccagtcgttcacgaactccgggtgagcctggaagagatctatcacggctccactaaacggatgaaaatcactcgccgaaggttgaatcccgacggaaggaccgttcgtactgaagataagattcttcacattgtcataaaacgcggatggaaggaaggaacgaagatcactttccctaaggagggtgacgctacccctgataatattcctgcggacatcgtttttgtgttaaaggacaaaccccacgctcactttagaagagatgggacaaacgtgctctatagtgccttgattagcttgaaagaggctctctgtggttgtacagtcaacattcccactatcgacggacgggttatccccttgccatgtaatgatgttatcaaaccgggtacagtcaaaaggctgaggggtgaggggctgccctttcctaaagtacccacgcagcgtggagacctgatcgtggagttcaaagtgaggtttccagatcgcctcactcctcagacgaggcaaatccttaaacagcaccttccatgtagttag

SEQ ID NO: 30681 - DNA, 279 bp, Artificial Sequence
  Description of Artificial Sequence: Synthetic coding sequence
gtgtacggtgcaaaagatatcgaacttagtccagaggcccaggctaaaatcgatagatacacacagcaggggtttggcaacctgcccatctgtatggctaagacacatttatcgttatcccaccagcctgacaagaagggggttccccgagatttcatcctgccaatttcagatgtcagagctagtattggcgctgggttcatttatcccctcgtaggaaccagaagctcgcccctggccttagtgggggagtcacaacctaaacaggtgcacccatag

SEQ ID NO: 30682 - DNA, 468 bp, Artificial Sequence
  Description of Artificial Sequence: Synthetic coding sequence
atgagcgttacttacgatgactcagtgggagtggaggtctctagcgatagtttctgggaggtaggaaattacaagcgcactgtcaaaagaattgatgacggacataggctgtgctccgatctgatgaactgcctgcatgaaagagccagaatcgaaaaagcgtacgcccaacagctaaccgagtgggctaggcggtggcgccagttggtggaaaagggcccacagtacggaacagtggaaaaagcctggatggcatttatgagcgaggcggagagagtctcagagctgcacctggaggtgaaagctagtctgatgaatgatgacttcgaaaagatcaagaattggcaaaaagaagcctttcacaagcaaatgatgggcggatttaaagagaccaaagaagccgaggatggatttcgcaaggctcagaaaccttgggccaagaagctgaaggaggtgcacttgtcctag

SEQ ID NO: 30683 - DNA, 483 bp, Artificial Sequence
  Description of Artificial Sequence: Synthetic coding sequence
atggaggccgagcgtccacaagaggaagaggatggggagcaaggtcctccccaggacgaagaaggctggcctccccctaacagcaccactcgcccttggaggtctgcacctccgtcacccccaccgcctggcacccgtcacactgcactcggaccaaggagcgcttccctgctatcattgcagaccgaactccttctcgacctggttgccgaggctcaaagcagacggcttgaagagcaaagggcgactttttacactccacagaatccatcttcattggcacccgcacccctccgacccctcgaggatcgcgagcagctgtattcaaccattctgagccaccaatgccagagaatggaggcccagcgcagtgaacctcccctgcccccaggcggacaggaactactggaactactgctgagagtacagggagggggtcgtatggaggagcagcggtctaggcctcctacccatacttgctag

SEQ ID NO: 30684 - DNA, 660 bp, Artificial Sequence
  Description of Artificial Sequence: Synthetic coding sequence
atggaaccttcagctcagcagctgcagctcgcggcttctctgcccgctaatctgagcaatttttgccaaggctctgaaatgccaacaacctcccgccctgctctggacgtcaagggcggaacttcaccagctaaagaggacgccaatcaggagatgagtagcgtggcctatagcaacctggccgtgaaggataggaaggcagttgcgatcttgcactaccccggagtggccagcaacgggaccaaggcgtcaggcgcacccacgtctagctccgggtctcccattggaagccccactactactccccctactaaaccgccttccttcaacttacacccagcccctcacttactcgccagcatgcaccttcagaagcttaatagccaatatcaaggcatggctgcggcaacccctgggcagcccggagaagctgggcctctgcagaactgggactttggtgctcaggccggaggtgcagaatccctctccccttctgcaggagcccaatcccctgccatcatcgactccgaccctgtggacgaagaagtgctgatgagcttagtggttgaattgggactcgacagagcaaacgagctcccagagctctggttaggtcagaacgaattcgacttcactgccgatttcccttcatcttgctag

SEQ ID NO: 30685 - DNA, 318 bp, Artificial Sequence
  Description of Artificial Sequence: Synthetic coding sequence
atgaatatgatctggagaaattccatctcatgcctgcgtctcgggaaagtgccacaccggtatcagtccggataccatcccgtggcgccacttggatccagaatcctgacagatcccgcaaaagttttcgaacataatatgtgggaccacatgcagtggtccaaggaagaggaagccgctgctcgcaagaaggtaaaggagaattcagccgtgagggtcctgctggaagagcaggtcaaatacgaacgggaggcgtctaagtattgggatactttctataagatacacaagaacaaattctttaaagatagaaactag

SEQ ID NO: 30686 - DNA, 366 bp, Artificial Sequence
  Description of Artificial Sequence: Synthetic coding sequence
tgagagggcgaaagtcccacggcaagtcctcattccagtgccaccgatgacctgcaccactctgaccgttaccaaacattcctacgggtacgagcaaacagacagacccgcctgaatgccagaataggcaaaatgaaacggaggaaacaggatgaaggacaagtatgtccattatgcaatcggccactggctggaagcgagcaagaaatgagccgccacgtggagcactgtctcagcaagcgagagggaagctgtatggccgaagatgacgctgtcgacatcgaacacgaaaacaacaatagatttgaagaatacgaatggtgtggacagaaaaggattagagctactacactgcttgaaggctag

SEQ ID NO: 30687 - DNA, 1701 bp, Artificial Sequence
  Description of Artificial Sequence: Synthetic coding sequence
atggatctgcaccgggcagcattcaagatggaaaacagctcatacttgccgaatccactcgcttccccggctctgatggttctggcgtctacagccgaagctagccgggatgctagtatcccatgccagcagccacggcctttcggagtgccagtctccgttgataaggacgtccatattcctttcaccaatggttcttacacttttgctagcatgtatcatagacagggcggtgtgcccggaaccttcgctaatcgcgatttccctccatcccttctccaccttcacccccagttcgccccaccgaatctggactgcacacctatcagcatgctaaaccactccggagtgggcgcattcagaccttttgcctccactgaggatagggagtcctaccagtccgctttcactcccgcaaaacggttgaaaaactgccacgacaccgaatccccacacctgcggttctcagatgccgatgggaaggaatacgacttcgggactcaactgccctcctcctccccagggtccctcaaggtggacgatacaggtaaaaagatattcgccgtttctggtctcatctccgatcgtgaggcatcatcttctcccgaagaccgcaatgacagatgtaagaaaaaggctgcagctctttttgattcacaggcaccaatatgcccgatctgtcaggtgttgttacgtccctcagagcttcaggagcacatggagcaggagcttgagcaactcgcccagcttccaagctccaagaactcactcctcaaagatgctatggcccctggtacacccaagtccctgctgctgtctgcatccataaagcgcgaaggagaaagcccgacagcgtcgcctcactcctctgcaacagatgaccttcatcactcggacaggtaccaaacatttttgagggtgagggctaatcggcagactagactgaacgctcgtatcggcaaaatgaaacgacgtaagcaggacgagggccagagggaggggtcgtgtatggccgaggatgatgcagtggacattgaacacgagaacaacaacaggttcgaagaatatgaatggtgtggccagaaacgcatcagagctacaactctgctggagggcggttttagaggatcagggtttatcatgtgtagcggaaaggagaatcccgacagtgatgccgacctggacgttgatggcgatgacaccctggagtatggaaagcctcagtataccgaggccgatgttattccttgtaccggcgaggaaccgggagaggctaaggagagagaagctctgcggggagcagtgctcaatgggggtccaccaagcacgcggataactcccgaattttcaaagtgggctagcgatgagatgccgtccacatctaatggagaaagcagcaaacaagaagcaatgcagaaaacttgcaagaacagcgacattgagaagatcaccgaggactcggccgtgaccactttcgaagctctgaaagctagggttagagagctggagcgtcaactgagccggggagacaggtacaaatgtctcatttgtatggacagctattctatgcccctgacctctatccaatgctggcatgttcactgtgaagagtgttggctgaggacactgggcgcaaaaaaactctgcccgcaatgtaacacaatcaccgcccctggcgaccttaggcgaatctacctctag

SEQ ID NO: 30688 - DNA, 4719 bp, Artificial Sequence
  Description of Artificial Sequence: Synthetic coding sequence
atgttgcttcacctgtgtagtgtcaaaaacttgtaccaaaacaggttcctgggtctagctgcaatggcatcaccttccaggaacagtcagtcacgtaggcgctgcaaagaacccctaaggtattcctataatccagaccagttccacaatatggacctccggggaggcccacatgatggcgtcactatccccaggtccacgagcgacacagaccttgtcacgagcgatagtaggagcactcttatggtgtcatcctcttactatagcattggccactctcaggacctggttatccattgggatattaaggaggaagtagacgcaggggattggataggaatgtatctgatcgatgaggtgctctctgaaaacttcttagactacaagaatagaggcgtaaacgggtctcaccgcggacagatcatatggaagatagatgcttcttcttactttgttgaaccagagaccaaaatttgtttcaaatactaccacggagtatcgggcgctctacgggcaactactccctccgtcacagtgaagaattcagctgctccaatctttaagtcgataggtgctgacgaaaccgttcagggtcagggcagccgacgcctgattagttttagtttgagtgacttccaggctatggggctgaaaaaagggatgttcttcaaccccgacccatatctcaagatctccatacagcctgggaagcactcaatattccctgcgctgccacaccacggtcaggagcgccgttccaaaataataggaaatacagttaatccgatttggcaggctgaacaattctcttttgtctctttaccaactgacgtgctcgagatcgaggttaaagacaagttcgccaagtctcgtccaatcattaagcgctttctggggaagctgtctatgcccgtccaacgcctgttagagcgccatgctatcggcgatagagtggtgtcctacaccctcggcaggagactgccaacagaccatgtgagcggccagctgcaatttagattcgaaattacaagttctatacatccggacgatgaagagatatccctgtccactgaacctgaaagcgctcagatccaggactcgcccatgaacaacctcatggagagcggaagtggcgagcctagaagcgaggcccctgaaagcagcgaatcctggaaacccgaacagttgggggaaggtagcgtgccagatggacccggtaatcagtccatcgagctttccagacccgctgaagaagccgctgtgattacggaggctggcgatcaagggatggtgtccgtcggaccggagggagcaggcgagctcctggctcaggtccaaaaagatattcaacccgctccttctgcggaggaactggctgaacagttggacctcggggaggaggcctccgccttactgttagaggatggggaggctccagcctcaactaaagaggaacctctcgaggaagaggctactacccagtccagagccggtcgggaggaagaagaaaaggaacaggaggaagagggggacgtgagcacattggagcagggcgaggggcgattacagttgcgggctagtgtcaagcgcaagagcagaccctgttcccttcccgtatctgagctggagacggtcatcgcgtccgcttgcggtgacccagaaacaccaaggacacattatattagaattcacaccctgctgcacagtatgccttcagcccaaggcggatcagctgccgaggaggaagacggagcagaggaagaatcaactcttaaagactcaagtgagaaggacgggctttcggaggtggacacggtagccgctgatcctagtgccctggaagaggaccgcgaagaaccagagggagctacaccagggactgcgcatcccggacacagtggaggccactttccaagcctggcaaatggagccgctcaggacggagatacacacccttcaaccgggagtgaatccgattcttctcccaggcaaggcggtgaccattcttgtgaggggtgtgacgcgtcgtgttgttccccctcctgctactcctcatcctgctacagcacgagctgctactcctccagctgttatagtgcgtcttgctattcaccttcttgttacaacggaaatagatttgcgtcccacacccgcttctcctccgtggattccgctaagatttccgagtctactgtgttcagtagtcaggacgatgaggaggaggagaactcagccttcgagtctgttcctgattccatgcagtccccagagttggaccctgagtctacaaacggcgctgggccatggcaggacgaactcgctgcaccatcagggcacgtggagagatcaccagaggggttggagtctcccgttgccggacccagcaaccgcagggaagattgggaggctcggattgactctcatggaagagttttctacgtcgatcacgtgaatcgaacaacaacctggcaaagacctacggctgcggctacaccagacggtatgagaaggtcggggtctatccaacagatggaacagctcaatcgcagatatcagaacattcagcgcacaatagcgaccgagaggtcagaagaggattcggggtcacaatcttgtgagcaggccccagcgggtgggggtggcggtggaggctctgactcagaggcagaatcttcgcagtcgtctcttgacctgcgcagggagggatcgctctccccggtcaactcacagaagatcaccctcctgctgcagagtcccgctgtgaagttcattacgaatcctgagttcttcaccgtgcttcacgccaattactccgcctacagggtttttacatccagcacatgcctcaaacatatgatcttgaaggttcgaagagacgcccgaaatttcgagagatatcaacacaaccgggaccttgtgaatttcatcaacatgttcgccgacacgagattagagctgcccaggggttgggagatcaagaccgatcagcagggaaaatctttctttgtggaccacaacagtcgtgccaccacatttatcgatcctcgaatcccattacagaatggcagactcccaaaccacctcacccacaggcagcatctgcaacggctccgctcctattccgccggagaggcgtctgaagtgtcaagaaacagaggagctagtcttctcgcccgacccggtcatagcctggtggcagccattagaagccagcaccagcacgagtcacttcctctggcctataacgacaagatagtggcctttttacgacagcccaacatatttgagatgctgcaggagagacaaccaagcctggccaggaaccacacactcagggagaaaatacattatatccgcacagaagggaaccatggtctggaaaagctcagctgtgacgctgacctggtaatcctgctcagtttgttcgaggaggaaataatgtcgtacgtccccctacaggccgctttccatcctggctacagtttctccccaagatgcagcccctgttcttctcctcaaaattcgccgggactccaacgcgctagtgctagggcgccaagcccttataggcgcgactttgaggccaaacttagaaatttttacaggaaactggaagctaagggttttggccaggggcctggcaagattaaactgattatccgcagagaccacttattggagggcacctttaaccaggttatggcctactctagaaaagaacttcagcgaaataaactttatgtgaccttcgtcggagaggaagggctcgattattcagggccatcgagggaattttttttccttctctcacaggaactattcaacccatattacggtctgtttgaatactctgctaatgacacctacaccgtgcaaatctcccctatgtctgcttttgtcgagaaccacttagaatggtttagattcagcggaaggatcttgggcctggcattgatccatcagtacttattagacgcatttttcacacgacccttttacaaagcccttctgcgattgccctgcgatctgagcgatcttgaatatttggacgaagagtttcatcagagcctccaatggatgaaagataacaatattacagatatcctggatcttacatttaccgtcaatgaggaggtatttggacaagtgacggaacgtgaattaaagagcgggggagcaaatacacaggtgaccgaaaaaaacaagaaagagtatatcgagcgaatggtgaagtggcgggtggagcggggtgtggtgcaacagacggaagctcttgttaggggtttctacgaagtcgtcgattcccggttggtgagcgtctttgacgctcgggagttggaacttgttattgcgggtaccgctgagatcgatctgaatgactggcgtaacaataccgaatacagaggaggttatcatgatggacatctggtcatcagatggttctgggctgcagtggaacgttttaacaatgagcagagattaaggctgctgcagtttgtgactggtaccagctctgttccctacgagggattcgccgctctaagggggtcaaatggacttcggaggttctgcattgagaaatggggtaagattactagcttgcctagggctcatacatgctttaaccggctcgatctaccgccttatccgtcttactcaatgctatacgagaagctgttgaccgccgtggaggagacctccacgttcggcttggagtag

SEQ ID NO: 30689 - DNA, 1629 bp, Artificial Sequence
  Description of Artificial Sequence: Synthetic coding sequence
atgagtgggctcgtgctgggccagagagacgaacccgctggacaccgcctgagccaggaggagattctcgggtccacccggctcgtgtcccagggactcgaagccctaagaagcgaacaccaggctgtgctgcagagcctgagtcagacgatcgaatgtttacagcaaggaggccacgaggaaggcctggttcatgaaaaggccaggcagctgcgtcgatcgatggaaaacattgaacttggattgtcagaagctcaggaggagaaagagggggatgccactaaggacagcctggacgatttgttccctaacgaggaggaagaggaccccagcaacggactatcccgtggccagggcgcaaccgctgcccagcagggtgggtacgagattccagcgcgactgcggaccctgcacaacctggtgatccagtacgcagctcaaggcaggtatgaagtagctgtgcctctgtgtaaacaggctctggaggacttggaacgtacaagcggtaggggtcatcctgatgtggctactatgctgaatattctcgcactggtctatagggaccagaataagtacaaggaggctgcccatctgctgaacgatgctttgtcgattcgagagtcgacactggggcctgatcatccagccgtcgccgctacacttaataacctggcggtcctttatgggaaacgagggaagtataaagaagccgaacctctatgccaaagggcgctggagattagggaaaaagtgcttggaacgaaccaccctgatgtggcgaagcagctgaataatttggcacttctatgccaaaaccaggggaaatatgaggcagtggagagatattaccagagggcactcgccatatacgagggccagttggggcctgataacccaaatgtggcacggacgaagaacaacctggccagttgttatttaaaacagggtaagtatgccgaagcagagaccctgtacaaagagattctgacacgggctcacgttcaggagttcggctctgtagacgatgaccacaaaccaatttggatgcatgcggaagaaagagaggaaatgagcaagagcagacaccatgaaggcggtactccatatgcggagtatgggggatggtataaggcttgcaaggtttcatcccctaccgtgaatacaacactaaggaatctgggggctctgtatagaaggcagggcaagttagaagcagccgagacgttggaagagtgtgccctgaggagccgacgacagggcacagacccgatttcccaaaccaaagtggctgaattgcttggagagagcgacggaagaagaactagccaggaaggacccggagactccgttaagtttgaaggcggtgaagacgcttctgtcgcagtcgagtggtccggagacggcagcggtactctgcagcggtcagggtccctgggaaaaattagggatgttttgcggcgaagtagcgagctcttagtgaggaaactgcaggggaccgagcccagacccagctcgagcaatatgaagcgagcggcttccctcaactacctaaatcaaccctcggctgcacccttgcaggtgtcaagaggtctttcagccagtactatggatttatcaagttcctcttag

SEQ ID NO: 30690 - DNA, 1548 bp, Artificial Sequence
  Description of Artificial Sequence: Synthetic coding sequence
atgtgccaggtcggtgaggattatggggagccagccccagaagagccaccccctgccccaagacccagtagagagcagaagtgtgtcaaatgtaaggaggctcagcccgtggtggtcatcagggccggagacgcattctgcagagactgcttcaaggctttttacgtccacaagtttagggccatgctgggtaagaacagactgatattcccaggggaaaaggtgcttctggcatggtccgggggtccaagttccagcagtatggtttggcaagtgctggagggactgtcccaggattccgcaaagcggttacgattcgtagcaggggtcatcttcgttgatgagggagctgcctgcgggcagtcgcttgaggaaagatcaaagaccctggcggaggttaagcccatcttgcaggcaactgggtttccttggcacgtggtggccctcgaggaagtgttcagtctacccccatcggtgctttggtgttctgcccaggaactcgtcggctctgagggtgcctataaagccgcagtagactctttccttcagcagcagcatgtgctaggcgcaggcggtggtcccggaccaacacagggtgaggaacagcccccacagccacccctggacccacagaatctcgcaagaccccctgctccagctcagacagaagcgttatcccagctgttttgttctgtgagaaccttgaccgctaaggaggaactgctgcaaactctccgaacccatttaatacttcacatggctcgagcccacgggtactctaaggtgatgactggcgacagttgtacccggttggccatcaagcttatgacaaatcttgctctgggcagaggggcatttctggcttgggatacggggttcagcgacgaacggcacggggacgttgtcgtggttcggcctatgagagatcatactctgaaggaagtggccttctacaaccgtctattttcggttccctccgtcttcacccccgctgtggacacaaaggcacccgagaaagcatccattcatcggctcatggaggctttcatccttcgtctacagactcaattcccaagcacagtcagcaccgtgtatcggacctcagagaagcttgtcaagggcccacgagatggtcccgcagcaggtgattcaggtcctcgctgcctgctgtgcatgtgtgccttagacgtggacgcagccgactccgcgactgcttttggcgcacagacatcctcccgcctaagccagatgcaaagcccaatccccctgactgagactaggactcctcccggaccttgctgcagtcctggcgtgggttgggcccagagatgtggccagggagcctgtcgaagagaagaccctcaggcttgcatagaggagcagttatgctattcttgcagagtgaacatgaaagatctaccctcattagacccactgcctccctatatcctcgccgaggcccagctgagaacgcagcgggcatggggcctgcaggagattcgcgattgcctgatcgaggattccgacgatgaagccggacagtcctag

SEQ ID NO: 30691 - DNA, 1263 bp, Artificial Sequence
  Description of Artificial Sequence: Synthetic coding sequence
atgttcaaacggactgtcctatcttgcccccctcccgcagcaccccctctccaggcgagaggcgcatttcggtccttcccccattcctggggcgaggacttcctcgccagtctcatgttcaaaatacaattggagcctttgaaacttagagcctggaccttgaacggcttcgtgaagtttcggaataaagagactagcgccggacccgtcgctgtgatgggaaaggactactacaaaatattggggatcccatcaggagcgaatgaggacgaaatcaaaaaggcatatcggaagatggctctaaagtaccacccagataagaataaggagccaaacgctgaggaaaagtttaaagaaatcgctgaagcatatgatgtcctgtccgatccgaaaaagcgaggcttgtatgatcagtatggcgaggagggcttaaaaactgggggtggcacctccggcggttcttcaggatcttttcattacacctttcacggcgaccctcatgctacctttgctagcttctttggcggtagcaacccttttgatatttttttcgcatctagtaggtctacaaggccgttcagtggttttgaccccgacgacatggatgtggatgaagatgaggacccatttggcgctttcgggagatttggcttcaatggcctaagtagaggccctcgtagagcccctgaacccctgtaccctagacggaaggtgcaggaccctcctgttgttcatgagctgagagtgagtcttgaggagatctatcatggttctaccaagcggatgaaaatcacacgaaggcgtctcaatcccgacggacgcacagtgcgaacagaagataagatcttgcatatcgtgattaaaagaggttggaaggaggggaccaagatcacctttccaaaggagggagacgctactccagataatatcccagccgacatagtgtttgtactgaaggataagccacatgcacacttcaggagagacgggaccaatgtactttacagcgccttgatctcgctgaaagaagccttatgtggctgcaccgtgaatatccccaccattgatggtagagtgatcccccttccttgcaatgacgtgatcaagcctggaaccgtgaagagattgcggggagagggactgccgtttcccaaggtgcccacccagcgaggagatctcatcgtcgaatttaaggtaagatttccggaccggttaacgcctcagacccgacagattctgaaacagcacctcccctgctcctag

SEQ ID NO: 30692 - DNA, 2979 bp, Artificial Sequence
  Description of Artificial Sequence: Synthetic coding sequence
atgtatggctctgccaggtctgtcgggaaggtcgagccgtccagccagtctcccggacggtcccctagactgccaagaagtcctcgcctaggacatcgcagaactaactccactggaggatctagtgggtctagtgtggggggaggttcgggtaaaactctgagtatggagaatatccaatccttgaatgccgcttatgccacatccggtcctatgtatttgagcgaccacgagaatgtgggctcggaaacacctaaatccaccatgaccctgggacgctctgggggaaggctgccgtatggtgtcagaatgacagcgatgggcagtagccccaacatcgcaagctctggggtagcctccgatacaattgcatttggagagcaccacttaccccctgtctcgatggctagcactgtgcctcattcacttagacaggccagagacaacacgattatggacctacagactcaattgaaggaggtgctccgggagaacgacctgctgaggaaagatgtcgaggtgaaggaatctaagctgagtagtagtatgaattctatcaagacattctggtcacccgaactgaaaaaggaaagggctctgcggaaggatgaagcttccaaaattactatatggaaggagcagtatcgcgtggtccaggaggagaatcagcatatgcagatgaccattcaggccctgcaggacgaactccggattcagcgcgacctgaatcagttattccaacaggattctagcagccgcactggggaaccatgtgtggcagaattgactgaggaaaacttccagcgactacacgccgagcacgagagacaggctaaagagctgttccttctccgcaagactctcgaggaaatggaattgaggatcgaaacccagaaacaaacactgaacgccagagatgaatctatcaaaaaactccttgagatgctgcaatcaaaaggtctttctgccaaagccacagaggaggatcatgagcgtacacgccgtctggccgaagcggagatgcacgtgcaccacctcgagagcttgctggagcagaaggagaaggaaaatagcatgctccgcgaggaaatgcaccgtcgctttgaaaatgctcctgatagcgctaagactaaagccttacagacagtgattgagatgaaggattctaaaatcagttctatggagaggggcttacgcgacttggaagaggagatccagatgctgaagagtaacggggctttgtctaccgaagagcgggaggaagagatgaaacagatggaagtgtaccgatcacactccaaatttatgaaaaataagatcggccaggttaaacaggaactgagccgcaaggacaccgaattgctggcactgcagacaaaacttgagactctcacaaatcaattctccgactctaaacagcacattgaggttctgaaggagtccttgactgcaaaggaacagagagcggctatactccagactgaggtggacgcactacgcttgaggctggaggagaaggaaacgatgctaaataagaagacaaaacagattcaagacatggctgaggaaaagggaacacaggcaggagaaatccatgatcttaaagacatgctcgatgtgaaagagcggaaagtgaatgtgctgcaaaagaagatagaaaacctccaggagcagctccgcgacaaggagaagcagatgtcctcactgaaggagcgggtgaagagcttgcaggcggacaccacaaacacagacactgccctgaccaccctggaagaagctctggctgagaaggaaaggaccattgaaagactgaaagaacagcgagatcgggacgaacgggagaagcaggaagagatcgacaactacaagaaagacttaaaagacctcaaggagaaagtatctcttttgcagggtgatcttagcgagaaggaagcatcattgctcgatcttaaagagcacgcttccagtctggcttcttcagggctcaagaaggattcgcgtctcaaaaccttggagatcgctctggagcagaaaaaggaagaatgcctaaagatggaatctcagctaaagaaggcacacgaagccgcactggaggcacgggctagccctgaaatgtcagacagaatacagcaccttgagagggagataacccgctacaaagacgaaagctccaaagcgcaggctgaagtggatcgactcctcgagatacttaaggaggtggaaaatgaaaagaatgataaagacaagaaaatcgccgagcttgagagcctcttcagccgacaggttaaggaccaaaacaaaaaagtggcaaatctgaagcacaaggaacaggttgagaaaaagaagtccgctcaaatgctggaggaagccaggaggcgtgaagacaacttaaatgattcgagtcagcaactgcaggatagcctgagaaagaaagacgaccggatcgaggaactggaggaagctctacgagaatctgtacagattaccgccgaacgcgagatggtcctagcacaggaagagtctgccagaacaaatgccgagaagcaagtggaggagctgctgatggctatggagaaagtgaaacaggaactggagtccatgaaagcaaaactaagtagtacgcagcagagcctcgccgagaaggaaacccacttgacaaatctgagagcggaacgcagaaagcacctggaggaggttctcgaaatgaagcaggaggctctgctggcagcgatttctgagaaggatgctaacatcgctttgcttgaactgtcgagcagcaagaagaagacccaggaggaggttgcagccctgaagagggaaaaggatcggctcgttcaacagctcaaacagcagacccagaatcggatgaaactaatggcagacaactacgaagatgatcactttaagtcttcacactctaatcagaccaatcacaagccatctccagatcaagacgaagaggagggcatatgggcttag

SEQ ID NO: 30693 - DNA, 180 bp, Artificial Sequence
  Description of Artificial Sequence: Synthetic coding sequence
atggagccttcagcccagcaactacagctcgctgcgagtctgccggctaacttatccaacttttgtcagggaagcgagatgcctactacgtcgaggccagcattggacgtgaaaggagggacttctcctgcaaaggaggacgctaatcaggagatgagctcggttgcatattcgaactag

SEQ ID NO: 30694 - DNA, 6977 bp, Artificial Sequence
  Description of Artificial Sequence: Synthetic coding sequence
atgaaaaagggaagtcaacaaaagatcttcagtaaggctaaaattcctagcagcagtcacagcccaattccttccagtatgtccaacatgcgctcaagatcactgtccccactcatcggcagtgagacccttccctttcacagtggtgggcagtggtgtgaacaggtagagatcgctgatgagaacaacatgttactcgattatcaggatcacaagggagctgattcgcacgccggtgtccggtacattactgaggcacttataaagaagctgacgaagcaagacaatctagccctcatcaaatctctgaatctaagtctgtccaaggacggtggtaagaagtttaagtacatagaaaatctcgaaaaatgcgtaaagctcgaggttctcaacctgagttataatctgattggtaaaatagaaaagcttgacaagttgctaaagctgcgcgagctcaacttgtcctataataagatttcgaagatcgaagggattgaaaacatgtgcaacctgcagaagttgaatctggcaggaaatgaaatcgagcacatacctgtgtggcttggaaagaaactgaagagcctcagggtcctcaatcttaaaggcaacaaaattagtagccttcaggacataagcaagctcaaaccccttcaggatttgatcagtctaatcctggtggagaatcccgttgtcacactgccccattacctccaatttactattttccatctgagatcacttgagtccctggagggccaacccgtgaccactcaggacagacaggaggcatttgagaggttcagccttgaggaggtagaacggctggaacgagacctggaaaagaaaatgatcgagacagaggaactgaagtccaaacagacacggtttttggaggagattaagaaccaggacaagctcaacaaaagtttgaaggaagaagctatgctccaaaagcagagctgcgaagaactcaaaagcgatctgaacacaaagaatgaactgttgaagcagaagacaatcgagctcacgagggcctgccagaagcagtatgaacttgagcaggaactggcattctacaaaatcgacgccaaattcgaacctctgaattattatccatctgagtatgcagagattgacaaagctcctgatgaatccccctacattggcaaatcccgatacaagcgtaatatgttcgccaccgagagttacataatcgattcagcccaggccgtccaaatcaagaaaatggagccagacgagcagttgcgcaacgaccatatgaatttaaggggtcacactccgctggacacccagttggaggacaaggagaagaaaatcagtgctgcccaaaccagactgtcagaactgcacgatgagatcgaaaaggccgagcagcagattttgcgggctaccgaagagttcaaacagttggaagaagccattcagctcaagaaaatttccgaagccggaaaagacctcctctataagcaactatcaggcagactgcagctggtgaacaaactgcggcaggaggccctggacctggagttgcagatggagaagcaaaaacaggaaattgctggaaaacaaaaagagatcaaggaccttcagattgccatcgatagcctagactccaaagaccccaagcacagtcacatgaaggctcaaaaaagtggtaaagaacagcagttggatattatgaataagcagtaccagcagcttgagtcccgactggacgaaatcctcagccggatcgccaaagaaacagaagagattaaggatctggaagagcaacttacagaggggcagatagccgctaacgaggctctaaaaaaggacctggaaggcgtaatttcaggccttcaggagtacctgggaaccatcaaagggcaggcaacacaggcgcaaaatgagtgccgaaaattgagagatgagaaggaaactttactacagcgactcacagaagtggagcaagaaagagaccagctcgagatcgtggccatggatgctgaaaacatgaggaaggagctggcggaactagaatccgccctacaggagcagcacgaagtaaacgcatccttacagcagacacagggagatttgagcgcatacgaggcagagctggaagcgagactaaatttgcgtgatgccgaggcgaaccaactcaaggaggagctggagaaggtaacccgtctgacccagctggagcagtctgcgctgcaggccgaacttgaaaaagagcggcaagccctgaaaaacgccttagggaaagcccagttctcagaagagaaagaacaggaaaacagcgagttgcacgccaagctgaagcacctccaggatgataacaatcttctgaagcagcagctgaaggattttcaaaatcacctgaaccacgtagtggatggccttgtgaggcctgaggaggtcgccgctcgtgtggatgaactgcggagaaaactcaaactgggtaccggtgagatgaacatacactccccctccgacgttctggggaaatctctcgccgacctgcagaagcagttctctgaaattctcgcccgaagcaagtgggagagggacgaggcccaggtacgtgaaaggaaactgcaggaggagatggctctgcagcaggagaaattagccacaggacaggaagaatttagacaggcatgcgagagagcgctcgaggccaggatgaattttgacaaacgccagcacgaagcccgaatccaacagatggaaaacgagatccattacctgcaagagaatctgaagagcatggaggaaatccaaggactgaccgatctgcagctgcaggaggcagacgaggagaaggaaagaattctggcacaacttcgtgaacttgagaagaagaagaagctggaagatgccaaaagccaggagcaagtgtttggtttggataaggagctgaagaagttaaaaaaggcagtcgctactagcgacaagctggcaacagccgagctcaccatagccaaggaccaactgaaatccctgcacggtacagtcatgaagattaatcaggagagagccgaggaacttcaggaagcggagagattctccaggaaggcagctcaggctgccagggatctgaccagagcagaagcggagattgagctgctacaaaacctgctgcggcagaaaggtgagcagttccggctcgagatggagaagaccggggtcgggaccggggcaaatagccaagttctggagattgagaagttaaacgaaaccatggaaaggcagaggaccgagatcgccaggttgcagaacgttttggatttaaccgggagtgataataaggggggattcgagaatgtcttagaggaaatcgcagagctcaggcgtgaagtgtcttatcagaacgactacatatcaagcatggccgatccttttaaaaggaggggttactggtacttcatgcctccgcctccctcttctaaagtaagttcccacagttcacaggctaccaaggatagtggcgttgggctcaaatattctgcgagcacccctgttaggaagcctcgacccggtcaacaggacgggaaagagggaagccagcctcctcccgcttccggatattgggtctactcccccatcaggagtggactccacaagctatttccgtcgcgagatgcagattccggaggcgatagtcaagaggagtctgaattagacgatcaggaggagcccccttttgtgcccccacctggatatatgatgtataccgttctacctgacgggagccccgtcccccaagggatggccctgtacgcacctcccccaccgctgcccaataacagtagaccactcacaccaggtacagtcgtttacggtccaccacccgctggagccccaatggtttacgggccaccaccaccaaacttttccatcccctttatccctatgggcgtgttacactgcaacgtgccagagcatcacaatctggagaacgaggtgtctaggttagaggatatcatgcagcacctcaagtcgaagaagagggaagaacgctggatgagagccagtaagagacagagcgagaaagagatggaggagctccatcataacatcgatgatctgctgcaggaaaagaagtctttggaatgtgaagtggaggaactacatcggacagtgcagaaaaggcaacagcagaaagactttatcgacggcaacgtggaaagtcttatgacagaactggagatagagaagtcacttaagcatcacgaagatatagtggatgaaatcgagtgcatcgagaaaactctgttaaagaggcgttccgagctcagagaagccgatcgactgcttgcggaagccgagtcggaattgagttgcacgaaagaaaagaccaagaatgctgtcgagaagttcacggacgccaagcggtcccttctgcagactgagagcgacgccgaagagctggaaaggagggcacaggaaaccgcggtgaatctggttaaagctgatcagcagctgagatctctgcaggccgacgctaaggatttggagcagcacaagatcaagcaggaggaaattctgaaggaaatcaacaagatagtggctgccaaggactccgactttcagtgtttatccaagaagaaagaaaaattgaccgaggagctgcagaagctgcagaaggacatcgagatggccgaacggaatgaggatcatcacctgcaggtgctcaaggaaagcgaggttctcctgcaggctaaacgagctgaacttgagaaactcaagtcacaagtcactagtcaacagcaggaaatggccgtgctggaccggcagctgggacacaagaaggaagagctgcacctgctacagggatctatggtacaggcaaaagctgacttacaggaggccctccgtctgggcgagaccgaagtgacagagaaatgtaatcacatccgagaggttaagtccctacttgaggaactctccttccaaaaaggagagctgaatgtccagatttcagagaggaagacccagctcacccttattaaacaagaaatagagaaggaagaggagaatctgcaagtggtgctgaggcagatgagtaagcacaagactgagttaaaaaatatccttgacatgctgcaattagagaatcatgaattgcaaggcctgaaattacaacacgaccagcgcgtgtccgaacttgagaaaactcaggtagccgtgctcgaggagaagctggagttggagaacctccagcaaatctcacagcagcagaagggagagatcgagtggcagaaacagctgttggaaagagataagcgggaaatcgaaaggatgacagcggagtctcgagccctgcagtcgtgtgtagagtgcctctccaaggagaaggaagatctccaggagaagtgtgacatctgggagaaaaagctggcacagaccaagcgcgtcttagcagcagccgaggaaaatagtaagatggaacaaagcaatctggaaaaactagaactgaacgttagaaaattacaacaagaattagaccagctgaacagagataaactctccttgcataacgatattagcgctatgcagcagcagctgcaggagaaacgtgaggccgtgaactcactgcaggaagaactcgcgaacgtgcaggaccatctgaacctcgccaaacaggacctgctgcacactactaagcatcaggatgtgctgttatccgagcagacgaggctccagaaggacattagtgagtgggctaaccggttcgaggattgtcagaaggaagaggaaacaaagcagcagcagttacaggtccttcagaatgaaatcgaggaaaacaagttaaaactggttcagcaggagatgatgttccagaggctacagaaggaacgcgaatctgaggagagcaaactggaaacaagcaaggttaccctcaaagagcagcagcatcagcttgaaaaggaactgaccgaccaaaaaagcaagttggaccaggtgttgtcaaaggtcctggctgcggaggaacgagtgcgcacactccaggaggaggaaaggtggtgcgagtccttagagaagactttatcccagaccaaacggcagctgagcgagagagaacagcagctagtggaaaagtcaggcgagctgttagcgttgcagaaggaggcggatagcatgcgcgcagacttttctctgctacgtaatcagtttttgacagagagaaagaaagcagagaaacaggtcgcctctcttaaggaagccctcaaaattcagcgctcacagcttgaaaaaaatctgttggaacagaagcaggagaacagctgtatccagaaagaaatggccactatcgaactagtggcccaggacaatcacgagagagccaggcgactcatgaaggagctcaaccagatgcaatacgagtacacagagctgaaaaagcagatggctaatcagaaggacctggagcgcaggcagatggagatctcagatgccatgaggacactgaagtccgaggtcaaggatgaaatccgcacaagtctcaaaaacttgaaccaattcctccctgagctgcctgccgatctggaagccattttggaacggaatgaaaatctagagggggagttagagtcgctgaaggagaatctgcctttcactatgaacgaaggtccattcgaggaaaagctgaacttcagtcaggttcacattatggacgagcattggaggggagaggccctgagggaaaaacttcggcatagggaagacaggctgaaggctcaacttaggcattgcatgagcaagcaggcagaggtactgatcaagggtaagagacagactgagggcacactacattctcttcgtcgccaggtggatgcactgggggaacttgtcacgtctacaagtgccgactccgcaagctctccttccctgtcccagctggagtcctcgcttacagaggactctcagttaggccaaaaccagaagcagaataacagccttaggta

SEQ ID NO: 30695 - DNA, 657 bp, Artificial Sequence
  Description of Artificial Sequence: Synthetic coding sequence
atggatgaactggtgacacttgaggaagcagatgggggatccgacatactattagtggtccccaaggcaacagtgttacagaatcagttagatgagagccaacaggaacgcaatgatttgatgcagcttaagcttcaactggaaggacaggtcactgagttaagatccagagttcaggagttggagagggctctggctaccgcccgacaggagcatactgagctcatggagcagtacaaaggaatttctcgttcacacggcgaaattactgaggagagggacatattgagccggcagcagggcgatcacgttgccagaatactcgagctcgaagacgacattcagactatctccgaaaaggttctaaccaaagaagtggagcttgatcgtctgcgggacacggtcaaggctctcactcgcgagcaggaaaagttgttgggccagctaaaagaggtgcaagcagataaggagcagtccgaggctgagctccaggtggcacaacaggagaaccatcatttaaatctcgatctgaaagaggccaaatcctggcaggaggagcagagtgcccaggcccagcgcctgaaagacaaagtcgctcagatgaaggacactttaggtcaggcccagcagcgcgttcggccatcctggtcaccctag

SEQ ID NO: 30696 - DNA, 693 bp, Artificial Sequence
  Description of Artificial Sequence: Synthetic coding sequence
atgaagaaaccccgacctgctgccgcagctccatctccgcgaccaccagcatgcagcagaggcgcacaccccggaacagcatctgaactgagggtccccgctctgcgcagggggggatgtggcgaccgtaggcttagagaagaagccgcaccggaacaggcagcagccggtccacgtcgctcgaccgtgggagcactgcttgcaagcgagcttggctggaagttctatgacgctgacgactaccaccctgaagaaaatcgcagaaagatgggcaagggcatccccctcaatgatcaagaccgcattccatggttgtgcaacctgcatgacattctactccgagatgtagcttctgggcaaagagtggtgttggcctgctccgccctcaaaaaaacctaccgcgacatcttaacccagggaaaggatggggtggcgctcaagtgcgaggagagcggaaaggaagctaagcaagctgaaatgcagctcctcgtggtgcatctgtccggctccttcgaggttatcagcggcaggctacttaaaagagagggccacttcatgccgccagaattgctccagagccagttcgagaccctcgagccgcctgctgcacctgagaatttcatacagatttccgtggataagaacgtgagcgagatcatcgccacaatcatggaaacgctgaaaatgaaatag

SEQ ID NO: 30697 - DNA, 957 bp, Artificial Sequence
  Description of Artificial Sequence: Synthetic coding sequence
atgtgtcgcacggccctcggtgttacaaccctccaggacttgggagtgtgttggaggaaagaacacgatcccgctgagatgcttcgagtgggtcgagccgagctgggaggctggaagccctcatgggaggccattgtgaaagaagtggccgctgcgactgggcataccgttgttctcgtcgatcaaaccgaggatatcttggcaaaatcgaagaagggtatagaggagtcccttaggaaagtggccaagaagaagtttgcggagaacttaaaagctggcgacgaatttgtcgagaagactctcagcaccattgccacaagcaccgacgccgcatcagtggtccacagtaccgacctggtggtcgaggcaatagtcgagaatctgaaagtgaagaacgagctgtttaaacgtctggataaattcgcagcagagcacaccatattcgcatcgaatacatcctccctgcagattactagtatcgcaaacgccactactcggcaggatagattcgcgggtctacatttttttaatccagttcctgttatgaagctggtcgaggtgattaaaaccccaatgacttctcaaaaaaccttcgaaagcctcgtggactttagcaaggccctgggaaagcaccctgtatcttgcaaggacactcccggttttattgtgaatagactgcttgttccgtatctcatggaggcgatacgattgtatgagcgcggtgacgccagcaaggaagacatcgacacggctatgaagctcggagcgggatatcctatgggcccttttgaactgttagactatgtcggacttgatacgaccaagtttattgttgacggatggcacgagatggacgccgaaaacccactgcaccagccctcccctagcctcaacaaattagtggcagagaataagtttggcaagaagacgggagaaggattctataaatacaaatag

SEQ ID NO: 30698 - DNA, 666 bp, Artificial Sequence
  Description of Artificial Sequence: Synthetic coding sequence
atggctattgtacagacactgcctgtacccctcgagccggctccggaagccgcaaccgccccacaggcacccgtaatggggtctgtcagcagcctcatcagcgggcgtccgtgccctggcggacccgcaccaccaagacaccacggacccccaggaccaacctttttcagacagcaagatggacttttgcggggtgggtacgaggcccaggagccgctttgtccagcggttccacctcggaaggcagttcctgttactagcttcacatatattaacgaggatttccgaactgagtctcctccaagtccaagttccgatgtcgaggacgcaagagagcagagagcacacaacgctcacttgcgtggcccaccccctaagctcatccctgtcagtggcaaattggagaaaaatatggagaagatacttatcaggccaaccgcattcaagcccgtgttgcccaagcccagaggcgctccttcgttgccaagtttcatgggccctcgagcaaccgggctgagcgggtctcaaggatcactcacccagctatttggaggtcctgctagttctagcagctcttctagctcctcttcagcggctgataagcccttggccttctcaggttgggcgtcaggttgtcctagtggtaccctgtccgatagcggctag

SEQ ID NO: 30699 - DNA, 585 bp, Artificial Sequence
  Description of Artificial Sequence: Synthetic coding sequence
atgagagagctggccgcagttgtgagccgtgacatttacctgcataatccgaacattaaatggaacgatattattggtctagacgctgctaagcagcttgtaaaagaagccgtggtgtaccccatcagatatcctcagcttttcactggtatcctgtccccttggaaaggcctgctgctgtacggcccacctggcaccggaaagactctgttagctaaggcggttgctaccgagtgcaaaaccactttctttaacatctctgcctcaaccatagtcagcaaatggaggggggactccgagaagctagttagagtgctctttgagttagccagataccatgccccatcgaccatctttttggatgagcttgaaagtgtcatgagtcagcgaggtaccgcctccggtggtgaacacgaaggaagcctacgcatgaagactgagcttcttgtgcagatggacggcctggctaggtcagaagacctggtattcgtgcttgctgcttctaacctcccctgtctgaaagctatagctctgcagcctggtgacagagccaggcttcgattgaagaagaagaagtgtacctag

SEQ ID NO: 30700 - DNA, 555 bp, Artificial Sequence
  Description of Artificial Sequence: Synthetic coding sequence
atgacctttcaatttaatttcacaattgaagatcacctggagaacgagttgactcctattcgcgacggcgcactgaccctggatagcagtaaagaactgtccgtttcggaaagtcaaaagggagaggagcgggatcgcaaatgcagcgcagagcaattcgacctaccccaggatcatctgtgggagcataaaagcatggaaaatgctgctcctagtcaagacacggacagtcctctgtcagccgcttcgagcagtagaaatctggaaccccacggcaaacaaccctcactgcgcgctgccaaggaacatgccatgccgaaagaccttaaaaagatgttggaaaacaaggttatagagacgcttcctgggttccagcatgtgaaacttagcgtagtgaagaccatactcctgaaggaaaatttcccaggggagaatattgtatctaagtccttctcatcacactctgacctgatcaccggggtttacgaggggggtctgaagatttgggaatgtacattcgatttgctcgcctactttaccaaagcaaaagtgtag

SEQ ID NO: 30701 - DNA, 354 bp, Artificial Sequence
  Description of Artificial Sequence: Synthetic coding sequence
atggtactgattctgggtagacgcttgaatcgcgaggaccttggtgtccgggattctcctgctacaaaaagaaaagtatttgagatggacccaaagagcctgacaggccacgagttctttgacttcagctcagggtctagccacgccgaaaacatcctgcagattttcaatgagtttcgggacagccggctattcacagacgtgatcatctgtgtggaagggaaggaattcccctgccatagagcagttctgtcggcttgcagcagttatttcagggctatgttctgtaacgaccatagagagagccgggaaatgctggtcgagatcaacggcattttggcagaggccatgtag

SEQ ID NO: 30702 - DNA, 498 bp, Artificial Sequence
  Description of Artificial Sequence: Synthetic coding sequence
atgatcttgaacgtattggaatatggaagccagcaggtcgccgacctgaccctcaatttggacgactatatcgacgccgagcacctgggagacttccatcggacgtataaaaactccgaggagttgcggagtcgcatcgttagcggcataattacccccatccatgaacagtgggagaaggcaaacgtctcaagccctcaccgcgaattcccccctgcgacagcacgggaggtggacccccttagaattccgccacaccatcctcatacgtcccgccagcccccttggcctcgcagggggggtatgattgtcgacccgctacggagtgggtttccacgcgcattaatagatccaagttcgggtttaccaaaccgtcttccacctggggcagtcccgcctggagctcggttcgaccccttcggaccaatcggaacctcgccccctggtccaaatccagatcacctaccccctcccggttacgatgacatgtacttatag

SEQ ID NO: 30703 - DNA, 369 bp, Artificial Sequence
  Description of Artificial Sequence: Synthetic coding sequence
gccctgaccttctcattgcgcgctggcgctgcttctgcccaagacggccgatgtccctgcggagccaggaggcctgattctcgacttctgcagttgcatataaccatgccattttcttctcccatggaagccgagctagtccgcaggatcctgagccgggatgctgcgccactgcctcgaccaggtgctgtgttaaaagacttcaccgtgtccggaaacctgctatttattaggctgacagcagccgatcaccgacagctccagctcagtatttcgagctgtctgcagcagcttagcctcctgatgtggattacgcaatgttttcttccggtttttcttgcacaggctcccagtggacagaggcgctag

SEQ ID NO: 30704 - DNA, 2415 bp, Artificial Sequence
  Description of Artificial Sequence: Synthetic coding sequence
atgaaaagtattggcgtgaagactgtaaaggtgtgtgggtccaagagcagcgtacgcattgaaggtcaaccctgcagtctaggccagtctaggagaaaagtcaaattgatgggagagcggagttatacactgtctattggtaacggcgactacttctgggcaaataaggaaatgctgtgggactacgtccagacgctgagcgaccagggggcagaaaagcatgaaggcactggtcagtcctcgggaattacggatcaggaaaaagagctgtccacaaatgccttccaggcctttacgagcgggaactacgatgcatgcctgcagcacctggcctgcttacaggatattaataaggatgattataaaataatccttaacactgcagtggcagagttttttaagagcaaccaaaccacaacagataacttgcggcagaccttgaaccagttaaaaaaccaagtgcattcagctgtggaagagatggacggactggacgacgtggagaactcaatgctctattataatcaggctgtaattctgtatcatttacgtcagtacactgaggcaatatctgttggagaaaagttgtaccagttcattgagccattcgaggaaaagtttgcccaggccgtgtgctttctactggtggatctgtatatcctgacgtaccaggccgaaaaagcccttcatcttttggccgtcctcgaaaaaatgatctcacaggggaacaataataaaaacgggaagaatgaaacaggcaacaacaacaataaggatggctctaaccacaaagcagagagtggtgccctaatcgaggccgctaagtccaagatccaccagtacaaggtccgggcatacatacagatgaagagtctgaaggcctgcaaaagggaaattaagagcgttatgaataccgccggaaattccgccccttcgctgtttctcaaatctaactttgaatacttacggggaaattatcgcaaagccgtgaagcttttgaattcttccaacatcgctgagcaccccggtttcatgaagacaggcgaatgtttgcgctgtatgttttggaacaatttgggctgcattcacttcgcaatgagtaagcacaatctggggatcttctacttcaagaaagcactacaggagaacgacaacgtctgcgctcagctctccgccggaagtacagatccgggaaagaaattcagcgggaggccaatgtgtactctgctgactaataagcgttacgagttgctgtataattgcggcattcaattgctccatatcgggaggccgctggcagctttcgagtgtctgattgaagcggtacaggtctatcacgcaaacccgcgactttggctcaggcttgctgaatgctgtatcgccgcaaacaaaggaacctcagaacaggaaacgaagggactgccctccaagaaagggattgtacagagtatcgtaggtcagggctatcatcgtaagattgttctggcttctcagagcatacagaacacagtgtacaatgacggccaaagttccgccatacctgtggcttcaatggagtttgccgcaatctgcttaagaaacgccctgctgttgttacccgaagagcagcaggaccccaagcaagaaaacggtgcgaagaacagtaaccaactgggcggtaacacagagtcatcagagagcagcgagacctgttcctcgaagagccatgacggggacaagtttattcctgctcctccctcttcacctctcagaaagcaggaactagagaacctcaagtgcagtatattggcctgctcagcctacgtcgcactcgccttaggtgacaatctcatggccctgaaccacgccgataaacttctccagcagcccaaactgagcggcagcctcaaattcctggggcacctatatgctgctgaggcactgatctctctggacagaatttctgacgctattacgcacctcaacccagagaacgtgaccgacgtttctctgggaatctcaagtaatgaacaggaccaagggtctgataaaggcgagaatgaggcaatggaaagtagcggtaagagggcaccccagtgctaccccagcagcgtaaacagcgctcggaccgtgatgctgttcaatctgggcagcgcctattgcctacgtagcgagtacgataaggcgaggaagtgcctgcatcaggctgctagtatgattcatcccaaggaggtgcctcccgaagcaattctcttggccgtgtacctggagctccagaatggcaacacgcagttagctcttcaaatcattaaaagaaatcaactgttgcctgccgtgaagacccacagtgaagtaagaaagaaacctgtgtttcagccagttcatccaatccagcctattcagatgcccgctttcactaccgtgcagaggaagtag

SEQ ID NO: 30705 - DNA, 1899 bp, Artificial Sequence
  Description of Artificial Sequence: Synthetic coding sequence
atggataccatgatgctgaatgtacggaacctcttcgagcagctggtccgcagggttgagatactgagcgaggggaacgaagtacagttcattcaactggcaaaggacttcgaggactttcgcaagaaatggcagcgaactgatcacgaattggggaagtacaaggatctactgatgaaggcggaaacagaacggtccgctctcgacgtgaaactgaagcacgcaaggaaccaggtggacgtggagatcaaaaggagacagagggcagaggccgattgtgagaagctggagagacagatccagcttatcagagaaatgctgatgtgcgatacatctggctctattcagctgtcagaagagcagaagagcgcactcgcgtttttaaatcgaggccagccatcaagttctaacgcagggaacaagaggttgagtaccatagatgaatccggcagcatactgtcggacatttcgtttgacaaaacagatgagagtctggactgggactcctcattggtgaaaaccttcaagctcaagaaacgtgaaaaacgtcggagtacctcccggcagttcgtggacggcccacccggtcctgtgaagaaaacccgaagtatcggcagcgctgtcgatcagggtaatgaatcaattgtcgcaaagacaactgtaaccgtccccaatgacgggggtcctatagaggccgtgtctacaatcgaaacggtaccatactggaccagatcccgacgaaagaccgggaccctgcagccatggaatagcgatagtacattaaactcccgtcaactcgagccaagaactgagacagactcagtgggcacacctcaatcaaatggaggcatgaggctccacgatttcgtaagcaaaacggtcatcaaaccggagtcatgtgtgccctgcggaaagcgaatcaagtttggcaaactgtcattaaaatgcagagactgccgggttgtcagccatcccgagtgccgggacaggtgccccctgccttgtatcccaaccctgattggaacaccagtcaaaataggcgagggcatgttagcagattttgtgagtcaaacatcacctatgatccctagcattgttgtccactgcgtgaatgaaatcgaacagaggggcctgacagaaaccgggctctatagaatttcaggctgtgatcggactgtaaaggagctcaaggaaaaatttctgcgcgtgaagaccgtgcccttgctaagcaaggtggatgacattcacgctatctgcagcctcctgaaagactttctcagaaatctgaaagagccattgctgacatttcggcttaaccgagcattcatggaagctgcagagataactgacgaggacaactctattgcagctatgtatcaggcagtaggagaactccctcaggctaatcgggatactctggcatttctaatgatccacctacagcgggttgcgcaatccccacacactaagatggacgtggcgaacttggcaaaggtgttcggacctaccatcgtcgcacacgccgtccccaatcctgatccagtgaccatgctgcaggacataaagaggcagcccaaggtggtggagagactgctgtctctgcctctggaatattggagtcagttcatgatggtggaacaagagaatatcgaccctcttcacgtcattgaaaacagtaacgcatttagtactccccagacaccagacataaaggtgagtctgctgggaccagtcacaaccccggagcaccagctgctcaaaacacccagcagctccagcctctcccaacgcgtaaggagcaccctgactaagaacacgcccagattcgggtctaagtctaaatccgccaccaatttaggacgccaggggaacttttttgccagcccaatgctaaaatag

SEQ ID NO: 30706 - DNA, 585 bp, Artificial Sequence
  Description of Artificial Sequence: Synthetic coding sequence
atggaggatcttttcgagacattccaggacgaaatggggtttagtaacatggaagatgacggcccagaagaagaggagagggtggctgaaccccaggctaattttaacacaccccaggctttgcgttttgaagagcttcttgcaaacctgctcaatgagcagcatcagatcgcaaaggaactcttcgaacagcttaagatgaagaagcccagcgcaaaacagcagaaggaggtggaaaaagtgaaacctcagtgcaaggaagtgcaccagacattgatcttggaccctgcacagaggaaacgattgcagcagcagatgcaacagcatgtccaactgctgactcagattcatctgttggccacgtgtaaccctaacctgaaccccgaggcatcctccactcgcatttgtcttaaagaactagggacattcgcacaatcatccattgccctgcaccaccaatataaccctaagttccagacactgttccaaccttgtaatcttatgggcgctatgcagctaatcgaagacttttcaacccatgtgagcatagattgtagcccgcataagactgtgaagaagacctag

SEQ ID NO: 30707 - DNA, 1803 bp, Artificial Sequence
  Description of Artificial Sequence: Synthetic coding sequence
atggttctgatcctcggcaggcggctgaatcgcgaagatttaggcgttcgggattcccccgcaaccaagaggaaagtgttcgagatggaccctaaatcactgactgggcatgaattttttgatttctcctctgggagcagtcatgccgaaaacatcctgcagattttcaacgagttccgggatagtaggctgttcactgatgtaatcatatgtgtggaggggaaggaatttccatgtcacagggctgtgctgagcgcgtgctccagctacttcagggccatgttttgtaatgaccatagggagtcacgcgagatgttagttgagataaacggaattttggccgaggccatggaatgtttccttcagtacgtttacactggcaaggtcaagataacaacagaaaatgtgcagtacctcttcgaaacgtcctcccttttccagatatcggttttgagggatgcatgtgccaagtttttggaagagcaactcgatccatgcaattgtttagggatccaacgctttgctgacacacattcacttaagacgctgtttacgaaatgtaagaattttgcactgcagacttttgaagacgtctcccagcacgaagagttccttgagctggacaaggacgagcttatagattacatctgctctgatgaactcgttattggtaaagaggagatggtgttcgaagccgtgatgaggtgggtgtatcgcgcagttgatctgcggaggcccctgctccacgagctgctgacgcacgtgcgcctgcctttgttgcaccccaattactttgtgcagaccgtggaggtggatcagctgatacaaaatagccctgaatgttaccagttattgcacgaggcaagaagatatcacatcttaggcaacgaaatgatgtctccacgcacaaggcctcggaggagtaccggctacagcgaggtgatagtggtcgtgggcggatgcgaacgcgtgggagggtttaacctgccgtacacagagtgttatgatcccgtcaccggggaatggaagagcctggctaagcttcctgaatttaccaaatcagaatacgccgtctgtgcgctgagaaatgatatactggtgagtggcggtcggatcaattcacgcgatgtgtggatatacaacagccagctcaacatttggattagagtggcatcccttaacaaaggtcgatggcgtcacaaaatggctgttctactgggcaaagtgtacgtggtgggagggtatgatggccaaaacaggttgtcgagcgtagagtgttatgattccttcagtaatcggtggaccgaagtggcacctcttaaggaagccgtttccagccccgcagtcacgagctgcgtagggaagctgttcgtcatcggcggtgggccagacgacaacacttgctcagataaagtgcagtcctatgaccctgagactaattcttggctgctgagggccgctatccccatcgcaaaaagatgtatcacagccgtcagcctaaataatctgatatacgtggccggtggcctcacaaaggcaatatactgctacgatcccgtcgaagactattggatgcacgtccagaacactttcagtcgccaagagaactgtggaatgtctgtgtgcaacgggaagatctacattctcggaggacggagagagaatggcgaggctacagatacaatattgtgttacgaccctgcaaccagcatcatcacaggtgtcgcagccatgcctcgtcccgtcagttaccatgggtgcgtgacaattcatcgttacaatgaaaagtgttttaagctctag

SEQ ID NO: 30708 - DNA, 1620 bp, Artificial Sequence
  Description of Artificial Sequence: Synthetic coding sequence
atggccacctccgccccactgcgctccctcgaggaggaagtgacctgttcaatctgcttggattaccttagggaccccgttacaatagattgcgggcacgttttttgccggagctgcaccactgatgtgcgcccaattagcgggagtagacccgtgtgcccactgtgtaagaagccctttaaaaaggagaacatccgacctgtttggcagctagcaagtctggtggagaatatcgaaaggttaaaagtggacaaaggacgccaacctggggaagtgacacgtgaacaacaagatgctaagctgtgcgaaagacacagggagaaactacactactattgcgaagatgatgggaaactgttgtgcgtgatgtgccgcgagtccagagaacatagaccacacacggctgtcttaatggagaaagccgctcagccgcatcgcgaaaagatcctcaaccatttaagcacccttcggagggaccgggataaaatccagggcttccaagccaagggcgaggcggatatcctcgcggcactaaagaagctccaggatcagcggcagtatatcgtagctgagttcgagcaagggcaccagttcctgcgagagcgggaggagcatttgctggaacagctcgccaagctggagcaggagctcacagagggtcgggagaagttcaaatcccgcggtgtgggagaactcgctcgcctggctttggtcatctctgaactggagggcaaggcccagcagcccgctgctgaacttatgcaggacactcgcgactttctcaatagataccccaggaagaaattctgggtgggaaaacctattgcacgagtcgtaaaaaagaagacgggagagttttccgataagcttctcagcctccagcggggattgcgagaatttcaggggaagttgctgagagatctggaatataaaactgtgtctgtcactctggatccgcagtcagcttcaggctacttgcagctgtccgaggactggaagtgcgttacttatacatcgctctataaaagtgcctacctgcacccacagcagttcgattgcgaacctggggtgctgggctccaagggatttacatgggggaaggtgtattgggaagttgaggtggagcgggaagggtggtccgaggatgaggaggagggtgatgaggaggaggaaggagaggaggaggaagaagaggaagaagcagggtatggtgacggttacgatgattgggagactgatgaagacgaagagtcactcggggacgaggaggaggaggaggaggaggaagaagaggaggtactggagtcctgcatggtgggtgtggcacgcgattcagtcaagcggaagggggatttgtcactgcgcccagaggatggcgtgtgggccttgcgactatctagttccggaatctgggccaacacctcccccgaggcagaactgttcccagcgctcaggcctagaagggtggggattgctcttgactatgagggcggtaccgttacgttcacgaatgccgaatcgcaggaattgatctacaccttcactgctacgtttactaggcgactcgtcccttttctgtggctcaaatggccaggcactaggctgctcctgaggccgtag

SEQ ID NO: 30709 - DNA, 567 bp, Artificial Sequence
  Description of Artificial Sequence: Synthetic coding sequence
taatatgtgaacgcggtcgactcccggtggagttcatatggcaacgaggcgacgtcatccgcacattacgtggagcgtgacaggttcatcgtcactgacttaagcggacatcgtaagcatagttccactggtgacctgctgtctttagaactacaacaggcgaagtctaattccctcctgctgcagagagaggctaacgccttggcgatgcagcaaaagtggaacagtctcgatgaagggaggcacctgacattgaacctgctgagtaaggagattgaactgcgcaacggcgaactccagagcgactatactgaggatgcgactgataccaaacctgatcgcgatattgagttagaattgagtgcactggacacagacgaacccgacggccagtctgaacccatcgaggaaatattggacattcagctgggtatctcctctcagaatgatcaattgcttaacgggatggctgtggagaatggccaccccgtgcagcaacatcaaaaggaaccccctaagcagaagaagcagagcctcggcaggtccaagaaacagttctgtaggtag

SEQ ID NO: 30710 - DNA, 1806 bp, Artificial Sequence
  Description of Artificial Sequence: Synthetic coding sequence
atggaagaaactatgaagttagccaccatggaagataccgttgaatattgtttgtttctcattccagacgaatcccgagactcagataagcacaaagagatactgcaaaaatacattgaacgaataataacgcggtttgctccaatgctcgttccctatatatggcagaaccagccgttcaacctgaagtacaagccaggaaaaggcggtgtgcccgcacatatgttcggagtgaccaaattcggggataatatcgaggatgagtggtttattgtgtacgtgattaaacagattactaaggaatttccagagctggtggccaggatcgaagacaatgacggcgaatttctgctgatcgaggccgctgattttcttcccaaatggctggatcccgagaactccaccaatagagtcttcttctgccatggcgaactgtgtattattcctgctcctagaaaatcgggggcagaaagttggctgcccactacgccaccaaccattcctcaggcattaaatatcattaccgcccattcagaaaaaatcctggcaagtgagtccatccgcgcagcagtaaataggcgtatcagaggctaccccgagaaaatccaggccagtctgcatcgcgcacactgcttcctgcctgcagggattgtagctgtgctgaagcagaggcccagacttgttgcagccgctgtgcaggcattttatctccgggatcctattgatctacgcgcttgtagggtgtttaaaacattccttcctgagactaggataatgacctcagcccatggatttgagattctgtgtagcaaatgttcccctcatttttcggactgcaagaagagcctggtcactgccagtcccctgtgggcttcttttctggaatccctcaaaaaaaatgattattttaagggcctgatcgaagggtctgcccagtacagggagcgcctggagatggcagagaactactttcaactctctgtggactggcctgagagctccctggctatgtcgccaggtgaggagatcctgacgctgttgcagacaattccttttgacatcgaagatctcaagaaagaagcggcaaatctgccgccagaggatgacgatcaatggttagatctgtcgcctgaccagctggaccagctgctgcaggaagctgtcggaaagaaggaaagcgagtcagttagcaaggaggagaaggagcagaattatgatctcacggaggtgtccgagagcatgaaagcgttcatttcgaaagtgtcgacacataaaggggctgaattgccgagagaaccttctgaggctcctataacatttgatgctgacagctttctgaattacttcgataagatccttggtccgcgacccaatgagagtgatagcgacgacctagatgatgaggattttgagtgtctcgattctgatgacgacctggacttcgagacccatgagcccggagaagaagcttccctcaagggtacccttgataacttgaagtcttacatggctcaaatggaccaggagctggctcacacatgtatctccaagtcatttacaacccgaaatcaagtcgagccagtatcacagacgactgataataattcagacgaggaggactctggaaccggcgaatcagtgatggcgcctgtggatgtggatttgaatctggtgtccaacattttggaatcatacagctcccaggcagggctggctggtcccgctagtaatttactgcagagcatgggagttcagttacccgataacactgaccaccgccctacttccaagcccacgaaaaattag

SEQ ID NO: 30711 - DNA, 405 bp, Artificial Sequence
  Description of Artificial Sequence: Synthetic coding sequence
atgaagaagaaacatgacgggatcgtttacgagacaaaggaggtccttaatccatcgccaaaagtgacccactgttgcaagagcctatggctgaagtacagcttccaaaaggcttacatgacccaactggtgagctctcaacccgtgccggctatgtcacggaaccccgaccataacttgttgagccagccaaaggaacacagcatcgtccagaagcaccaccaggaggagatcatccacaagctcgccatgcagcttcggcacattggcgataatatcgatcataggatggtgcgcgaagacctacaacaggacggcagggacgcgcttgatcattttgtcttttttttttttcgcagggtacaggttcttctacactttttctggaataatcacttactgtag

SEQ ID NO: 30712 - DNA, 1791 bp, Artificial Sequence
  Description of Artificial Sequence: Synthetic coding sequence
atggaagatgcgccacagagacttcgctggcaggcacacctggagttcacccataatcatgacgtcggagatcttacctgggacaagattgcggtgagcctgccccgaagcgaaaagcttagatctctggtgttggcgggaatacctcatggaatgaggccacagttgtggatgaggctttctggtgcactgcagaaaaaaaggaatagtgagctttcttatcgcgaaattgtcaagaatagctctaacgatgaaaccatcgcagcaaagcagattgagaaagacttactgaggaccatgccatcgaacgcctgctttgcgtctatgggctcaataggcgtgccccgactgagacgagttctccgcgctttagcttggctgtacccggagatcggctactgccagggtactggtatggtggcggcatgcctcctccttttcttagaagaagaggatgcattttggatgatgtccgccattatcgaggatctcttacccgcatcttatttcagcaccactcttcttggggtgcagaccgatcagagagtgctgcgtcacctcatcgtccaatacctaccacggctggacaaactgctccaggagcacgatatcgaattatccctcataacgctgcactggttcctgacagccttcgcatcagtggtagatattaagctgctgttgcgcatctgggacctgttcttctatgagggttcacgggtcctttttcaactgacattaggcatgttacacctaaaagaagaggagttgattcagtccgagaactctgctagcatctttaacacgctctcagacattccttcccagatggaagacgccgagttgctccttggcgtggctatgaggcttgctggctctctgaccgacgtggctgttgagacccaacggagaaaacacctagcctatctgatcgctgatcagggtcaactgttgggagccggtacgctaacaaatctcagccaggtcgtgcggagacgcactcaacgccgaaaaagcacaattaccgcacttctgttcggagaagacgatctggaggctctgaaggctaaaaacattaagcagacagagcttgtcgctgatctgcgggaggcgatcctccgcgtggctcgacattttcagtgtacagaccccaaaaattgctccgtggaactaactccagactactccatggagtcacatcagcgcgaccatgagaattacgtggcctgttcacggagccatagaaggagagccaaggcgttactggattttgaacgccatgacgatgatgaactagggtttcggaaaaacgatattatcactattgtgtctcagaaagacgagcattgctgggtgggtgagctgaacggattgcgaggttggtttccagccaagtttgtcgaggttctagacgagagatctaaggagtatagtatcgctggcgatgactcagtgaccgaaggcgtgaccgacctcgtgcgtggcacactgtgccccgctctgaaggccttattcgaacacggcctgaagaaaccgtctttactcggaggagcttgtcacccctggctatttatcgaggaggctgcaggaagggaagtagaacgtgacttcgcctccgtatactcgagactggtgctgtgcaagacgttcagattggacgaagacggcaaggtgctgacccctgaggagctgctttacagggccgttcagtccgtaaacgttactcatgatgccgtgcacgcacagatggatgtgaagctgcggtccctgatttgcgttggcttaaaatag

SEQ ID NO: 30713 - DNA, 399 bp, Artificial Sequence
  Description of Artificial Sequence: Synthetic coding sequence
atggaatccagggtggccgatgccggaacaggagagactgccagagccgctggcggaagcccagccgtggggtgcaccacaagaggcccagtagtgtccgccccattgggagctgcccgatggaaacttctacggcaagtgctgaagcagaaacatttagacgattgcctgagacacgttagtgtgagaagatttgaaagcttcaatctcttttcagtgacagaaggtaaagagcgcgagaccgaagaagaggtaggtgcctgggtccaatacaccagcatcttctgcccagagtactctatcagcctccgccacaattctggttcactgaatgttgaggacgtgcttacctcgttcgacaacaccggaaacgtatggtcgttttcccgcggaaaatag

SEQ ID NO: 30714 - DNA, 1620 bp, Artificial Sequence
  Description of Artificial Sequence: Synthetic coding sequence
atggccacaagcgcccctctcagaagtcttgaagaagaggtcacctgcagcatctgtctcgactacctgcgagatccggtcacaatcgattgtgggcacgtgttttgtagatcctgcacgacagatgtgcgtccaatttcagggagtaggcccgtatgccctctgtgtaagaagcccttcaaaaaggagaatattagacccgtgtggcagctggcctctctcgtggaaaatatcgagaggttaaaagttgacaagggtcggcagcccggtgaagtcacgagagagcagcaggacgcgaaactttgtgaaagacaccgcgagaagctccactattattgtgaggacgacgggaagctgctgtgtgttatgtgccgggaatctcgcgaacatagaccacataccgccgtcttaatggagaaggcagcccaaccccatagggaaaagatactgaatcacctgagtacactccggagagaccgggataagatccaggggttccaggccaaaggggaggccgatattctggctgccctgaaaaagctccaggaccaaagacagtacattgtagctgagttcgaacaaggccatcagtttttgagggagagagaagagcacctgctggagcaacttgccaagctcgaacaagaacttactgagggacgcgaaaaattcaagagtagaggagtgggggagttggctaggctggcacttgttatttctgaactggaaggcaaggcccagcagccagcagctgagctgatgcaagacaccagggacttccttaataggtacccacggaagaagttctgggtggggaagccaattgcacgagtggtcaagaaaaaaaccggagagttcagcgacaaactgctgagcctgcaacggggactaagagagtttcaaggcaagctgctcagggatttggagtacaagactgtttcagtgacactcgatccccagtccgcttctggctacctgcagctgagtgaggactggaagtgcgtgacctacacttccttatacaagtctgcctacttacatccacagcagttcgactgtgagcctggggtcttagggagtaaaggatttacgtggggaaaagtctactgggaggtggaggtcgaaagggagggatggagcgaagacgaagaagagggagatgaagaagaggagggtgaggaagaggaggaggaagaagaagccggttacggcgatggatatgacgattgggaaaccgatgaggatgaggaatcactgggcgatgaggaggaagaggaagaggaggaagaagaggaggtgctggagtcttgtatggtcggagtagccagagattcagtgaaaaggaagggtgacttgagcctgaggcctgaagatggcgtgtgggcgttacgactgagctcaagtgggatttgggctaataccagtcccgaagcagagctctttcctgctcttaggccgagaagagtcggcatcgcgttggattacgagggcggtaccgtgacattcactaatgctgagagtcaggaattgatctacacgttcaccgcaacatttacaaggcgcctggtgcccttcttatggctcaagtggccaggtacacgcctgctgctgcgcccttag

SEQ ID NO: 30715 - DNA, 2193 bp, Artificial Sequence
  Description of Artificial Sequence: Synthetic coding sequence
atgaataactcatcgtctgagactcgcggacacccccattctgcttctagtcctagcgaaagagtgttccccatgcctctcccacggaaagcaccattgaatattccaggaacccctgtgttggaggactttccccagaatgatgacgaaaaagaaagactgcagaggaggcgctcccgtgtcttcgatttgcagttcagcactgattctcctagattacttgcatccccctcctcccgctccattgacatctcagccacaattccgaaatttacaaatacacagatcactgagcattatagcacatgcatcaagctcagtactgagaataaaattactaccaagaacgccttcggcttacacctcatagatttcatgtcagaaatcctaaagcagaaggatactgagcctacaaatttcaaggtcgcggcagggacactggatgccagtacgaagatctatgccgttcgcgtggatgctgttcacgctgacgtctacagagtgctgggcggactggggaaggacgctccatccctcgaggaagtggagggacacgtggccgatggcagtgcaactgaaatggggacaactaaaaaggctgtcaagccgaaaaaaaagcacctgcaccggaccatcgaacagaatattaacaatttgaatgtttcagaggccgacaggaaatgcgaaatcgaccccatgttccagaagacagcggcttcctttgacgagtgtagcacagcaggagtcttcctcagcacacttcactgtcaggactaccgatcggaactactgttcccttccgatgtccagacgctgtctacgggcgagcctctcgaacttcctgagctggggtgcgtagaaatgaccgatctgaaggccccactgcagcagtgtgccgaggataggcaaatctgcccaagtctggccggtttccaattcacccagtgggacagtgaaacccacaacgagtctgtgagcgcgttggtagataagttcaagaagaatgatcaggtgttcgatatcaacgctgaggtagatgaaagcgattgcggtgattttccagacgggagcctgggagatgactttgacgcaaatgacgagccggaccacaccgcagtgggcgatcatgaagaatttcgttcctggaaggaaccctgccaggtgcagagttgccaagaagagatgatctcactgggcgatggtgatatccggacaatgtgcccactgctgagtatgaaacccggagaatattcctacttctcccccaggaccatgtcaatgtgggcgggtcccgaccattggcgcttcagaccgaggcggaaacaggatgcgcctagccaatccgagaataaaaagaaaagtactaagaaggactttgagatcgacttcgaagacgacatcgactttgatgtctatttcagaaagactaaggcggcaactatcttgacgaaatccacgttggaaaatcagaattggcgagcgaccactctccctactgactttaattacaatgtggacaccctcgtgcagcttcacttgaagcctggtacccgtttattaaagatggcccaggggcacagagtggaaactgagcattacgaagaaatcgaggattatgactacaacaaccctaacgatacctctaacttttgtccaggcttgcaggccgctgatagcgatgacgaggacctcgacgatctgttcgttggccctgtggggaactctgacctgagcccatatccttgccacccacccaaaacggctcagcagaatggagataccccagaagcccaggggttagatatcacaacgtacggcgagtcaaacctcgtagccgagcctcagaaggtcaacaaaattgagatccattacgctaaaactgctaagaaaatggacatgaaaaagctgaagcagtccatgtggtccctgcttactgcactctctgggaaggaagccgatgctgaggcgaaccacagggaagccggtaaagaagcggctctcgccgaagttgctgatgagaagatgctttcaggcctgacaaaggaccttcagcgttcactgccaccggtcatggcccagaacctcagcatccctttagcattcgcctgccttctgcatcttgccaacgagaaaaatctcaagctggagggaacagaggatctgtccgatgtgctcgtgcgccagggagactag

SEQ ID NO: 30716 - DNA, 900 bp, Artificial Sequence
  Description of Artificial Sequence: Synthetic coding sequence
atggagacccagttccccgtgagtgagggaaaagttgatccttacaggtcctgcggattctcatatgagcaagatcccacccttcgcgaccctgaggccgtagcaagaaggtggccttggatggtgtctgtgagggcaaatggcactcatatctgcgccggaaccatcatcgccagccaatgggtgttaactgtggctcactgtctgatttggcgggacgtgatctactcggttcgcgtggggtccccttggatagaccagatgactcaaacagcttcagacgtcccggtgctacaagttattatgcactcaaggtatcgtgcacagcgcttctggtcttgggtggggcaggcaaatgacataggattactcaaacttaagcaggagcttaagtacagcaactatgtcagacctatttgtctgcccggaactgattacgtgttgaaagaccatagccgctgcacggttacgggatgggggctgagtaaagccgacgggatgtggccacagtttcgcacaatacaggagaaagaagtgatcattctgaacaataaggagtgtgacaatttttaccacaactttacaaagatcccaaccctggtccaaataattaagtcccagatgatgtgtgccgaggatactcacagagagaagttctgttatgagctgaccggggagcccttagtgtgtagtatggaaggcacttggtatcttgtggggctggtcagctggggcgcaggatgtcaaaagagtgaagctccacctatatatctgcaggtgtcaagctatcagcactggatttgggactgcttaaacggccaggccctcgcgctcccagcgccttccagaaccctgctgctggccttacctctgccactctcacttctggctgctctctag

SEQ ID NO: 30717 - DNA, 1089 bp, Artificial Sequence
  Description of Artificial Sequence: Synthetic coding sequence
atgttggtccctggatctacgaggccctatagcaaaaaaagacaaaactcaaagagtgcccaaggattggcgggactgcgtaatcttggaaacacatgctttatgaactcaatcctccagtgcctaagtaataccagagaactcagagactactgcctgcagcgcctttacatgagagatttacaccacggatccaatgcacataccgctctggtagaagagtttgcaaaattgattcagactatatggacaagtagccccaacgatgtcgtttctccttcggagtttaagacgcagatccagcgctacgccccacgattcgtgggctacaatcaacaagacgcccaggaattcctgagattcctattagatgggttgcataacgaagtgaatcgcgtgactctcagacccaaatcaaaccctgaaaaccttgaccatctaccagatgatgaaaaggggaggcagatgtggaggaagtatctggagagagaggattccaggattggagacctgttcgtgggtcagttaaaatcatccctgacttgcacagactgtgggtactgcagcacggtgttcgatccattctgggacctgtctctgcctattgctaagaggggttatccagaagtgacgttaatggactgtatgaggttatttactaaagaagacgtgctcgatggggatgagaagcctacttgctgccggtgtagggggagaaagcgctgcattaagaaatttagtatacagagattccctaaaatcctcgtacttcacctgaaaagattttctgaatctcgtattcggacttcaaagctcacaacttttgtaaactttccattaagggatttagacttgagggaattcgccagcgaaaacaccaaccacgcagtgtataatttatacgccgtgagcaatcactccggcactacgatgggaggccattatacagcatattgccgaagtccaggtaccggtgaatggcataccttcaacgactctagcgtcaccccaatgtcttcctcacaggtgcgtacctctgatgcctatctcctgttttacgagctggcctcacccccttctaggatgtag

SEQ ID NO: 30718 - DNA, 1800 bp, Artificial Sequence
  Description of Artificial Sequence: Synthetic coding sequence
atggaccccggtgacgcagccatactggagtcgagcctgaggatcctttaccggttgttcgagagtgtgctgccaccccttcctgcggctctccagtcaagaatgaatgtgatcgatcatgttcgggacatggccgctgctggcctgcactctaatgtacgcctcctctctagtcttttgttaacaatgagcaacaataatcctgaactattctctcctcctcagaagtaccagctcctcgtgtatcatgcagatagcctatttcatgataaagaatatagaaatgccgtcagtaaatatacgatggccctgcagcaaaagaaagctctgtccaagacctctaaagtgcgcccatctaccgggaatagtgcaagtaccccccagtctcaatgcctcccttctgagattgaggtcaagtacaagatggccgaatgttacactatgctgaaacaggacaaggatgctattgcaatactggacggtataccctcccgccagcggacccctaaaatcaatatgatgctcgcaaatctgtacaagaaggccggtcaggagagaccttcagtcactagttataaggaggtgctccgccaatgtccactcgccttggacgcaatattgggactgctgagcctgagcgtgaaaggagccgaagtggcatccatgacgatgaatgtgatccagacagtgcccaatttggactggcttagtgtctggataaaggcttacgcctttgttcataccggcgataacagccgagctatctccaccatttgcagtctcgagaagaagtctctcttgcgcgacaacgtggacttgttaggcagtctggcagatctatacttccgagctggggacaacaagaactcagtgctcaaatttgaacaagcccagatgctggatccatacctgatcaaggggatggacgtttatggctatctgctcgctcgagaaggacgtttggaagatgtggaaaatctcgggtgcaggctgttcaacatcagcgatcagcacgccgagccatgggtcgtgagtgggtgtcactccttctacagcaagaggtacagccgggctctataccttggggcaaaggccatacagttgaacagtaatagcgtccaggccttactcctgaagggagcggcactgagaaacatgggaagagtacaagaggctatcattcactttagggaggcaatcaggttggctccatgcaggttagactgctatgagggactcattgaatgctatctagcatccaactccattagagaagcaatggtgatggcaaacaacgtgtacaagacactcggagcaaacgcgcagaccctgacattactcgctactgtttgcctcgaggaccccgtgacccaggagaaagctaaaactttgttggacaaggccttgacacagagaccggactacatcaaagccgtggttaaaaaagccgaattgttatcacgggagcagaagtacgaggatggaatcgctttactacggaacgcactggcaaatcagtccgactgcgtgttacacaggatactgggggatttcttggtagctgtgaacgaataccaagaggccatggatcagtactctattgctctgtcactggatccaaacgaccagaagtccctggagggaatgcaaaaaatggagaaggaggagtcacccacagatgccactcaggaagaggatgttgacgacatggagggaagcggcgaggaaggggatctggagggctctgactccgaagcagcacagtgggccgaccaggagcagtggttcggaatgcagtag

SEQ ID NO: 30719 - DNA, 507 bp, Artificial Sequence
  Description of Artificial Sequence: Synthetic coding sequence
atgcctgccacccggaagccaatgagatacgggcacacggagggccacacagaagtgtgtttcgacgattccggctcgttcatcgtgacgtgcgggagcgacggagacgttagaatttgggaggacttggacgatgacgatccaaaatttattaatgtgggagagaaggcatattcatgtgccctgaaatctggcaagctcgtcacagccgtatctaacaacacaattcaggtgcatacattccctgagggagttccggatgggatcctcacacggttcacgaccaacgcaaatcacgtggtatttaatggtgatggcaccaaaatcgcggcaggctctagtgactttctggtgaaaatcgtggatgtgatggactcaagtcagcaaaaaacattccgaggtcacgatgctcccgttttgagcctgtcttttgatcctaaagacatcttcctggcctctgcctcttgcgatgggtccgttagggtctggcagattagtgatcagtag

SEQ ID NO: 30720 - DNA, 141 bp, Artificial Sequence
  Description of Artificial Sequence: Synthetic coding sequence
atggtgaactcttgttgtggatccgtttgctcagatcagggctgcggactcgaaaattgctgtcgaccgtcctgttgccagaccacttgctgtcggaccacatgttgccggccattgtgttgtgcatcgtcatgttgctag

SEQ ID NO: 30721 - DNA, 669 bp, Artificial Sequence
  Description of Artificial Sequence: Synthetic coding sequence
atggccagcgtagttgaatataaaggtctgcgggctgggtaccactgcgggtattgcgattcaaaggaaggcaaggctagttgtggaatgtgggcccatagcatgactgttcaggactaccaggatctcatcgaccgaggctggcgtagaagcggtaagtatgtttataaaccagtgatgaaccagacatgttgtccgcagtataccattaggtgcagaccactccagtttcagccatccaagtctcacaaaaaggtcctgaagaagatgctgaagttccttgcgaaaggagaggtcccgaagggttcgtgcgaagacgaacccatggatagtacaatggatgatgctgtggccggtgatttcgcactcatcaataaactggatattcagtgcgatttgaaaacactgtccgatgacattaaagagagtcttgagtcggagggtaagaactcaaagaaggaggaaccacaggagctgctccagagtcaggatttcgttggagagaagctcggcagcggtgagccctcacatagtgtgaaggtacacacagtgcccaagcctggaaaaggagccgacctttcaaagcccccatgcaggaaggcgaaagagattagaaaagagcgcaagcgccttaaactgatgcagcaaaacccggctggagagctttag

SEQ ID NO: 30722 - DNA, 495 bp, Artificial Sequence
  Description of Artificial Sequence: Synthetic coding sequence
atgcttaaggccgtgatcctgattggcggtcctcagaaaggcactagatttagaccactctccttcgaagttcctaaacccctgttcccagtggccggagtcccaatgattcagcatcacatagaggcctgtgcccaggtcccaggaatgcaagaaatattactgattggtttctaccagcccgacgaacccctcacccagtttctcgaagccgcacagcaggagttcaatctacctgtgcgctaccttcaggagtttgcgccactggggaccggtggaggactgtaccactttcgggaccaaatcctcgccggatctccagaagcattttttgtgctcaatgccgatgtgtgtagcgacttccctctgagtgcaatgctggaggcgcacagacgacaaagacatccttttctgctgctgggaacaactgctaacagaactcagtctctaaattacgggtgcatcgtcgagaatccacagacacatgaagtgtag

SEQ ID NO: 30723 - DNA, 339 bp, Artificial Sequence
  Description of Artificial Sequence: Synthetic coding sequence
atgttcgtgagtgatttccgtaaggagttctatgaagtggtgcagtcacaaagggtcctactgttcgtcgcatcggatgtggacgccctctgtgcctgcaagattctccaagccctcttccagtgtgatcacgtccagtataccctggtgccagtatcgggctggcaggagctggaaactgcctttcttgagcacaaagagcagttccactacttcatccttattaactgcggcgctaatgtcgacctcctcgacatccttcagccggacgaagatacaattttcttcgtttgtgatacccaccgtcctgttaatgtagtgaatgtgtacaacgattag

SEQ ID NO: 30724 - DNA, 942 bp, Artificial Sequence
  Description of Artificial Sequence: Synthetic coding sequence
accttggttgtgtcaggtagagacgaccctcccacacactctcaacccgactcagatgacgaggctgaggagatccagtggagcgatgacgaaaataccgccacactcaccgcaccagagttcccggagttcgccacaaaagtgcaagaggctatcaactcactcgggggaagcgtgtttcctaagctgaattggagtgctccgcgagatgcctactggattgccatgaattcttctctcaagtgtaaaaccctatccgatatattcttattattcaagtctagcgacttcatcacacgtgatttcactcagccttttatacactgcactgacgatagtccagatccctgtatcgagtacgagctggtgctgaggaagtggtgtgagttgattccgggagcagaattccgctgtttcgtgaaagaaaataagcttattggcatcagtcagcgagattacacccaatattacgaccacatttctaaacagaaagaggagatcaggagatgtatccaggatttctttaagaagcacatccagtacaaattcctggatgaggacttcgtattcgatatttatagggattccagggactcaccagctttccgatgtacaaactccgaagtgactgtgcagcccagcccctacctgtcgtatcggctgccaaaggacttcgtggacttgtctacaggggaggatgcacacaaactgatcgataagtccgccggtgggagactcatgtccgtgttagaactggagaagaggcggcctcgccctaccgcccctggagcagcccatcagccccagcttcccgctgacccggatgcaggcggtcccagctccgtggatatttcccacttcctctatagctgcacttttacctggggtaagaagaggagggactttgccacgtgcaaaaataacatcatcaacaggtcttag

SEQ ID NO: 30725 - DNA, 1017 bp, Artificial Sequence
  Description of Artificial Sequence: Synthetic coding sequence
atggagctgtggggaaggatgctatgggcactactcagcggaccaggtaggaggggcagtacacgcggttgggccttctcaagctggcagccacaaccacccctggcaggcctcagctccgcaattgagctggttagtcattggacaggtgtattcgaaaaacggggaattccagaagcaagggaatccagcgagtatattgtagcccacgtcctgggtgccaaaaccttccagagcctgagacctgctctctggacccagcccctgacatcccagcagttgcagtgtatccgggagttgtccagccggaggttacagaggatgccggtgcagtacatactgggcgagtgggacttccagggactgtccctgagaatggtcccaccagtgttcattcctagaccggagactgaggagttagtagaatgggtcctggaagaggtggcccagcggagccacgctgttggttcccccggatctcctctcattctcgaggtgggctgtggctcaggtgccattagcttgagcctgctgagccagctgccccaatctcgggtgattgcagtggacaagagagaagctgcaatctctctcacccacgaaaatgcccagcggctacggctccaggaccgaatttggatcatccacttagatatgacctccgaacggtcctggacacacctgccatggggccctatggacttaatcgtttctaacccaccttacgtcttccatcaggacatggaacaactggcacctgagatacgatcttatgaggatccagccgctctagatggaggagaggagggcatggatattatcacacatattttggctctggcgcctcggctcctgaaggatagtggctcaatcttcctggaggtagaccctagacaccctgaactcgtgtcgagctggctgcaatctagacctgacctatatctgaacttggttgccgtgcgcagagatttctgcgggagaccccgatttctgcatataaggagatcaggaccatag

SEQ ID NO: 30726 - DNA, 1119 bp, Artificial Sequence
  Description of Artificial Sequence: Synthetic coding sequence
atgaaaaggcgtactgacccagagtgtacagcccctatcaaaaagcagaagaagcgggttgccgagctggcgctgtccctgtcttcgacctcggacgatgagcctccttcttccgtctctcatggagcgaaggctagcacaacctccctgtctggtagcgatagcgaaacagagggcaagcagcattcgtcagactcattcgacgacgcctttaaggcggatagtctggttgaagggacaagttccagatactcgatgtacaacagcgtgagtcaaaaattaatggctaagatggggttccgtgaaggagaaggcctggggaagtactctcaaggtcggaaggacattgtagaagccagctcccaaaaagggaggcggggactaggactgacgctacgcggatttgatcaggagctcaatgtagactggcgcgatgagcccgaaccaagtgcttgcgagcaagtgagttggttccccgaatgtactaccgaaatcccagacacccaggaaatgtccgactggatggtcgtcggcaaaagaaagatgatcatcgaagacgagaccgaattctgtggtgaggagctcctgcatagcgtgctccagtgcaagaagccccttgtcaaggatagagaggctgaactactgtacttcgccgatgtctgcgcagggccaggtggcttcagcgagtatgtcttatggcgtaagaagtggcatgctaaaggcttcgggatgactttaaaggggccaaacgacttcaagttagaagacttttattccgcttcttcagagttattcgaaccatattacggggagggagggattgacggggacggagatatcacccgtccagaaaatatatcggccttccgcaacttcgtcctagataacacagatcgtaagggcgtccattttctcatggctgacgggggattttctgtggagggacaagagaatctgcaggagatcctcagtaagcagctgttactgtgtcagtttctaatggctctgtcgatcgtgaggaccggtgggcactttatttgcaaaacctttgacctgttcacacccttctcagttggactggtttacctcctgtattgctgctttgagcgagtctgctag

SEQ ID NO: 30727 - DNA, 408 bp, Artificial Sequence
  Description of Artificial Sequence: Synthetic coding sequence
taacagttagcatcgatggtgtggaacaatccttctcagcagcagtttatgcagttcggcggatccagtggctcccaactgccgcaaattcagactgacgtggtattaccttcttgcaaaaagaaggctccagctgagactcccgtgaaagagcggttgtttatcgtctttaaccctcaccctcttccactggacgtgctggaagatattttctgcagatttggcaacctcatcgaggtttatcttgtttctggaaaaaacgtcggatacgcaaagtacgcggaccgcatttcggccaacgacgccatcgcaacattgcacggaaaaatattaaacggagtgagattaaaagtgatgctcgcggattcgcctcgggaggaaagtaataagagacagagaacatattag

SEQ ID NO: 30728 - DNA, 1764 bp, Artificial Sequence
  Description of Artificial Sequence: Synthetic coding sequence
atggcctcggaagacatcgctaagctggcagagaccctggccaaaacacaggtggccggaggacaattaagctttaagggtaaaagtctcaaattgaacactgccgaagacgctaaggatgtcattaaagaaatcgaggatttcgatagcctcgaagccctgagactggaggggaataccgtgggggtagaggccgctcgagtgatagccaaagctcttgagaaaaagagcgagctgaagcgttgccattggtcggatatgttcacagggcgactgcgtacagagatccctccagctctgatctccttaggcgaaggtctgatcaccgccggtgctcagttggtggagctcgacttgtcagataacgccttcgggcctgatggagtacagggctttgaggccctactgaagtcttctgcctgcttcacactgcaagaattaaaactgaacaattgcggcatggggattggcggtggaaagatcctggcagcagcgctcacggagtgccacagaaaatcatcagcacaaggcaaacccttagctctaaaggttttcgtcgccggtcgtaacagattggagaacgatggtgctacagccctggctgaagcatttcgcgtgatcggaaccctagaagaagtacacatgccccagaatggtatcaatcatcctgggattaccgccctcgcacaagccttcgccgtgaaccccttacttcgcgtgatcaatctcaacgataacacattcaccgaaaagggagctgtagctatggccgagactctgaagaccctgcggcaggttgaagtaattaactttggagattgcctggtcagatccaaaggagcagtagccattgctgacgccatccgcggtggacttccaaagcttaaagagttgaatctctccttctgcgagattaaaagggatgcagcgctcgccgtggcggaggcaatggctgacaaggcagagctggagaaactagacctgaatggaaacactttaggtgaggaaggctgcgaacaactgcaggaggtgctcgaggggttcaatatggctaaggtgctggcaagtttaagcgatgacgaggacgaagaagaagaggaggagggggaagaagaggaggaagaggccgaggaggaagaggaggaagacgaagaggaggaagaggaggaggaggaggaggaagaagaggagccacaacagcgaggacaaggtgaaaaaagcgccactccgtcaaggaaaatactcgaccctaatactggggaacccgctcccgtcctatccagtcctccacccgcagatgtctcaacctttttagccttcccttcacctgagaaacttctgcggttgggcccaaaatccagtgtcttaattgcccagcagacggacacaagtgatcccgagaaagtagtgtcagcctttttaaaagtcagcagtgtgttcaaagacgaggcgaccgttagaatggcagtccaggatgccgttgacgccctgatgcagaaggcctttaacagttcttcttttaattcgaatactttcttgaccaggctgttggtgcacatgggccttctgaaatctgaggacaaggttaaggcaatcgccaacttatatgggccattaatggccctgaaccacatggtccagcaggactactttcctaaagccttggcaccacttctcctggcattcgtcactaaacccaactcggcactggagagctgctccttcgccaggcacagcctgctgcagaccctgtacaaagtttag

SEQ ID NO: 30729 - DNA, 1842 bp, Artificial Sequence
  Description of Artificial Sequence: Synthetic coding sequence
atggcgaccatcccagactggaaattgcaactcctggcgcgaagacgccaagaggaggcctctgtgagaggcagagagaaggctgaaagagagcgcctcagccagatgcccgcttggaagcgaggactcctcgagcgaaggagagcgaagctcggcctgtctcctggagagccctcacctgtcttgggaacagttgaagcaggcccaccagatccagacgagagcgccgtgctactcgaagctatcggacctgtccatcagaaccgtttcattcggcaggagaggcagcagcagcagcaacagcagcagcgctcagaagaacttctcgctgaaagaaagccagggcctctggaggcgcgagaaagaaggccatccccgggagagatgcgcgatcaatcaccgaagggcagagagtcacgggaggaacgtctgtcccctcgagaaactcgagagagaaggttgggcattggcggtgctcaagaactgtcactacgccctctagaagccagggattggcggcagagtcctggcgaagtcggcgacaggtcctcaagactgtcagaggcctggaaatggaggctctctcccggtgaaacccccgaacggtcactgaggctggctgagagcagggaacagtccccccgacggaaagaagttgaatcaagactgtccccaggagaaagcgcctaccaaaaactcggcctaacggaggcacataagtggcgtcctgactcccgcgaaagtcaggaacaaagcctcgttcagctggaggcgacagagtggagactgcgatctggcgaagaaagacaggactacagtgaggaatgtggacgaaaagaggaatggcccgtaccaggtgtggcaccgaaagagaccgccgaactttccgagaccctgaccagggaggcccaggggaattcatccgcaggagtggaagctgcggaacaaagacccgtagaggatggtgaacggggaatgaagcctactgaggggtggaaatggaccctcaattcaggaaaggctcgagagtggactccccgtgacatcgaagctcagacgcagaaaccggagcctccggaaagcgccgagaaactgctcgaaagtcccggagtggaagccggtgagggcgaggccgagaaggaagaggctggagcccagggaagaccattgagagccttgcagaactgttgtagcgtaccatccccgctgccgcctgaagacgccggtacaggcggtctgagacaacaggaggaagaagctgtggaactacagcctcctccccctgctcccctgagccccccaccacctgcccctacagcccctcagccccctggcgacccacttatgtcgcgtctattctacggtgtgaaggcgggaccaggggtgggtgcaccgagacgatctggccatacgttcactgtgaatcctcgaaggtccgttccgccagccacgccagcaacaccaacgtcccctgccactgtcgacgctgccgttccaggcgctggtaagaaacgatatccaacagccgaggagatcctggtcctgggaggttacctaaggctttctagaagctgcctcgcgaaagggagccctgagaggcatcacaaacagcttaagatttctttttccgaaacagcgctggaaacaacgtaccagtatccgtccgagtcaagcgtgctggaggaattagggccagaaccagaggtaccttctgccccaaacccgcctgccgcacagcccgatgatgaggaggatgaagaagagctgctcttgcttcagcctgagctacaggggggactgcgtactaaagccctgattgttgacgagtcgtgccgtcggtag

SEQ ID NO: 30730 - DNA, 477 bp, Artificial Sequence
  Description of Artificial Sequence: Synthetic coding sequence
atgacacactgttgcagtccctgttgtcagcccacttgctgcaggactacctgctgcagaaccacctgttggaagcccacaaccgtgaccacctgtagcagtacaccatgttgtcagcccgcatgttgcgtcagcagctgttgtcagccatgctgccgaccaacttgctgccagaatacatgttgccgaacaacatgttgccagcctacatgccccacctgttgcggtagctcttgctgtggacagacttcatgcggatccagctgcggacagtcttccagttgcgctcctgtatattgtcgaaggacatgctattaccctactactgtgtgtctgcccggttgtctaaaccaatcgtgtggctcaaactgttgccagccctgttgccgacctgcttgttgcgaaaccacttgctgtcggacaacatgtttccagcccacttgtgtgtcatcatgctgccagccctcttgctgctag

SEQ ID NO: 30731 - DNA, 1620 bp, Artificial Sequence
  Description of Artificial Sequence: Synthetic coding sequence
atggccaccagcgcacctttaagatctttggaggaagaagtaacctgctccatttgtctcgactacctgcgggaccctgttactattgactgtgggcacgttttctgcagatcatgcactaccgatgtgaggccaattagtggctctagacccgtgtgtccactttgcaaaaaaccctttaaaaaagagaatattaggcctgtctggcagcttgcaagtttggtagaaaatatagaaaggctgaaggtggataaaggtcggcagccgggtgaggtgacgcgcgagcagcaggacgcaaagctgtgtgagcggcatcgcgaaaaactccattattattgtgaagacgacgggaagctactttgtgtgatgtgccgagagagcagagaacaccggcctcacaccgctgtcctgatggagaaagcggcacagcctcaccgcgagaagatcttgaatcacctgtcgactttaagacgggacagggataaaattcaaggattccaggctaaaggtgaagctgatatcctcgccgctcttaagaagctacaggatcagaggcagtatattgttgcagagtttgaacagggccaccagttcctaagagagcgtgaggagcacctcctggaacagttggcaaagctggaacaggagctcacagaaggccgagaaaagttcaagagccgcggagttggtgagctggccaggctggcgctcgttatttctgagctcgagggcaaagcccagcagcccgctgctgagctgatgcaagatacccgcgatttcctcaatcggtatcccaggaagaagttctgggttggcaagccgatcgcgagggtagtcaagaaaaagacaggggagttttcggataagctcctctctttacaacggggtctgcgggagtttcagggtaagctactgcgtgacctcgagtacaaaacggtcagcgtaactctggatcctcagtccgcaagtggatacttacagctgtccgaagattggaaatgcgtgacatacacgagcctatataagagtgcttatcttcatccacaacaatttgactgcgagcctggcgtcttaggctctaaaggcttcacctggggaaaggtctattgggaggtcgaagtagagagagaggggtggagcgaggacgaggaggagggagacgaggaggaggagggagaggaagaagaagaggaggaggaggccggttacggcgacggatacgacgactgggagacagatgaagatgaagagtctctgggagacgaggaggaagaggaggaagaagaggaggaagaggtgcttgaaagctgtatggtgggcgtggccagagattctgtcaagaggaaaggagatctgagcttaagacctgaagatggagtgtgggccctgaggctctcatcaagcgggatctgggccaataccagcccggaggctgagctgttccccgcattgaggcctaggagggtggggattgccttggactacgagggcggaactgtaacgttcactaacgccgaaagtcaagaactgatttacacatttaccgccacattcacaagacggttggtcccattcttgtggctcaagtggccgggtacgcggctgttgttgagaccttag

SEQ ID NO: 30732 - DNA, 2511 bp, Artificial Sequence
  Description of Artificial Sequence: Synthetic coding sequence
atggccgctgctctggggccaccagaggtgattgcccagctggagaacgccgcaaaggtgctcatgcaaaccctcgcctgctcaattctgactgccctgctgagcgaattctcttcatcatccaagacctccaatatagggctcagtatggagttccacggcaactgtaaacgagtgttccaggaggaagatttaaggcaaatttttatgctcaccgtggaggtactgcaggaatttagtcgaagagaaaacctcaatgcgcaaatgtcatctgtatttcagcggtacttggccctggccaaccaagtcctgagctggaacttcttacctcctaagttagggaggcattatatagccatgttcgaatccagccagaatgtccttttaaaacctaccgagagctggcgagagacactgttagattcgagggtgatggagcttttctttacggtccaccggaagattagggaagattccgacatggcccaagattccctgcaatgcctcgcacagctggcgtctttacatggaccgatcttcccagacgaggggtcccaagttgactacttggcacatttcatcgagggactgttaaataccatcaacggcatagaaattgaggattcagaggccgtcggcatcagctcgatcattagtaacttaatcacagtgttcccccgaaatgtcttgactgctataccttccgagctgtttagctcctttgttaattgcttgacccatctcacctgttcattcgggaggtctgccgctctggaggaagttttggataaagacgatatggtgtacatggaggcgtacgataagctgctggagtcctggttgaccctggtgcaggatgataaacactttcataaggggttttttactcagcacgcagtgcaggtgtttaatagctatatccagtgtcacttagctgcgcctgatggcaccaggaacctgaccgcaaatggagtcgcctctcgagaggaagaggaaatcagcgagctgcaggaggacgaccgagatcagttttccgaccagctggcttcagtggggatgctagggaggatcgctgctgagcactgtatccctctgctgacgtcattgcttgaggaacgtgtcacacggctgcacggccagctccaaagacatcagcagcaattgctagccagtcccggaagttcaacagtggataataaaatgcttgacgatctctacgaagatatccattggctcattctggtgacgggctacttgctcgcagacgatacacagggcgaaacacctcttatcccaccagagatcatggagtactcaatcaagcactctagtgaggtggacattaatactacactgcaaatccttggttctccaggcgagaaggcttctagcatacccggttacaaccgcaccgacagcgtgattaggctgctgtcggctatcctgcgggtgtctgaagtggaaagccgagctattcgcgctgatctgactcatctgctaagtccacagatgggaaaggatattgtgtggttccttaaaagatgggccaagacttatctgcttgtagatgaaaagctgtacgaccagatcagcctgccattttcgacagccttcggagctgacaccgagggctcccagtggattatcggttatctcctccaaaaggtgatctccaacttgtcagtctggagcagcgaacaggatctggctaacgacacggtacagctgttggttaccctcgtggaaaggcgcgaaagagcaaatttggttattcagtgcgagaactggtggaatctggccaaacaatttgctagtagaagccctcccctgaactttctcagttctcccgttcagagaacccttatgaaagctctagtgcttgggggtttcgcccacatggacaccgagaccaaacagcagtactggacagaggtcctgcagcccctgcagcagcggtttcttagggtgataaatcaggaaaactttcaacaaatgtgtcagcaggaggaagtgaagcaggagatcaccgcaacattggaggctctgtgcggaatagccgaagccactcagattgacaatgtcgctatcctattcaattttctaatggatttcctgaccaattgcattggacttatggaagtgtacaaaaatacgccggagacggtgaatctgatcattgaagtgttcgtggaggtggcccataagcaaatctgctatctgggagagagtaaagcaatgaatctgtatgaggcttgcctgacactgctgcaggtctacagcaaaaataatcttggtcggcagcggatagatgttacagctgaagaggagcagtaccaagacctgttgctgattatggagttgttgaccaacctcctttcgaaagaatttattgacttttctgatactgacgaggtttttcgaggacacgagcccggacaagccgctaatcgcagtgtcagcgcagctgacgtggtgttgtacggcgtcaacctcatactcccgctcatgtag

SEQ ID NO: 30733 - DNA, 1008 bp, Artificial Sequence
  Description of Artificial Sequence: Synthetic coding sequence
atggactttctgttagggaatccattctcctctccagtgggacaacgtatcgaaaaagccactgatggctccctgcagtccgaggactgggctttaaatatggagatctgcgacatcatcaacgagaccgaagagggacctaaggatgcactgcgcgctgtgaagaagagaatagtgggaaataagaattttcatgaggtgctggaaacgtgcgtgaagaattgtgggcaccgctttcatgtccttgtggcttctcaggacttcgtggagagcgtcctggtgaggacaattctgccgaaaaataatcctcccaccatcgtacacgacaaagtcttgaatttgatacagagctgggctgacgccttccgcagctctccggatttgaccggcgttgtaaccatatatgaggacctcaggagaaaaggactagagttcccaatgaccgaccttgacatgttgtctccgatacacacacctcagaggactgttttcaattcggaaactcagtctgggcaggacagtgtcggcacggatagctcccagcaagaggactcgggccaacatgccgcacctttacctgctcccccaatcctgagcggtgatactccaatcgccccaactcccgagcagattggcaaattaagaagtgaactggaaatggtgtctggaaatgtgagggtgatgtccgaaatgctcacggaactggtgcctactcaggcggaacctgccgacctggagctgctgcaggaactcaatcggacttgtagagctatgcagcaacgcgtccttgagctgattccccagattgccaatgagcaactgactgaggaactgctgattgttaatgacaacctcaacaacgtgttcctgcgccacgagcgtttcgaacgtttcaggacagggcagaccacaaaagctccttccgaggcagaacctgctgcagacttgatcgatatgggacccgatccggctgccaccggaaacctttcatcacagctggccggatag

SEQ ID NO: 30734 - DNA, 5192 bp, Artificial Sequence
  Description of Artificial Sequence: Synthetic coding sequence
atgggcaattccgactcccagtacacccttcagggctcgaagaatcactcaaataccatcacaggcgcaaaacagatcccatgttctctgaagatcaggggaattcacgcaaaggaggaaaagtcccttcacggatggggacatgggagtaacggggctggctacaaaagcaggtcactggctcgctcatgcctgtctcacttcaaaagcaaccagccttacgccagtaggttgggagggccaacctgtaaagtaagccgcggagtcgcctatagtacccacagaacaaatgcccctggaaaagactttcaagggatctcagccgctttttcgacggagaatggctttcactctgtggggcatgagctagccgataatcatatcacatcacgcgattgcaatggccacctgctgaactgctacggccgaaatgagagtatagccagtactcctcctggcgaagaccgaaagtcacctagggtccttatcaagaccctgggaaagttggatgggtgtctaagagttgagttccacaacggcggtaacccctctaaggtgccagccgaagactgttccgagcccgtgcagcttttgcgctactcacccacacttgcatctgagacgagcccagtgcctgaggccaggcgtggcagctccgctgattcgctcccttcacatagacccagccccaccgattctcgcctgagaagtagcaaagggagctccttatcaagtgaatcctcctggtacgactccccatgggggaacgcaggagaactgtctgaggctgagggctcatttctagcacccggtatgcctgatcctagccttcatgcgtcttttcccccaggcgatgctaagaagccctttaaccagagttcatccctgtcctctctgagagagctttacaaagatgccaacctgggtagcctctccccatccgggatcaggctctcggacgagtacatgggcacccatgcatcccttagcaatagggtgtccttcgcctctgacattgatgtgcctagtcgtgttgctcatggggacccaatccaatactcgtcattcaccctgccatgtcggaagcctaaggccttcgtcgaagatacagctaaaaaagatagccttaaagcaaggatgagaagaatctcggactggaccggatctctctctcgcaagaaaagaaagctccaagaaccacgctcaaaagaaggtagcgattatttcgacagtcggtctgacggcctgaacacagatgtgcagggaagctctcaggcttcagcgttcctgtggtctggtggaagcacgcagatcctttcccagagatccgagtcgacacatgccatcgggagcgatcctctcagacagaacatctatgagaacttcatgcgagaattggagatgtcgcgcacgaatactgagaacattgagactagtaccgaaactgctgaaagttcatctgagagtctgagttcactcgagcagcttgacctactcttcgaaaaggagcagggagttgtgcgcaaggccggatggctcttttttaagccactggtgacggttcagaaagaacgcaaactggagcttgtggcgcgtagaaaatggaaacaatactgggtgaccctcaagggctgtactttactgttttacgagacttatggcaagaacagcatggatcaatccagcgctcccaggtgcgccttgttcgctgaagacagcatcgttcagtcggtgccagaacatccaaagaaggagaacgtcttctgcctgtctaacagttttggagatgtgtacttgtttcaagccacttctcagacggacctggaaaactgggtgacggcagttcacagcgcatgtgcgtctctgttcgccaaaaagcatgggaaggaggatactctgaggcttctaaagaatcagactaagaaccttctccaaaagatcgacatggatagcaaaatgaaaaagatggccgagctgcagcttagcgtggtgtctgatcccaagaatagaaaggcaatcgagaaccagatccaacagtgggaacagaacctcgaaaaatttcacatggatctgttccgcatgcgttgctacctggccagcctccaggggggagaactacctaatcctaagagcttactggccgctgcgtctcgccctagtaagttagcactcggcaggctgggtattctttccgtttcatcctttcatgctctggtctgttctcgggacgactcagctcttcgaaaaaggactttatcccttacccagcggggtcggaataagaaaggtatcttttcttcattgaaaggccttgacactctggcacgcaagggcaaggaaaaacgcccaagcatcacacaagtggatgagctccttcatatatatgggtcaaccgtggacggggtgccccgagacaatgcctgggagatacagacttacgtccattttcaggataaccacggcgttacagtgggtattaaacctgagcatcgggtcgaggacattcttacattagcctgtaagatgagacagttggagccctctcattacgggctccagctgaggaaacttgtggacgacaacgtggagtattgcattccggctccatatgagtacatgcagcaacaggtgtacgacgagatcgaagtctttcccctgaacgtgtacgacgtccagctaaccaagaccgggtcggtgtgcgacttcgggtttgctgtcactgcccaggtcgacgagagacaacatctgtctagaatatttatcagtgacgtcttgccagatggcctcgcctacggggaaggtctgcggaagggcaatgagattatgacactgaacggagaggctgtctccgatctggatcttaaacagatggaagccctgtttagcgagaaatcagtgggcttgacgctcatcgccaggccacctgatacaaaagcaaccctgtgcacttcttggagtgactccgacctcttcagtagagatcaaaagagccttttaccaccgcctaaccagagtcagcttctggaagaatttctagacaactttaagaaaaataccgcgaacgacttttctaatgtgcctgacattactaccgggctcaagagaagtcagacagacgggactttggatcaggtgtcccaccgggaaaagatggagcagacctttcgcagcgctgaacaaattactgccttgtgtcgatcttttaatgactctcaggccaacggcatggaggggccacgtgagaaccaagacccccctcctcgctcgctcgcaagacacctgtccgatgcggatcgtcttcgtaaggtaattcaggagttggtcgacactgagaagtcgtatgttaaagacctgagctgtttgtttgaactatacctcgaacctctgcagaatgagacgtttctcactcaagacgagatggagtccctttttggtagcctgcctgaaatgctcgagtttcagaaagtgtttctggaaacactggaagacgggatcagcgcaagctcagacttcaacacactcgagacaccttcccaatttaggaagctgctgttctccttgggaggaagctttctttactacgctgaccattttaagctctactctggcttctgcgcgaaccacattaaggtacagaaggtcctggagcgagcaaagactgacaaggctttcaaggctttcctagatgcaagaaaccccaccaagcagcattcctctaccctcgaaagctatttgattaaacctgtccaacgcgtcttaaagtatccactgttgctcaaagaactggtgtctctgactgaccaagagagcgaggagcattaccatttaacagaggccctgaaggctatggagaaggtggcgagtcacatcaatgagatgcagaagatttacgaagactacggcactgtattcgatcaactcgtcgcggagcagagcggcaccgaaaaggaacaacccgagtggagttccgaggtcatggacgtcttggatccacgtggcaaactgaccaagggtacactggaggagccacggacactagtcacggagctgtccatgggagaattgctgatgcattccaccgtgtcatggttgaatcccttcctgtcactgggtaaggctcggaaggatcttgagctcacggtcttcgtgtttaaaagagcagtcatcctggtctacaaggagaattgtaagctgaaaaaaaagctgccatctaattctagacctgctcataacagcacagacctcgatccctttaagtttagatggctcatcccaattagcgccttgcaggttcgcctgggtaaccccgcaggtacagaaaacaattccatttgggaactcatccacacaaagagtgagatcgaaggcaggcccgaaaccatctttcaactgtgttgtagcgattccgagagtaagactaacatcgtcaaggtgatccgcagcatcttaagagaaaatttccgcaggcatattaaatgcgagcttcctctcgagaaaacttgtaaagatcggctcgttccactcaaaaatcgagtgcccgtttcggcaaaattggcttcttcacggtcactcaaagtcctgaaaaacagcagttccaacgaatggaccggagaaaccgggaagggaacgctgttggacagcgacgagggatcattgtcctctgggacacagtcctccggctgtccgaccgcagagggtcgtcaggatagtaaatccacctctcccggaaagtacccccatccaggcctcgcagacttcgctgataatctgataaaagagtcggatatcctgagcgacgaggacgatgaccatcgacagacagtcaaacaaggatcgccaaccaaggatattgagatacagtttcagcgacttcgcatttccgaggatccagatgtgcatccagaagccgagcagcagccgggaccagaaagcggagagggacagaagggcggagaacagccaaaactcgtcaggggacatttttgccccatcaaacgaaaagcgaacagtaccaaaagggataggggcactttgctgaaagcccaaatacggcatcagtccctcgattctcagtccgagaatgccacaattgatcttaactccgtgttggagagggaattctcggtgcaaagcttgacaagcgtagtgtctgaagagtgtttctacgaaactgaatcccatggcaaatcata

SEQ ID NO: 30735 - DNA, 348 bp, Artificial Sequence
  Description of Artificial Sequence: Synthetic coding sequence
atggcgccagcgaaaaaggggggtgagaagaaaaagggtagaagcgccatcaacgaagtggtcacaagagaatacactattaacatccataagcgcattcacggggtgggttttaagaaaagggcgccaagagccctgaaggaaattcgtaaattcgccatgaaggagatgggcacccctgacgttcggatagacaccaggctgaacaaagcggtgtgggctaaagggattcggaatgtgccgtaccggattcgggtgaggctgagcagaaagcgaaacgaggatgaggattctcccaacaaactttatacgcttgtgacttatgttcctgtgactactttcaagtag

SEQ ID NO: 30736 - DNA, 747 bp, Artificial Sequence
  Description of Artificial Sequence: Synthetic coding sequence
atggctctagaagttggggatatggaggacggccaactcagtgattctgactctgacatgacagtagccccttccgatcggccacttcagctgcctaaggtcctcgggggagatagcgccatgagagctttccagaatacagctaccgcttgcgccccagtgagtcactaccgggctgttgagtccgtcgactcatccgaagaatccttttctgacagcgacgatgactcttgcctctggaaaaggaaacgtcagaaatgtttcaacccacctccaaagcccgaacccttccagtttgggcaaagctcgcagaagccaccggtagccggaggcaagaaaattaataatatttggggcgcagtcttacagaaattgaggaaggagtctcaggaacatacgaaggatctggacaaagagcttgatgagtacatgcacggaggtaaaaaaatgggcagcaaagaggaggagaatggacagggccacttaaagcgcaagcggcctgtcaaggatagactcggaaacagacccgagatgaattacaaggggaggtatgagatcacagcagaagacagccaggagaaggtcgctgacgaaatcagctttcgcttgcaagagcctaagaaagatctcatagccagggtggtgagaaacaagctgaggaccttcagcactttgaagaccaagcgaaatatgaagattaaaaagctgctggggaggggtgagcacaaatgctgggggaagaggtag

SEQ ID NO: 30737 - DNA, 78 bp, Artificial Sequence
  Description of Artificial Sequence: Synthetic coding sequence
atggcaatggccccaagcccctctctagtccaggtctacactagtcccgcagccgtggccgtctgggagtggcaatag

SEQ ID NO: 30738 - DNA, 171 bp, Artificial Sequence
  Description of Artificial Sequence: Synthetic coding sequence
atgtcttattaccagcgccctttttccccatctgcttacagtctaccggcttcactcaatagctccatcgtaatgcagcatggcacgagcctcgatagcacagacacatacccacagcacgcacaatcccttgacggcaccacaagttcctccatacccctgtatcggtag

SEQ ID NO: 30739 - DNA, 450 bp, Artificial Sequence
  Description of Artificial Sequence: Synthetic coding sequence
gtgagagagttggaggccgaactggatgcggaacagaagaagcacgcagaggccttaaagggagtgagaaagcacgagaggagagttaaggagctcgcctaccaagcagaagaagatcgaaagaatctggccaggatgcaggacctggtcgacaagttacagagcaaagtgaagtcatataaacggcagttcgaagaggccgaacagcaggcgaacacaaacctcgcaaaatacagaaaagcacagcacgagctggatgatgccgaagagagagccgacatggctgagacacaggccaataagctcagagcacgaaccagagatgccctgggtcctaaggtgcggtccggcaggggtatagccctttgcgccggagggctgtggggtctcacgggttcaaccgctcatagcgcgataccattttcatcagcccaaggcgtgacggcttag

SEQ ID NO: 30740 - DNA, 468 bp, Artificial Sequence
  Description of Artificial Sequence: Synthetic coding sequence
agcaatgtaatggaggctaatgcagcccgtcaggcgacacccgcagaatggtcccaggatgattcgaacgatatgtgggaagatcaagaggaggaagaggaagaggaggaggacggtctcgcgggtcagctcctgagcgatatcctagcaacatcaaagtatgaagaggattattacgaagatgacgaggaagatgatcctgacgccctgaaggaccccctgtaccagatcgacttgcaggccactctgatgactatgaggggggagttttaccgcccttccgcctctaagaagggttcactttcaactttcgcaccatccggcccagctgccaaccatttcgccgcattgaccggcctcgagatgcacttcctcctcaatttaaagtggcatctggatccctggcccctggcctcggccgtcactttgatgaccattcagacgaggctgacaggcgctgtaacttag

SEQ ID NO: 30741 - DNA, 1620 bp, Artificial Sequence
  Description of Artificial Sequence: Synthetic coding sequence
atggccacatcagctcctctacggtccctggaagaagaggtgacatgctctatttgtctagattaccttagggaccctgtcaccatcgattgtggccatgtgttttgccgtagttgcactactgatgttagaccaatctcgggctccagacctgtctgcccgctgtgtaaaaaacctttcaaaaaagagaatatacggccagtctggcagttggcttcccttgttgaaaatatcgagcgcctcaaggtcgataaaggccgacagcccggtgaggtgaccagggagcaacaggacgcaaaactttgcgagagacaccgcgagaagctgcattactattgcgaggacgacggtaagctgctgtgcgtaatgtgccgagagagtcgtgaacaccgcccacatactgctgtgttaatggaaaaagctgctcaacctcaccgtgagaaaatcctcaatcatctttctaccctgagacgcgatcgtgacaagattcaagggttccaagccaagggcgaagccgatatactggccgctctgaagaaattacaggatcagaggcagtacatcgtagcagagtttgagcagggtcaccagttcctcagagagcgcgaagagcatttgctggagcagctggctaagcttgaacaggaacttaccgaaggtcgcgagaagtttaagtcccggggagtgggggaactggcaagactggccctcgtgatctcagagctcgagggaaaggctcagcagcccgcagctgaactgatgcaggataccagggacttcctcaaccggtatcccagaaagaaattttgggtgggaaagcccatcgctagagtcgttaagaagaagactggtgaattctctgacaaattgctatccctgcagagaggtctgagggaatttcaaggcaagctgctcagggacctggaatacaagactgtgagcgtaactctagacccacagagtgcatccgggtacctgcaactgagtgaagattggaaatgcgtgacctacacatccctgtataaaagtgcgtacttacacccgcagcagtttgattgtgaacctggggttctggggtcaaaaggatttacctggggtaaggtgtactgggaagtcgaggttgagagggaagggtggagtgaggatgaagaagagggcgacgaagaggaagaaggcgaggaggaagaggaggaggaggaagctggctatggggacgggtatgatgactgggaaacagacgaggacgaggaatccctgggagacgaagaggaggaggaggaggaggaggaagaagaggtgctagaatcttgtatggtcggagtcgcgagagacagtgtgaaacggaagggcgatctttccctgagacctgaagatggcgtgtgggctcttaggttatcttccagcgggatttgggcaaacacatctccggaggctgagctgtttccagccctccgcccacgcagagtgggaattgctctagattacgagggcggtaccgtgaccttcacaaacgcagaaagccaagagctgatttataccttcactgccacattcacgaggcgcctggtcccattcctctggttgaagtggcccggtactcgactactcctccgaccatag

SEQ ID NO: 30742 - DNA, 645 bp, Artificial Sequence
  Description of Artificial Sequence: Synthetic coding sequence
atgccttcaccatgggggtggttcgccgttaccgcctgtggagcccagagaaataactttgaagagcccgtggcccttcaggagatggacacctcaaacggtgtactcctgcccttctacgatccggactcttctatcgtgtacctttgcggcaagggtgatagtagtatcagatactttgagatcacagatgaaccacctttcgtccactatctcaataccttcagttctaaggagcctcagaggggcatgggctttatgccaaagcgagggctggatgtttctaaatgtgaaatcgctagattttataaactgcatgaaaggaagtgcgagcctatcatcatgaccgttcccagaaagtcggacttgtttcaggacgccgaaccggtgctcataagtctgcgtgatggctatgtcccacccaagcatagggaactgagagtgacaaaaagaaacatccttgacgttaggccgccatctgggccaagacggtcgcaatcagcatccgacgctccactgtctcagcacaccctcgagacgctgctggaggagattaaagctttacgtgagcgggtgcaggcacaggagcagagaataacagccttagaaaatatgctctgtgaactcgtggatggaacagattag

SEQ ID NO: 30743 - DNA, 690 bp, Artificial Sequence
  Description of Artificial Sequence: Synthetic coding sequence
atgttgcagttaagggatagtgttgactccgcaggcactagcccaaccgccgttctggcagccggagaggagcccggatccattgaacaggccgtggaagagatccgtgtggtggtgaggcccgtagaagacggagagatccaaggtgtgtggctcctgaccgaagtggatcactggaataacgagaaagagagactggtattggtcactgagcaatctttgttaatatgcaagtacgattttatcagcctccaatgccagcaggtggtcaggatcgcactgaacgcagtggacactatctcctatggagagtttcagtttccccctaagtcccttaataagcgcgagggctttggcatccgtatccagtgggataagcagtctaggccttcttttatcaacagatggaatccctggtccacaaacgtgccctacgctaccttcacggagcatcctatggcaggggctgacgagaagaccgccagcctgtgccagttagaatccttcaaggcccttctcattcaggccgtcaagaaggcccagaaagaaagtcctctgcctggacaggccaacggcgttctcatcctggaacgacctttgttaatcgaaacatatgtggggcttatgtctttcatcaataatgaggcgaagttaggctatagcatgactagaggcaagataggtttttag

SEQ ID NO: 30744 - DNA, 390 bp, Artificial Sequence
  Description of Artificial Sequence: Synthetic coding sequence
atgtgcgaggtgtctagaggttggaagccttgcactgagggaattttgaaagtacgcccaactcgtaagatctcctacgagggcaacataacgccaacagttgaactcaatgccctgtgtatgaaattaggaaaaaagccaatgtataagcctgtggatccatatagccgcatgcagtccacttacaactacaacatgcgaggcggagcctatcctccgagatacttttaccccttccccgtgccccctctactgtatcaggtggaactctcggtgggcggtcagcagtttaatgggaagggcaaaactcgtcaggctgcaaaacatgacgctgctgcaaaggccctgagaatcctacaaaatgagccgcttcctgaacgcctggagtag

SEQ ID NO: 30745 - DNA, 3042 bp, Artificial Sequence
  Description of Artificial Sequence: Synthetic coding sequence
atggatctgttcagaatgcgctgctacctggccagcttacaagggggagaactgcctaatcccaagtctctgctggccgctgcctctcgaccttcaaaacttgctctaggtcgcctcggaatcctcagcgtgtcatctttccacgcattggtgtgctctagggatgattctgcattgcggaaacgtactctgtccctcactcaaagaggaagaaacaaaaagggaatcttctcttctttgaagggactggatacactggcccgtaaagggaaagagaaaagacccagtatcacacaagttgacgaactgctccacatttacggaagtactgttgatggggtacccagagataatgcttgggagatacagacctatgtccactttcaggacaatcacggtgttacagttggaatcaagcctgaacatagggtggaggatatcctgaccctggcctgtaagatgaggcagctggaacctagccactacggattgcaactccgaaagctggttgacgataatgtagaatactgtattccagctccttacgagtacatgcagcagcaggtatatgatgagatcgaagtgttcccgctcaatgtatacgatgtccaacttaccaaaactggctcagtgtgtgactttggtttcgctgtgactgcccaggtcgatgagcgtcaacacttatctaggattttcatctcagatgtcctgccagacgggttggcctacggagaaggactgaggaagggcaacgagatcatgacactcaacggcgaggcagtctctgatctggatctgaagcagatggaggccctgttcagcgagaaatctgtgggtctaactctcattgccagacccccagacaccaaggctacattatgtacgagctggtctgattctgacctgttttcccgggatcagaagtccttactgccaccaccaaatcagtcccaattgctagaagagttcctcgataactttaaaaagaatacagctaatgacttttctaatgtgccagacatcactaccgggttgaaacgctctcaaacagatggcactctcgaccaggtgtcccatagagagaaaatggagcaaacattcaggagcgccgagcaaataaccgccctgtgtcgatcattcaacgactcacaggccaatggcatggagggcccacgtgaaaatcaggacccgccacctcgctccctggccaggcacctgtcagacgccgatcggttaagaaaggtcatccaggagctggtggacactgagaaaagttacgtgaaggacttaagctgcctgtttgagctgtaccttgagcccctgcagaatgaaacttttctgacgcaagacgaaatggaatctttgtttggatctctacccgaaatgttagagttccagaaagtcttcctggaaaccttagaggatggaatctcagcgagcagtgacttcaatacccttgaaacaccttctcagtttcgaaaactgttgttcagcctgggcggttcatttctgtactacgccgaccacttcaaactatattcggggttctgcgccaaccatatcaaggtccagaaggtgctggaaagggcaaagaccgacaaagcattcaaagccttcctggatgcccgtaatcccacgaaacaacacagcagtaccctggagagttatctgataaaacctgttcagagggtactcaagtacccccttttgttgaaggaactggtgtccctaacagaccaggaatccgaagagcactatcacctcacggaagcactgaaggctatggagaaagttgcctcccatattaacgaaatgcagaagatctatgaggattacggaactgtgttcgatcagttagtggctgagcaaagcggaaccgaaaaagaggttactgagctctctatgggagaattgctcatgcactctaccgtgtcttggctgaatccttttctctcactaggtaaagcacgaaaggatttggagcttacagtttttgttttcaaacgggctgtgatcctagtttataaggagaactgtaagctcaagaaaaaactccctagtaattctcgacccgctcacaattcaactgacctagacccttttaaatttaggtggctgataccgatatccgctctgcaagttaggctagggaacccggcaggcactgagaataatagcatctgggaactcatccacactaagtccgaaattgaaggcagaccagaaacaatttttcaactgtgctgttccgacagcgagagtaaaacaaatattgtcaaagtcattcgatcaattctccgagagaattttcgcaggcatatcaagtgcgaacttcccctggagaagacgtgtaaagataggctggtgcccctgaagaaccgcgtgcccgtcagtgcaaaattagctagttctagatccctaaaggtcctgaaaaactccagcagtaatgagtggacgggagagaccggcaagggtactctattagacagcgatgaaggaagccttagctccgggacgcagtcatccgggtgccccactgcagagggtagacaagattcaaagagcacctcccctggaaagtatccacacccgggtctagccgacttcgccgacaatttgatcaaggaaagcgacattctgtcagatgaggatgatgaccatcgccagactgttaagcaaggaagtcccacgaaggatattgagatacagttccagaggcttcgcatttccgaagatcccgacgtccacccggaggcagaacaacagcccggacctgagtctggcgaggggcagaaaggtggggaacagccaaagttggtgagaggacacttctgtccaataaagagaaaggctaactcgactaaacgtgatcgaggaactctgctgaaggcccaaattaggcaccagtctctcgactctcaatccgagaatgctacaattgacttgaacagcgttcttgaacgggagttctccgtccaatccttaactagcgttgtctctgaggagtgcttctacgaaactgagagccatggaaagagctag

SEQ ID NO: 30746 - DNA, 1149 bp, Artificial Sequence
  Description of Artificial Sequence: Synthetic coding sequence
atggccgcaaacctctctcggaacgggccagccttgcaggaggcttatgtacgggtagtgaccgaaaagtctccaaccgattgggctttattcacttatgagggtaattccaatgacatacgcgtcgccggaacgggcgaagggggtctggaggagatggtggaggaactcaacagcggtaaggtgatgtacgcattttgcagagtgaaggatcccaactctgggctgcccaaattcgtgcttattaactggacaggtgagggagtcaatgacgtgaggaagggcgcatgcgcttctcacgtctcaacaatggcctcctttttgaaaggatctgtgtaccagaaaaccaacgcagtttctgagataaaaagagtaggaaaggatagtttttgggctaaggcagaaaaagaggaggaaaacaggcgtctcgaagagaagcggagggcggaagaagctcagcgccagcttgagcaggagagaagggaacgggagttacgagaggctgcacgtagggaacagcggtaccaggagcaggggggagaggcatccccccagtctcggacttgggaacagcagcaggaggtagtttcaaggaaccgcaatgagcaagagagcgccgtgcatccgagagaaatcttcaagcagaaggagcgggctatgagcacaacatctatctcaagcccacagccaggcaaactccgctccccattcctgcagaaacagctcacgcagccggagacgcacttcggcagggagccagctgccgctatctccaggcctagggccgatcttcccgctgaggaaccagccccatccactccaccttgccttgtccaagccgaagaggaagcagtgtacgaggaacctccagaacaagagaccttctatgaacagccgccactggtccagcaacagggggctgggagtgagcacatcgatcatcatattcagggccagggactgtctggccagggattgtgcgccagagccctgtacgactaccaagccgcagatgacactgagataagcttcgaccccgagaacctaataacgggaattgaggtgatcgatgaagggtggtggcgtggttacgggcctgatgggcatttcggcatgtttccagccaactatgtcgaacttatcgagtag

SEQ ID NO: 30747 - DNA, 660 bp, Artificial Sequence
  Description of Artificial Sequence: Synthetic coding sequence
atggtggtgctgtcagtgcctgccgaggtaacagtaatactgctcgatattgaagggaccacaactcccatcgccttcgtgaaagacatcctgtttccttatattgaagagaatgtgaaggagtatcttcagacccactgggaagaagaggagtgccagcaggacgtttcgctcctcagaaaacaggccgaggaagacgcccatctcgatggcgcagtcccaatcccagcagcttccggtaacggagttgacgatctgcaacaaatgatccaggccgtagttgacaacgtgtgttggcagatgtccctggacagaaaaaccacagccctgaagcagctgcagggtcacatgtggagagctgcctttactgcaggccgaatgaaggcagagttcttcgccgatgttgtccctgccgtgcgtaagtggagggaagcgggaatgaaagtatatatctacagttctggaagcgtcgaagcgcagaagttgctgttcggacactctactgaaggcgatatacttgaactggtagatggacatttcgataccaagattgggcacaaagtggagtcagaaagctacaaagactgtcggcagcattgggttctcaaccaacagcacttcgtcagtgacagatgttatagcagagggcagtgttgctag

SEQ ID NO: 30748 - DNA, 1446 bp, Artificial Sequence
  Description of Artificial Sequence: Synthetic coding sequence
atggcctctgctgcaagcgtgacatcgttagcagacgaagttaattgtccaatctgccaggggacactgagagagcccgtgacgatcgactgtggccataacttctgtagagcctgccttactcgctactgcgagatacctgggccagatcttgaggaatcaccaacctgtcccttgtgcaaagaaccattccgcccaggtagcttcagaccaaattggcagcttgctaacgtcgtagagaatattgaacgactgcaattggtgagcacgctggggctgggggaggaagacgtctgccaggaacacggtgaaaagatttacttcttttgtgaggacgacgaaatgcagctttgcgtcgtgtgcagagaggcgggagagcacgctacacatacaatgcggtttttagaagacgccgctgccccataccgggaacaaatccacaagtgcctaaagtgcctgagaaaggagcgggaggagatccaggagattcaatcaagagagaataaacgaatgcaggtgctgcttacacaggtctctacaaagcgccagcaagtaatatccgagtttgctcatctgagaaaatttcttgaagagcagcagtctatcctgttggctcagttggagagccaagatggcgatattctgaggcagcgagatgaatttgacttactcgtggccggtgaaatctgtcgcttcagcgcactcatcgaagagctcgaagagaaaaatgagaggcccgcaagggagctgctgactgatattcgcagcaccctcatacggtgcgaaacacgtaaatgtcggaagcctgtggcagtgagcccagagctgggtcagaggatcagagatttccctcagcaagcactgccgctgcaaagagaaatgaagatgttcttggaaaagctatgttttgagctggattacgagcccgctcacatctcactcgacccccagacaagccatcctaagctgttattatcagaggaccatcagcgggctcaattcagctacaaatggcaaaattcccccgacaacccccagcgttttgatagagccacctgtgtgttggcccataccggcattacagggggacgacacacctgggtggtatctatcgatctggcccatggcggttcctgtaccgtcggggtggtttcagaagacgtgcaaaggaaaggggagctccggctcaggccagaagagggagtttgggccgtaaggctggcgtggggcttcgtctccgcgttgggctcattcccaacgaggctgaccctgaaggagcagccgaggcaagtcagggtgtctctcgactatgaggtgggatgggttactttcaccaatgctgtgacccgcgagccgatctatacattcacggcctccttcaccaggaaggtgataccatttttcggtctttggggcaggggatcctccttctccttgtcgagctag

SEQ ID NO: 30749 - DNA, 1644 bp, Artificial Sequence
  Description of Artificial Sequence: Synthetic coding sequence
atggccggtacaaaaaataaaacccgggctcaggcaaagacagaaaaaaaggctgccatccaggcgaaggcaggcgcagagcgagaagccactggcgtagtaaggccggtcgctaagactcgcgctaaggccaaagctaagactgggagtaaaaccgatgccgtcgccgaaatgaaggccgtctctaagaataaggtggtggcagagaccaaagaaggcgcactgtcagagccaaagactctgggtaaggccatgggcgattttactcccaaagccggtaacgaatcaacttcctccacatgtaaaaatgaagccggaacagatgcatggttttgggctggcgaggaagccactattaatagttggttctggaatggggaagaggcgggtaattctttctctacaaaaaatgacaaaccggaaatcggcgcacaggtctgtgccgaggagctcgagccggctgccggagcagactgcaaaccacgttccggcgctgaagaggaagaagaagagaacgtcattggaaattggttttgggagggagacgacacgtcgttcgatcccaacccaaaaccagtctcaaggattgtgaaaccccaacctgtctatgagatcaacgagaaaaacagacctaaagactggagtgaagtgaccatttggcctaacgccccagcggtgacccctgccgtcctggggttccgctcgcaggcaccgtccgaagcttctcccccatcttacattgtgctcgccagtgcagaagagaacgcgtgtagtctgcccgttgccactgcatgccgtccttctagaaataccagatcttgttctcagcctatccctgagtgccggttcgacagtgatccgtgcatacaaacaatcgatgagattcgtcgacagattcgcataagggaagtcaacggaatcaaacccttcgcatgtccctgtaagatggagtgttacatggactctgaggagtttgagaagttggtgtcacttctcaagtccactactgatccactgatacacaaaatcgcaaggatcgccatgggcgtccataatgtccaccctttcgcacaggaatttatcaacgaggtaggcgtggtgaccttaattgagtcacttctatctttcccaagcccggagatgcggaaaaaaaccgtgattactcttaaccccccatctggcgatgaacggcagagaaagatcgagctacatgtgaaacacatgtgcaaagagaccatgagcttcccattgaactcacccggtcaacaatcaggactgaaaatcctaggtcagttaaccaccgactttgtccaccactatatcgtggccaattattttagtgagttgtttcacctcttgagcagcggcaactgcaaaacgcgtaatttggtcctgaaactgttactcaatatgtctgagaatcctacggccgctcgcgatatgattaatatgaaggcactggccgctctaaaacttatctttaaccagaaggaagccaaggctaaccttgtctctggcgtcgctatctttattaacatcaaagagcacatccgcaagggttccatcgttgtcgtcgaccatctctcatacaataccctcatggctatctttcgggaggtgaaagagattatcgagacaatgtag

SEQ ID NO: 30750 - DNA, 1887 bp, Artificial Sequence
  Description of Artificial Sequence: Synthetic coding sequence
atgagcgataagagtgacctaaaagctgaattggagagaaagaaacagaggttggcacagataagagaggaaaaaaagcggaaagaagaggaacgtaagaaaaaagaagccgacatgcagcaaaaaaaggagccagtgcaggacgatagtgacctggatcgaaaaaggagggaaacagaagcactgttacagagcatcggtatcagccccgagccccctctggtccctactccaatgagcccaagctccaaatctgtgagtacacccagcgaagctggctcacaggatagtggcgatctgggccctctcactcgcacacttcaatgggacaccgatccttccgtgctgcaactgcagtctgattccgagctcggcagacggctccacaagctgggggtctcaaaggtgacgcaagttgattttctcccgcgtgaagtcgtaagttactcaaaagaaacgcagacacctctggctacccatcagtccgaggaagatgaggaggacgaggaaatggttgagtcaaaagttgggcaggactctgagttggagaatcaggataagaagcaggaggtgaaggaggcccctccacgcgaattgaccgaggaggaaaagcagcagattctacatagtgaagagtttctgatattctttgatcgtacgatacgggtgattgagagagccctcgccgaggacagcgacatatttttcgactatagtgggagggaactggaggaaaaggatggggacgtacaggcaggcgctaatttgagtttcaacagacagttttacgacgaacactggtccaaacatcgtgtcgtgacgtgcatggattggtccctgcagtatccagagctgatggtggcctcttacaacaataatgaggatgctcctcacgagcccgacggcgtcgcccttgtgtggaacatgaagtttaaaaagacaactccagaatacgtgtttcattgtcaaagtagtgtgatgtctgtttgttttgcgagattccaccccaacctcgtggtaggcggtacgtacagcggccagattgtgttatgggataatagatcacatagaagaaccccagtccaaagaacaccactgagcgctgctgctcatactcaccccgtatattgcgtaaacgtggtgggaacccagaacgcccacaacttgattacggtgtcaactgatggcaaaatgtgcagctggtctctcgacatgttgagtacaccccaggaaagtatggagcttgtgtacaacaagagcaagcccgtagctgtcactggcatggctttccccaccggagacgtgaacaacttcgttgtggggtccgaggagggcaccgtgtacactgcttgtcgtcacggcagtaaagcagggattggggaagtgttcgaggggcatcagggcccagtaaccggaataaattgccacatggctgtgggaccaattgatttctcacacttatttgttacatcttcttttgactggactgtgaaactttggactaccaaacacaataagccgttgtactctttcgaagataacgccgactacgtttatgatgtgatgtggtcacctgtgcacccggctttgttcgcctgcgtggatggcatggggcgtctcgatctttggaacctgaacaacgacactgaggtgccaacggcatctgttgcaatcgagggagcttccgcgcttaaccgcgtcagatgggctcaagccggaaaggaggttgcagtgggtgattctgagggaagaatttgggtgtatgacgtgggcgagcttgcagtaccccataatgacgagtggacacgtttcgcacgaaccctggtcgagattagggctaaccgcgcagacagcgaagaggaaggaaccgtcgagctgtctgcttag

SEQ ID NO: 30751 - DNA, 474 bp, Artificial Sequence
  Description of Artificial Sequence: Synthetic coding sequence
atgaggagtggatttcgctgcgatgaacccgctgaggcagtggcgcctgagaggcagactgtgtcgggggctgtcgccctggccagttttacctccccacacacccacccagtcgacgacggcggaagacactacagctggggatccccaaaaagaatcctcggtcttggcccaggtgacgccgctaaggaggctggcctcgtgaggcccctccagggccagagcgaaaaaattctgctgcgtacgcgaaacagacagccaatggagccacctatggaaccaagcgggggagaacaggaacctggcgctgttaggtttctggaccttccttgggaggatgtcttgttgccacacgtgctcaaccgggttccactgaggcagcttctccgtctgcagcgcgtcagtagggcattccgcagtctggtacaactgcatctggctggactccggcgttttgatgcagcccaggtgtag

SEQ ID NO: 30752 - DNA, 483 bp, Artificial Sequence
  Description of Artificial Sequence: Synthetic coding sequence
atggaagccgaaagaccccaggaggaagaggacggagagcaggggcctcctcaggacgaggaagggtggccaccacccaactcaacaacaagaccttggcggagcgcaccaccctcacctcccccacctgggacaaggcacactgccctgggacccagatccgctagcctgctgtcgctgcagacggagctactcctggacctggtcgccgaggcacagtcccggaggcttgaggagcagagggctactttttatacaccgcagaacccatcgagtcttgccccagcaccattgcgtcccctggaggaccgcgaacagctctacagtacaatcctatcccatcagtgccagcggatggaggcacagcggtccgagccccctctgcccccaggtggccaggaactattggaattgcttctaagggtacaggggggaggcaggatggaggagcaacggtcacgccctccaactcacacctgttag

SEQ ID NO: 30753 - DNA, 402 bp, Artificial Sequence
  Description of Artificial Sequence: Synthetic coding sequence
atggcagccttacgaccattagtgaagcccaagatcgtgaagaaaaggaccaagaagttcatacgccaccaatcagatcgatatgttaagattaagcggaactggcgcaagccccgtggcatcgacaaccgtgttcggagacggtttaaaggacaaatccttatgcccaatatagggtacggtagcaacaagaagacaaagcatatgttgccatctggattccgtaaattcctcgtccataacgtgaaagaattagaggtactgcttatgtgcaacaaaagctattgtgcagagattgctcataatgtgtcgtccaagaatcgtaaagctatagtggaacgagccgctcagctggccatccgtgtgaccaacccaaacgcacgtctccgcagtgaagagtag

SEQ ID NO: 30754 - DNA, 639 bp, Artificial Sequence
  Description of Artificial Sequence: Synthetic coding sequence
atggacctgttcggtgacttacctgagcctgagagatctcccaggcctgcagccggtaaggaggcccaaaaaggacctctgctgttcgatgatctaccacctgccagtagcactgatagcggcagtggcggaccactgctctttgatgacctgccccctgctagctcgggggactcaggcagcctggcaacatccatttctcaaatggttaaaacggaggggaagggcgctaagcggaagacctcggaagaggaaaagaacggcagcgaagagttagtagagaagaaggtgtcatcaagcgtgatcttcgggctgaaggggtacgtcgcagagcggaagggagaacgcgaggagatgcaggacgcccatgtgattctgaacgacattaccgaggagtgtcgaccaccgagttcgcttataactcgggtgtcgtacttcgctgttttcgatgggcacggcggaattagggcatcaaagtttgcggcacagaaccttcaccagaaccttatcagaaagttcccaaagggagacgtgatctcagtagagaagactgtcaagagatgtctgttggatacttttaaacatacggacgaggagtttttgaaacaggccagctctcaaaagccagcttggaagtag

SEQ ID NO: 30755 - DNA, 1131 bp, Artificial Sequence
  Description of Artificial Sequence: Synthetic coding sequence
atgccgttgcaagtctctgactatagctggcagcagaccaaaaccgccgtgttcctgagcttacccttaaagggcgtctgcgtgcgagacacagatgtgttctgcactgagaactacctgaaagttaattttccaccgtttttgttcgaagcttttctgtacgctcctatcgatgatgagagcagcaaagctaaaatcgggaacgatacgatcgtgttcactctctataaaaaagaagccgcaatgtgggaaactctgtccgtgacgggagtggataaagaaatgatgcaacggatcagagaaaagtccatcctgcaggcccaggagcgggctaaggaggcaacagaggccaaggcagctgcgaagcgagaagaccaaaaatatgccctctccgtgatgatgaagatcgaggaagaagaaagaaagaaaattgaagatatgaaggagaacgagagaattaaagcgacaaaggcactcgaggcctggaaagagtaccagcggaaggccgaggaacagaaaaaaatccaacgtgaggagaagctctgccagaaggagaagcagatcaaggaggagaggaaaaagattaagtataaaagtctgacaagaaatctggccagccggaacctggccccaaaagggcgtaattctgaaaatatctttacagaaaaactgaaagaggattccatcccagcccctcgcagcgtcggatcaattaaaataaacttcacccccagggtcttcccaactgctttaagagagagtcaggtagctgaagaggaggagtggctgcataaacaggctgaagcgaggcgggctatgaatacagatatagccgagctgtgcgacttgaaggaagaggagaagaatcccgaatggttgaaggacaaggggaacaaacttttcgcaacagagaattacctcgccgctattaatgcctataacctggccatcaggctgaacaataagatgccacttctgtatctcaatagggccgcatgtcatctcaaactaaagaatttacataaagctatagaggacagcagcaaggcatatcgcatcatgaagaggcatttaagattgatccaccccactaagctttataagttaatgctgcgcagattcggaatgtag

SEQ ID NO: 30756 - DNA, 1485 bp, Artificial Sequence
  Description of Artificial Sequence: Synthetic coding sequence
atggccgctgcagcggaatgtgacgtcgtgatggccgctacagaacccgagttgctcgatgatcaagaggcgaagcgagaagccgaaacgtttaaggagcaagggaatgcatactacgccaaaaaggactacaatgaggcgtataattattataccaaggcaatagacatgtgccccaagaatgccagttactacggcaatcgggctgcaactcttatgatgttgggaaggtttcgagaagcactgggcgacgctcaacaatctgtccgcctggacgactcattcgtcaggggacacctccgagaaggaaaatgtcatttgagtctcggcaacgctatggctgcctgccggagctttcagagagccttggagttggaccataagaacgcccaagcccagcaggagttcaagaatgctaacgccgtgatggagtacgagaagatagcagagaccgattttgaaaaaagggatttccggaaggtggtgttctgcatggaccgagcccttgaattcgcgccagcctgccaccgcttcaagattctgaaggccgaatgcctggcgatgctgggccgatatcctgaggcccagagtgtcgccagtgatatactccggatggacagtacaaacgccgatgctctctacgtgcggggactgtgtctgtattacgaggattgtatcgaaaaggcagtgcagttctttgtgcaggctctccgtatggcacctgaccatgagaaggcgtgcatcgcatgccgaaacgcaaaggcattaaaggcaaaaaaagaagatggcaacaaagccttcaaggaggggaattacaaactcgcttacgagctttatactgaggccctcggcatcgatccgaataatattaagacaaacgctaagttatactgtaaccgaggcactgttaattccaaactgaggaaactcgatgacgcgattgaagattgcaccaacgccgtgaagctggatgacacgtacattaaagcctacttgaggagggctcagtgttatatggacacagagcagtatgaagaggcggtgagggattacgaaaaggtgtatcagactgaaaagactaaggagcataagcagttgctaaaaaatgcacagctcgaactgaagaaaagcaagcggaaagactattataagattctgggcgtcgacaaaaacgcttcggaggatgaaattaagaaagcatacagaaaaagggcactgatgcatcatcctgaccgacattcaggggctagcgccgaagtccagaaggaggaggagaagaaatttaaagaggtgggagaagcttttaccatcctttcggaccctaagaagaaaacacggtacgacagcggccaagatctcgacgaagaaggaatgaacatgggcgatttcgatcccaataatatcttcaaggcattctttggcggtccaggtgggttcagctttgaagcatctggccctggcaacttcttcttccagtttgggtag

SEQ ID NO: 30757 - DNA, 1329 bp, Artificial Sequence
  Description of Artificial Sequence: Synthetic coding sequence
aacgaggtgtataacctcacccaggagttcttccggcacgacaaacccgtcaatgcagaatcacagaattcagtcggagtatttactcgggaggaagtgcgtaatcggattcggaacgaccctgatgaccctgaagcaactaagaggctcaaactggccatgatccagcagtacctgaaggtagagagttgtgagtcaagtagtcatagcatggacgaggttagtctgtccgcatttggcgagtggaccgagattcctggtgctcatcatattattccatcaggatttatgagggtggtggagctattggccgagggcatcccggcacatgtgatacagctcggtaagcccgtgaggtgtattcactgggaccaggcgagtgctagacccagaggcccagagatcgaacctcggggtgaaggcgatcacaaccatgacacgggtgaaggtgggcagggtggcgaagagccacgcggtgggcgttgggatgaagacgagcagtggagtgtggttgtggagtgcgaggattgcgagctgatcccggctgatcacgtcatagtcactgtgagcctgggagtcctgaagcgccaatatactagctttttccgacccggtctgcccacagagaaggttgcagccatccatcgcctgggaattggcaccaccgataagatttttctggagttcgaggagccattttgggggcctgaatgtaactccctgcaatttgtgtgggaggatgaagccgagtcccacacactgacgtaccctcctgagctgtggtaccgcaagatctgcggtttcgacgtcctgtatccccctgaacggtacggccacgttctgtccgggtggatttgcggtgaagaggcattagtaatggagaaatgtgatgatgaggccgtagctgagatatgtacagagatgttacgtcagtttactggcaaccctaatattcccaaaccccgacgaattctgagatcagcgtggggcagcaacccttatttccgcggaagctatagttacactcaggtgggttcctcaggagctgacgtcgaaaaactcgcaaagcctctgccgtacacagaatcatccaagaccgcccatggtagcagtactaagcaacaacccggacacctattttcatctaagtgtcctgaacaaccccttgacgcaaacaggggcgcagtgaagcccatgcaggttcttttcagtggggaagcaactcataggaagtactactcaacgactcacggagctctgctaagtggccaacgggaagccgcacgcctgattgagatgtatcgagacctctttcagcaggggacatag

SEQ ID NO: 30758 - DNA, 180 bp, Artificial Sequence
  Description of Artificial Sequence: Synthetic coding sequence
atgtcttattaccagcgcccattctctcccagtgcttactccctgcctgcttcgctgaactcttccattgtgatgcagcacggaacctccttggatagcactgatacttacccccaacatgctcagagccttgatggtacgaccagctccagtatcccactctatcggagctccgaatag

SEQ ID NO: 30759 - DNA, 837 bp, Artificial Sequence
  Description of Artificial Sequence: Synthetic coding sequence
atgaagtgtgagcattgtacccgcaaggagtgctccaaaaagaccaaaaccgatgaccaggaaaacgtgtctgctgacgctccttcacccgctcaggagaatggggaaaaaggagagtttcacaagctcgccgacgccaagatttttttgtcggactgcctggcttgtgactcttgcatgacggcagaagagggcgtccagctctcacagcagaatgccaaagatttcttccgcgtgctgaacctcaacaaaaagtgtgatacttcgaagcataaggtgctggtcgtgtcagtctgcccgcagtcgctgccttatttcgcagccaaatttaatttgagcgtgacagatgcatccagacgattgtgcggctttcttaaatctctgggatgggtgcggtatgccgaacgcgtcctcgggcgtcctataacagctcatctgtgtactgcaaaaagcccccaacaggtcatgggctctttagtcaaagattatttcgccagacagcaaaacttgagcccagaaaaaatttttcatgtcattgttgctccttgctacgataaaaagcttgaagcacttcaagaatctctgcctcctgcgctgcatggtagtcgcggtgccgactgcgtcttgacatcggggacaggatcactttgggagtgcactccagtgataacagccacccaggaggccgcagcacgtgaatctctggagcctggccgacagagactacagagagacaagatcgccccactcgacagctcactgggaggcggaggtgaaattgctcagatcatggaacagggggacttatccgtccgtgatgcagctgtagacacttag

SEQ ID NO: 30760 - DNA, 471 bp, Artificial Sequence
  Description of Artificial Sequence: Synthetic coding sequence
taagggaaagcccagagaaagatctccgcaattcacattcttgatgtgctcgtgcttaacggaaccgatgtcagggagcagcacttcaaccagaggattcagcttgccgaaaaatttgtcaaggcggtttccaaacccagtcgtcccgacatgaaccccatacgggtcaaagaggtgtataggctcgaagagatggagaaaattttcgtgcggctcgagatgaagatcattaagggatcctccgggactccaaagttatcttatacaggtagagacgatcgacacttcgtcccaatgggcctctatatcgtgaggacagtaaacgagccttggaccatgggattctcaaaaagctttaagaagaagtttttttacaataaaaaaacaaaggattctacatttgaccttcccgcagactccattgcacctttccatttgccctccctcgcatgcctaagcaaaatggattag

SEQ ID NO: 30761 - DNA, 1200 bp, Artificial Sequence
  Description of Artificial Sequence: Synthetic coding sequence
atggcaaccggcgatctgaagcgttcactgcggaacctggagcaggtgctccgtctattgaattaccctgaggaggtggactgcgttggcttgattaagggagatccggctgccagtcttccgataatttcctattcatttacatcctacagtccgtatgttactgagcttattatggagtccaatgtcgagctgatagcaaaaaatgacttacgctttatcgatgcagtgtacaagctgctgagagatcagtttaactacaaacctattttgacgaaaaagcagttcattcagtgcggcttcgctgagtggaaaatccagatcgtgtgcgatattctgaactgtgtcatgaaaaagcacaaagagctctcctcattacagaaaattcctagtcaacaaagaaaaaagatcagctccggaaagagcgaacctcccctgggaaatgagaagatatctgcggaggccgtgggcgtcgatatctccggacgttttatgacaagcggcaagaaaaaagccgtcgtcatccgtcacctatacaatgaggataatgtggacattagcgaggatacgctgagcccaattactgacgtgaacgaagcggtggacgtgtctgatctcaatgccactgaaattaaaatgcctgaagtgaaagtgccagagattaaggccgagcaacaggatgtcaatgttaatcccgaaatcacagccctgcagaccatgcttgcagagtgccaagagaatctcaagaagctgacgtcaattgaaaagaggctggattgcttagaacagaagatgaagggaaaagtcatggttgacgagaacacatggacaaaccttttgagcagagttacactcctggagacggagatgcttctctcaaaaaagaatgacgagttcatagagtttaacgaagtgagtgaagattacgcaagttgcagcgacatggatctgctaaatccccatagaaaatccgaagtggagaggccggcatcaattcccctgtcctcggggtacagcacagcatcgtcggactcaacccccagggcctctaccgtgaactattgtggactgaacgagatctctgagaattttccagcttggtcggctacatcctcttgtagtagcctgtcatggctgctgcggggacacacctcctacctgtctagccagagtttcgcgtggccactgagttgcgtttag

SEQ ID NO: 30762 - DNA, 819 bp, Artificial Sequence
  Description of Artificial Sequence: Synthetic coding sequence
atggctagccttctccaggatcaacttacgacagatcaggatctcctattaatgcaagaagggatgcccatgaggaaagtgaggtcgaagtcctggaagaagcttagatattttcgcttacagaatgacgggatgaccgtgtggcacgccaggcaggccagggggagcgcgaaaccttcattttcaatcagcgatgtggaaactatcaggaatggccatgactctgagctgctgaggtctctggccgaggaactacctttagagcagggctttactatcgtctttcacggccgtcgatccaacctcgatctgatggccaattctgtcgaagaggcccaaatttggatgagaggacttcaacttctcgttgaccttgtgactagtatggaccatcaggagcgcctggaccgctggctgtcagactggttccagcggggagataagaatcaggacggtaagatgtcttttcaagaggtgcagagactgctccaccttatgaatgtggagatggaccaggagtatgccttcagtctgttccaggctgccgacaccagccaatctggcacactcgaaggtgaggaattcgtacagttttacaaggccctcacaaagagggctgaggtacaagagctctttgagtctttttctgcagacgggcagaaattaacgctgttagagttcctggacttcctgcaggaggaacagaaagagcgagactgcacctctgaactggcgttggaattaatcgatagatatgagcccagcgattcgggggcttcagaagaagaccccggagagggcgaagaggtcaacacgtag

SEQ ID NO: 30763 - DNA, 360 bp, Artificial Sequence
  Description of Artificial Sequence: Synthetic coding sequence
atggacaagaatataggggagcagttgaacaaggcctacgaggctttcaggcaggcatgcatggaccgagattctgcggtcaaggagctccagcagaagaccgaaaattacgagcaaagaattcgcgaacagcaagaacagctgtccttacagcagactattattgacaagcttaagtcacagctattactggtcaattcaacccaggataataattatggttgtgtccctttgttagaggattccgaaacaagaaaaaataatctcacattagatcagccccaggacaaagtgataagtggcatagccagggaaaagttgccaaaagtggacatcgcatccgccgagagctcaatttag

SEQ ID NO: 30764 - DNA, 1881 bp, Artificial Sequence
  Description of Artificial Sequence: Synthetic coding sequence
atgtgctcaacccttaagaaatgtggaacctacagaacagaggtggcagaatgccatgaccacggatccaccttccaggggagaaagaagggaggctcctccttcagggacaattttgataagcgcagctgccattacgagcacgggggatacgaacggccaccgtcacattgccaggagaacgatggctcagttgagatgcgtgacgtgcacaaggatcagcagcttcgccatactccctactctatccgctgcgagcggcgaatgaaatggcacagtgaggatgagattcggattacgacatggcgcaatagaaaacctccagaaaggaagatgtctcagaatacacaggacgggtatacacgaaactggttcaaggtgacaataccctatggcattaaatatgacaaggcctggctgatgaacagcattcagtcacactgctctgatcggttcacaccagtcgacttccactacgtacgtaatcgcgcatgcttctttgttcaggatgcgtccgcagctagcgctcttaaggacgtatcatacaagatctacgatgacgagaatcaaaaaatttgcatcttcgttaatcattccactgctccctattccgttaagaacaaactaaagcccggacaaatggaaatgctgaagctgaccatgaataaacgctacaatgtctctcagcaggctctcgacctccagaacctacggttcgaccctgacctaatgggtagagatatcgacataatcttaaaccggaggaattgtatggccgctacgctcaagattatcgaaaggaacttcccagagctgttgtccctcaatctctgtaacaataaactttatcagttagacggtctgagtgatattactgaaaaagctcccaaagttaaaacgctgaatctgtctaagaacaagctggagtcggcctgggaactcgggaaagtgaaggggcttaagctcgaggaactgtggttagagggaaatcccctgtgtagtaccttctctgaccagtctgcctacgtgtctgccattcgcgattgttttcctaagttgctgcgtctcgatgggagggaacttagcgcgcctgtcattgtggacatcgactctagcgagaccatgaagccctgcaaagagaacttcacagggtccgaaactttgaagcaccttgtgttacaatttttacagcagtactactcaatttatgacagcggggataggcagggactactcggagcatatcatgacgaggcttgcttctctctggctatccccttcgatcctaaggactctgctccctcctccttgtgcaaatatttcgaggattcaagaaacatgaagacactcaaggatccgtatctgaaaggcgaactgctccgcaggaccaaaagagacatcgtggattcgctgtccgccttaccgaagactcagcatgatctttcttccattttagtggacgtttggtgtcagacagaacgcatgctctgctttagcgtcaatggtgttttcaaagaagtggaggggcagagccaagggagtgtgctggccttcactcggactttcattgcaacccccggaagcagctcttctctatgcatcgtgaatgatgagctgtttgtcagggatgcctcaccccaggagacccagagtgcattctctatccctgtctcaactttaagctcatcctctgagcctagcctgagtcaggagcaacaggaaatggtccaggctttttcggcgcaaagtgggatgaagctggagtggagccaaaaatgcctgcaggacaacgagtggaactacacaagagcagggcaggcatttaccatgctgcaaaccgagggcaagatacctgccgaggcgtttaagcagatcagctag

SEQ ID NO: 30765 - DNA, 189 bp, Artificial Sequence
  Description of Artificial Sequence: Synthetic coding sequence
atggccatggccccatctccctctctggttcaagtgtataccagcccagctgccgtggccgtgtgggagtggcaggatggtcttggaacctggcacccttattcagccacagtgtgtagtttcattgagcaacaattcgttcagcaaaaaggtcagcgcttcggccttggaagtttagctcatagctag

SEQ ID NO: 30766 - DNA, 228 bp, Artificial Sequence
  Description of Artificial Sequence: Synthetic coding sequence
atgagattgagtctgcccctactgctcctcctgctaggagcttgggcaatacccggtggcctgggtgacagggcaccgcttacagctaccgcccctcagctggacgacgaggaaatgtacagcgctcacatgccagctcacttacggtgcgatgcctgcagggcggtggcttatcagaggctgtgtagttatccccctcatctgcccctgactgagcaacagtcctag

SEQ ID NO: 30767 - DNA, 2619 bp, Artificial Sequence
  Description of Artificial Sequence: Synthetic coding sequence
atgggggattcggatgacgagtacgataggcgacgcagagataaatttagaagggagcgatctgactatgaccggagccgagaaagagacgaaaggcgcagaggggacgactggaatgacagggaatgggatagggggcgtgagcggaggagtcggggagagtatcgtgattatgacagaaaccgcagggaaagattctcgccaccgaggcatgaactaagtcctccccagaagcgaatgcgacgggactgggacgaacactcctctgacccatatcactcaggctacgagatgccttacgcaggtgggggaggagggcctacatatgggccaccccaaccctggggtcatcctgacgtccatatcatgcagcaccatgtgctgccaatacaagccagactggggagcatcgccgagattgatctcggcgtgccaccgcctgtgatgaaaacctttaaggagttcttgctgtccctggatgactcagttgacgaaaccgaagccgttaaaaggtataatgattacaagctggactttcgccgtcagcaaatgcaagatttctttctggcccataaagacgaggagtggttcaggtcaaagtaccacccagatgaagttggaaagagacgacaggaagccaggggggctctccagaatcgcctgcgggtgtttctcagtctcatggagaccggctggtttgataatctgctgctggatatcgataaggcggacgcaattgtaaaaatgctggatgctgctgtcattaagatggaagggggtacagagaatgatcttcggatcctggagcaggaggaggaggaggagcaggccggaaagcctggcgagccttctaagaaggaggagggacgagcaggtgcagggttaggtgacggcgaaagaaagactaatgataaggacgagaaaaaagaggacggaaagcaagccgagaatgatagcagcaacgatgacaagaccaagaaatcggaaggcgatggagataaagaagaaaagaaagaagatagtgagaaggaggccaagaagtcctccaagaagcggaatagaaagcacagcggagacgactcttttgacgagggatccgtttctgagagcgaaagcgaatccgaaagtggacaggcggaggaagaaaaggaggaagcagaggaagctctgaaggaaaaggagaagcccaaggaggaggagtgggagaaacccaaggacgccgctggactggaatgtaagccacgtccccttcacaagacatgttctctctttatgagaaacatcgcgcctaacattagccgagccgaaatcatctctctgtgtaaaagatacccaggattcatgagagtagccctgtcggaaccacagccagagcgacgtttttttagacggggatgggttactttcgatcgttctgtgaacatcaaagaaatttgttggaatttgcaaaatatccggctgcgggagtgtgaactgtccccgggagtgaaccgcgatctcaccagacgagtgcgcaacatcaatggaattacacagcataaacagatcgtgagaaacgatataaaactggctgccaaacttatacacacccttgacgacagaacccaactctgggcctcagagccagggacccctcccctcccaacgtccctgccatcacagaaccccatcctgaagaacataaccgattatctgatagaagaggtcagtgccgaggaggaggaactgttggggagttctggaggcgctcctcccgaggaacctcccaaagagggaaatcccgctgaaattaatgtggagagggatgagaaattaatcaaggtattggacaaattgctgctgtacctgaggattgtgcatagcctggactactataatacttgcgaatatcccaatgaggatgagatgcccaaccggtgcggcatcatccatgtgaggggacccatgcctccaaataggatctctcatggcgaggtcttggaatggcagaagactttcgaagaaaaactcacccccctcttaagcgtgagggagagtctctctgaggaagaggcccagaaaatgggcaggaaagacccggagcaagaggtggaaaaattcgtaacgtcaaacacacaggaactgggtaaagacaaatggctgtgccctctgtcgggaaagaagtttaagggtccagaattcgttcggaagcatatttttaataagcatgcagaaaaaattgaggaggtgaagaaagaggtagcgttcttcaacaactttttaacagatgccaagcgacctgctttgcccgaaatcaaaccggcacagcctcccggaccggcacaatctctgaccccaggactaccctacccccaccagactccccagggcctcatgccatacggtcagccaaggccacctatcctgggctatggagccggagctgtgagacccgcagtgccaacagggggtcctccatacccacatgctccatacggtgcgggtagaggaaactacgatgcctttcggggacaggggggttatcctggtaagcccaggaatagaatggtccggggtgacccgagggcgatcgttgagtacagagacctcgacgcccctgacgacgtagattttttctag

SEQ ID NO: 30768 - DNA, 483 bp, Artificial Sequence
  Description of Artificial Sequence: Synthetic coding sequence
taacccgaggacgtacaggccctggtgagtggcaaactggccctccgctatgccggaaggcaaacagaggcgttgaaatgtgtggcccaggcaagcaagaataggagtctggccgactttgagaaggcactgactgactaccgcgctgaactgcgcgatgatcctattatcagcacacacttggcaaagctctatgacaatttgctcgagcaaaatctcatccgagtgatcgagccatttagtagagtgcagatagaacatatctcttccctcattaagctctcaaaagctgatgtggagcgcaaactcagccagatgatccttgataagaaatttcatgggatcctggaccaaggggaaggagtgctgatcatctttgatgagccacccgtggacaaaacgtacgaagccgctctcgaaacaatccagaacatgagcaaagttgtagattctctatacaacaaagctaaaaaactcacctag

SEQ ID NO: 30769 - DNA, 3906 bp, Artificial Sequence
  Description of Artificial Sequence: Synthetic coding sequence
atgtggaggagaaaacaccccaggaccagtggcggtacaagaggtgttttgagcggaaaccggggagtcgagtacgggagcggtcggggacatctgggtacatttgaggggagatggcgaaaactccccaaaatgcccgaagctgtgggcaccgacccatccactagccgcaagatggctgaactagaggaggtgactcttgatggaaaacccctgcaggcgctgcgggtcaccgacctgaaagctgcgctcgaacagaggggtctggcgaaatctggtcagaagtcggccttggtgaaaaggctgaagggtgccttgatgttggaaaacctgcaaaaacattctaccccacacgccgctttccaacccaatagtcagatcggtgaggagatgagccagaattccttcatcaagcagtacctggagaagcaacaggaactgcttaggcaaaggctggagcgagaagcacgtgaagcagcagagctggagggaaagagcagctctatctctgaagagaagggggatagcgatgatgagaagccgaggaaaggtgagagaagaagttccagggtgaggcaagctcgagccgcaaaactgtcagaggggagccaacccgctgaggaagaagaggatcaagagacaccaagtcgcaacctgcgcgtgagggcggaccggaacctcaagaccgaggaggaagaggaggaagaggaggaggaggaggaggacgacgaagaagaggagggagatgacgaggggcagaaatcaagggaagcacctattctcaaagaattcaaggaagaaggtgaagaaatcccacgtgtaaaacccgaggagatgatggatgagcgacccaaaactcgctcccaggaacaagaagtcctcgaacgcggtgggaggttcacgcggtcacaggaagaggctaggaagtcacacctggctaggcagcagcaagagaaagagatgaaaacgacctcacccctggaggaggaagaacgcgaaattaaaagctctcaggggcttaaggagaaatctaagagcccgtccccgcctaggctgacggaggaccgcaagaaagcaagtctcgtggcccttcccgagcagacagccagtgaggaggaaacaccgcctcccctcctgacaaaagaggcatccagccctccacctcatcctcagttgcattccgaagaggaaatcgagcccatggaaggtcctgcacccgctgttctcattcaactgagcccacctaataccgatgcggacacccgggagctcctggtctcccagcacaccgtgcagcttgtgggaggtttatctccactgagctctccatctgacacaaaggccgaatcgccggctgagaaggtgcccgaggagtcagtgctccccctggtccagaagtccactcttgccgactactccgcgcagaaggacctcgagccagaaagcgaccgctccgcgcagcctctccccttgaaaattgaggagctcgcattggcgaaaggaatcacagaagaatgtctgaagcaaccatcactcgagcagaaggaaggcagacgggctagccatacccttcttccttcccacaggctcaagcaatctgctgacagcagttctagtcgttcttccagtagctctagctcctctagccggagccggtcacgctcccccgacagctcggggagtcgcagccacagtcctctgcgctccaagcagagggacgtcgcccaggctaggacccatgccaatcccagagggagacccaagatgggctctagatcgacctcggaaagccgctcacgatccaggtctcgatccagaagtgctagctccaacagtagaaagagtctgagcccaggggttagtagggactcctctacttcatacactgagacgaaggatccatcttcgggacaagaagtggccacaccgcctgtgccccagctgcaggtttgtgaacccaaggagcggacaagtacatcatcatcctcagttcaggctcgcaggctcagccagcccgagagtgcagagaagcatgttactcagaggctgcagccggaaaggggctcacctaagaaatgtgaggccgaggaagccgaaccacctgcggcaacccagcctcagacatcagagactcagacttctcacctaccagaatctgaacgcatccaccatacagtggaggagaaggaggaggttaccatggatacctccgagaacaggccagaaaatgacgtgccggagcctccaatgccgatcgcagatcaggttagcaatgacgacagaccagaaggctcggtcgaggatgaggaaaagaaggagagctcccttcccaaatcttttaagagaaagattagcgtagtcagtgctactaagggcgtcccggctggcaatagcgacactgaaggaggtcaacctggacgcaagcgtaggtggggggcaagcacagcgacaacacagaagaaacctagcattagcataaccaccgaaagtctgaaatctttaatccctgacattaagcccctcgcgggacaggaagcagtggtggacctccatgctgatgacagccggattagtgaggatgaaacagaacggaatggagatgacggcacccatgataaagggctcaaaatttgcaggaccgttactcaggtagtgccagctgaggggcaagagaacggccagagagaagaagaggaagaggagaaagagcccgaagcagaacctcccgtgccaccacaggtttctgtggaggttgctctgccccctcctgcggaacacgaagtgaagaaggtgacactgggggatacacttacgcggcgaagcatctcacaacagaagtctggcgtaagcatcacaattgacgaccctgttagaacggcacaggtcccgtcacctccaaggggtaagatatctaacatcgtccatattagcaatctggtgaggccgttcacccttgggcagctgaaggaactactcggcaggactggcacccttgtggaagaagccttttggatcgacaagattaagagccattgcttcgttacttactccacagtggaagaggcagtcgccacccgcacagcactccatggagtgaaatggcctcagagtaatccaaaatttctgtgtgctgattacgccgagcaggatgaactggactatcaccgaggcctactggtggaccgaccctccgagaccaagactgaggagcaggggataccccgacccttacaccccccaccaccccctcctgtccagccccctcagcatcctcgggcagagcagagagagcaggagagagccgtaagagagcagtgggctgagagggagagagagatggaacggcgagagagaactaggtcagaacgggagtgggaccgggataaggtccgtgaaggcccacggtctcgctccaggagccgcgatagacggagaaaggaaagggccaagtctaaagaaaaaaaatctgaaaaaaaggaaaaggcccaggaggagccacctgctaaactgctcgacgacttattcagaaaaacgaaagccgctccctgcatatattggctccccttaacagattcacaaatagtccagaaagaggctgagcgggctgagagggcgaaggagcgcgaaaagcgtcgtaaggaacaggaggaagaggaacagaaagaaagggagaaagaagccgaacgcgaaaggaacaggcagttggaacgagaaaaacgtcgagagcactcaagagagcgcgatcgggagagagaaagggaacgtgagagggacagaggagatcgcgatcgcgaccgcgagcgtgatagggaacgcggaagggagagggatagaagagatacaaagaggcacagtaggagccgctcacgctccaccccagtgagggatcgcggaggccgtaggtag

SEQ ID NO: 30770 - DNA, 231 bp, Artificial Sequence
  Description of Artificial Sequence: Synthetic coding sequence
atgttgctcgagaatcttactgacaacgagagcgaaaacactaacctgaagaagaaggtttttgaaaaggaggctcacatacaggaactgtcctgtcttttccaaagcgagaagtctctcgaaaccaagatagccaaatggaacctgcagagccggatgaacaagaacgaagctatagtgatgaaggaggcatcacgacagaaaaccgttgcactaaagaaggcttcttag

SEQ ID NO: 30771 - DNA, 1749 bp, Artificial Sequence
  Description of Artificial Sequence: Synthetic coding sequence
atggaggtgcgggctagtctgcagaaggtgtccggaagcagcgactcagtggcaaccatgaactctgaggagttcgttcttgtccctcagtatgcggacgacaacagcaccaagcacgaggaaaaaccacaacttaaaatagtgtccaatggagatgagcagctcgaaaaagcaatggaggagatcttgcgggactccgagaagagaccttctagtctcctggtggattgtcaatctagcagcgaaataagcgaccattcctttggggacatccccgcatcccagaccaataagccctccctccagttaatactggacccatccaatactgaaatcagtactccacgcccaagcagccccggaggtcttcctgaggaagatagcgtgctgttcaataagctgacttacttaggatgtatgaaagtgtccagcccaaggaatgaggtcgaggccctccgcgcaatggccactatgaagtccagtagccagtaccccttccctgttacgctgtacgtgcctaatgtccctgaggggagcgtgaggattatcgatcagagctccaacgtggagatcgcctcattccctatttacaaggtgcttttttgcgcaagaggccacgacggtacgacagaatcaaactgctttgcctttacagagtcgagccatggttccgaggaattccagatacacgtattcagttgcgagattaaagaagccgtctcacgcatactgtattcattctgtacggcttttaagcggtcctctagacaggtctctgacgtgaaagattcagttataccaacgcccgattccgatgtgtttaccttttctgtcagcttagaagtgaaagaagacgatggaaaagggaacttcagacttctggtcattcctataccttttgagtatttcagcccagtgcccaaagacagagataaattctatttcaaactcaagcagggaatcgagaaaaaggtggtgatcactgtacagcaactatcaaataaagaactagccattgaaagatgctttggaatgctactttccccagggcgtaacgttaagaacagcgacatgcatctgttagatatggagtctatgggcaaaagctatgacgggcgagcttatgtcatcaccggtatgtggaacccaaacgcaccagtttttctggcattgaatgaagagacacctaaagacaaacaagtctacatgactgtagcagtggatatggtggttaccgaagtcgtcgaacccgtgaggtttctcctggaaaccgtggtgcgtgtgtaccctgccaatgagaggttctggtatttcagccgaaagacctttactgaaacttttttcatgagattgaagcagagcgaaggaaaaggacacactaatgcaggagatgctatttatgaagttgtaagcctgcagagggaatcagacaaggaggaacccgtgacacccactagtggagggggtcctatgagcccccaggacgacgaggctgaggaagaaagcgacaacgaattatcctccggcaccggtgacgtctctaaagattgtccggagaaaatactatattcctggggtgagctgctgggtaaatggcactctaatctgggagctcggcctaaaggcttgtcaacgctggtgaaaagcggggtccctgaggcattacgggctgaggtgtggcagcttttggccggttgtcatgataatcaggcgatgctcgatcgatataggatccttattaccaaatag

SEQ ID NO: 30772 - DNA, 138 bp, Artificial Sequence
  Description of Artificial Sequence: Synthetic coding sequence
atggatgccgactccgacgtggccctggacatcctgatcacgaacgtggtctgcgtcttcaggactcggtgtcatctaaacttgagaaagattgcactggagggcgcaaatgttatctacaaacgggatgtgggctag

SEQ ID NO: 30773 - DNA, 762 bp, Artificial Sequence
  Description of Artificial Sequence: Synthetic coding sequence
atggaggatgccccacagaggcttcgatggcaggcccatctggagttcacgcataatcacgacgtgggggacctcacttgggataagattgcggtgagccttcctcggagtgagaaattgcggtccctggtgctggctggaataccccatggtatgagaccccagttatggatgaggctctccggcgctctgcagaagaagcgcaatagcgaattgtcatatcgcgaaattgttaagaattccagtaatgacgagactatagctgccaagcaaatagaaaaggatctcctgcgaacaatgcccagcaatgcctgttttgcttccatgggctctatcggtgttccacgcctgagacgggtgctgagggctcttgcctggctctatcctgagatcgggtactgccagggaaccgggatggtcgcagcatgtctgctcctctttttagaggaagaagacgcgttttggatgatgagtgccatcattgaagacctgctaccagcctcctacttctcaacaaccttgctgggagtccagacagaccaacgggtcttacgacacttgatcgtacagtacttgccaaggctggacaaactcctgcaggaacatgacattgagcttagcctaatcacattgcactggttcctgacggcctttgcctccgtggtggacatcaagctactgctgcggatttgggacctctttttctacgaagggagtcgcgtgttgttccagctaaccctaggaatgttgcatttgaagtag

SEQ ID NO: 30774 - DNA, 336 bp, Artificial Sequence
  Description of Artificial Sequence: Synthetic coding sequence
tgaccattggttaaggttcagatcttcggggtcagactcgatacagcaaggcaagagaccaactacgtggagaataatgggtttaatccatactggggccaaacactgtgtttcagggtcttggtgcccgaactggctatgctgaggtttgtggtgatggattatgattggaaatcccggaatgacttcatcggacagtacaccttaccatggacttgcatgcagcagggctatcgccacatacatttgcttagtaaggatgggattagtctgaggcctgccagcattttcgtatatatctgcatccaggagggattagagggagatgagtcctag

SEQ ID NO: 30775 - DNA, 552 bp, Artificial Sequence
  Description of Artificial Sequence: Synthetic coding sequence
atgatgcagatatgtgatacctataaccaaaaacactccctgtttaacgccatgaacaggtttatcggggctgttaataacatggaccagaccgtcatggtacctagcctcttgcgcgatgtccctctggctgatcccggactcgacaatgacgttggcgtggaagtgggcggaagcggaggctgcttagaggagcgtacaccaccagttcccgactctggttctgccaatgggtcctttttcgctcctagcagggatatgtactctcattatgtcctgctaaaatcaatccggaatgatatcgaatggggagtgcttcatcagccaccaccaccagctggctcagaggaggggagtgcctggaagagtaaagacatcctcgtcgatctagggcacttggaaggggcagacgcaggcgaggaggatttagaacagcagtttcattaccacttgcggggtctgcacaccgtattgtctaaactaactaggaaagcaaatattcttaccaaccgctataagcaggaaattggctttggcaattgggggcactag

SEQ ID NO: 30776 - DNA, 1215 bp, Artificial Sequence
  Description of Artificial Sequence: Synthetic coding sequence
atgatgcttagcacggaaggaagggagggttttgtcgtgaaggtacgtggtttgccctggagctgcagcgctgacgaagtgatgagattttttagtgactgtaagatacagaatggaacaagcggtattcgctttatttacactcgcgagggcagacccagcggggaagctttcgtagagctggaaagtgaggaggaggtgaagttggccctaaaaaaggatagggagactatggggcacaggtacgttgaagtcttcaaatctaatagcgtcgagatggattggatgacactgccagtagacttccaaggtcgcagtacaggcgaggctttcgttcagttcgcttctcaggaaatcgccgagaaagcattaaaaaaacataaagaaagaattggccatagatacattgaaatcttcaagagctctagggccgaggtgcgtacgcactatgatcctcctaggaagctgatggcgatgcaacgacctggaccatatgaccgcccaggggcaggacggggttataattccatcggtcgcggagccggatttgagcggatgcgtaggggcgcatacggtggtgggtatggcggatatgacgactacggaggttacaacgatgggtatggcttcggctctgatcgctttggaagggacctcaactattgcttcagcgggatgagcgaccacaggtacggcgacggaggatcttccttccagtccactaccggacattgtgttcacatgcgaggacttccgtatagggctactgagaacgacatttacaacttcttcagcccccttaaccccatgcgcgttcacatcgagattgggcctgacgggagagtgaccggcgaagccgacgtggagtttgcgacacacgaagacgcagtggctgcgatggcgaaagataaggcaaacatgcagcatcgttatgtagagctattccttaactccaccgcgggaaccagtggaggggcttatgatcactcatacgtggagctgttcctcaactcaactgcaggcgcttcaggtggagcttatggctctcagatgatgggcggtatgggattaagcaatcagtccagctacggaggtccggcatcacaacagctttctgggggatacggaggtggatacgggggtcaaagttctatgtccggatatgatcaagtgctccaagagaatagtagtgattaccagtccaatttggcgtag

SEQ ID NO: 30777 - DNA, 1545 bp, Artificial Sequence
  Description of Artificial Sequence: Synthetic coding sequence
atgagcatttctagcgatgaggtcaactttcttgtgtaccgctatctacaagagtcaggttttagtcacagtgcgtttacgttcggcatagaatcccacatctcccagagcaatattaacggtgcactggtgcctcccgcagcccttatttctataatccagaagggtctgcagtacgtggaggccgaagtgagtatcaacgaagatggtaccctgttcgatggaaggccaatcgagtcccttagcttaattgacgcagtgatgcctgatgtggtccagactcggcagcaggcctacagggataagctggcacaacagcaggcagccgctgcagcggcagccgcagcggctgccagtcagcagggatcggccaaaaacggcgaaaacacggctaacggcgaggagaacggggctcacaccattgcaaataaccacacagacatgatggaagtagacggagatgtggagatacctcccaataaggcggtggtgcttcgaggacatgagagtgaggtgttcatctgtgcctggaaccctgtctccgatctgcttgccagtggaagcggcgattccacagccaggatttggaatctctcagagaattctacctctgggagcacccagcttgtcctccgccactgtatccgggagggaggccaagatgtgccctcaaataaggacgttacttccctggactggaacagcgaggggaccttgctggcaacaggatcttacgatggatttgcgagaatttggacaaaagacggcaacctggctagtaccttagggcaacacaaaggcccaatatttgctctaaaatggaacaaaaaggggaactttatcctgtctgctggagttgataagactaccatcatctgggatgcacacacaggcgaagcgaaacagcaatttccctttcatagtgcccctgcacttgatgtcgactggcaatccaacaacacatttgcgtcttgttcaacagacatgtgtatccacgtatgcaagctcggccaggaccggcctatcaagacattccagggtcatactaatgaagtcaacgccatcaagtgggaccctacggggaatctattagcctcttgctctgacgacatgactctcaagatctggagtatgaagcaggacaactgtgtgcacgacttgcaagcccacaataaagaaatttatactataaaatggtcgcctacgggacccggaacaaataatcctaatgctaatctgatgctcgctagcgcctcttttgattccacggtgcgcctctgggacgtggaccggggaatttgtatccatactcttacaaagcatcaagagccagtttatagcgtggcgttcagccctgatggtaggtatctggcctccgggagctttgacaagtgtgtgcacatctggaatacacagaccggggctctcgtgcattcatatcgcggtaccgggggtattttcgaagtctgttggaatgccgcaggggataaagtaggagcttcggcaagcgacggctctgtctgtgttctcgatctgcggaaatag

SEQ ID NO: 30778 - DNA, 2928 bp, Artificial Sequence
  Description of Artificial Sequence: Synthetic coding sequence
atgaaattcgtgtcagaggacctgcatcggtgtgccctcctgacagctgactccttcggcgacccattctttcctagaaccacgcaaatcctgctggagtaccagcttggacgctgggtgccaaggctgagggagcccagagacctatacggtgtgagcagcagcgggccattatctcccacaagatggccttaccattgcgaggtaattgatgagaaagttcagcacattgattggacccctagctgtcctgagcccgtgtatattcctaccgggcttgagaccgagcccctctatcccgactcgaaggaggctactgtagtgtatctcgcggaggatgcttataaggaaccctgtttcgtttactcccgtgtggggggaaacaggacacctctgaaacagccggtggattacagagacaacacattgatgtttgaagctaggtttgagagcggcaatctgcagaaggtggtgaaggtggcagagtacgagtaccagctgacagttagaccagacctgtttactaacaagcacacccaatggtactattttcaggtgaccaacatgagggcaggtatagtttaccgctttacaattgtcaacttcactaaacctgcttcattatattcccgaggcatgcgtcctctcttttactctgagaaggaggcaaaggcacaccatattggctggcagcgcataggtgaccagattaaatactatcgtaacaacccagggcaggacgggagacattacttttcactgacttggacatttcagttcccacacaataaggatacatgctatttcgcgcactgctacccctacacatacacgaacttgcaagagtatctgagcggcatcaacaatgatcctgttcggagtaagttttgcaaaatccgtgtactctgccatactttggcgaggaacatggtgtatattctcactattacaacccccctcaaaaacagcgactccaggaagaggaaagcagtcatcctgaccgcccgtgtccaccccggagagacaaattcctcgtggattatgaagggatttctagactacatccttggtaacagttcggacgcgcaactgttgcgggacacattcgtgttcaaggtggttcccatgttaaatccggacggtgtcatcgtggggaattatagatgttcactggccggtcgcgatcttaatcgcaattatacttccctgcttaaggagtccttccctagcgtctggtacaccagaaacatggtacatcgcctcatggagaaacgcgaagtgatcctctactgcgacctccacggccactcacggaaggaaaacatttttatgtacggctgcgatggtagtgaccggagtaagactctgtacctgcagcagcgcatcttcccactaatgctgtctaaaaattgcccggacaagttctccttcagtgcttgcaagtttaacgttcaaaagtccaaggagggcacgggaagggtggtgatgtggaaaatgggcatcaggaactctttcactatggaagcgacattctgtgggtcaacactggggaacaaacgcggaactcactttagcacaaaagacttggagtccatgggctatcacttctgcgatagcctgcttgactactgcgatcccgaccggacaaaatactacagatgcctgaaggagctggaggaaatggaacggcacataacgttggaaaaggtttttgaggatagcgatacaccggtaatcgacatcacgctggatgttgagagctcctccagaggcagcgacagctccgaaagcattgactcattgacgtacttgttgaagctgacaagccaaaagaaacatttaaagaccaagaaggaaaggaattctacaatcgcaagccaccagaacgccagaggccaagaggtgtacgatcggggtcacttactgcaacgacatacccagtctaactccgacgtcaaggataccaggcccaacgaaccagatgattacatggtggactattttaggcgacagctgcctaaccaggggctggcccattgtaagctgcgattacccggtagtaggcacagccccgctagcgctagccgagtggcaggcaccacaggcaccaggcaccacacatggcttatatttgtcttccttgtggaaatgggaaagaaaattccgttgaaaggcactgatttatatggtaactgctttaaggtgacttctttgcaaagcccgatgggaaagcaaacttccacatggactgagaagactaggatccctacagaggacctccaccataatctgaagtctaaaataaaggagtgtatctcattccagtccaagaagacaggcatcaactggacggatgatgagaaacggagttacaaggataaagggatagtgcagacccaggaaattttacagtacctgctgcctattgtgcacagcactaaaaacatgcagactacccagattaagcaactattcaaccctaggaccaattttcaaatacaacaccagctgaatcccgctacgtgtcgcaacatcaaaaagtatagcactagctggactgcacccaggaaccatccctttgtgattcagggggatgtgatggcaaattcatctgagtgggttcagtcaaaaccacataggtccctggagagcctatcacctttgaaaggccctaagaaaaacaaacactcgcagatctgggccattaaaaatgaggacataaaacctctctccagtaagtgggagacagcctcctccagctttggaatggacgctaatgtcctgaagtataaatccttacaggccgaggagacgaaccagcaaagtagtaaacacaccgccctgcatctcacaaaaaataaagatgagcaagcaaataagaatgatggccagcctaccctgtaccttaagttccagcgcgagtcctag

SEQ ID NO: 30779 - DNA, 1626 bp, Artificial Sequence
  Description of Artificial Sequence: Synthetic coding sequence
atgagcagcagcggatatcctccaaaccaaggcgctttctccacagagcagagtaggtacccaccacattccgtgcaatacactttcccgaatacccgacaccaacaggaattcgcagtgcccgattacagatcatcccatttagaggtgtcccaggcaagtcagctcctccagcagcagcagcagcagcagctgcgcaggaggccctcgctgctgagcgagtttcacccaggctccgatcggcctcaggagcgaagaacgagttacgagccatttcatcctggtccctctcctgttgaccatgatagtctggagagtaagcgaccgcgacttgaacaagtctccgattcgcactttcaacgggtgtccgcagccgtgttaccactcgttcacccgcttcctgaaggccttagggcatccgccgatgctaagaaagatcctgcatttgggggaaaacatgaagcaccatcctcaccaatctcaggccagccatgcggcgatgaccagaacgcgtccccttccaagttatctaaggaagaacttattcagtctatggacagagtagacagggagatcgctaaggtcgagcagcaaatcttaaagctcaaaaagaaacagcaacagctggaggaagaagccgctaagcccccagaacccgaaaaaccagtcagcccacccccagtcgagcagaaacatcgttcaattgtgcaaatcatatacgatgaaaacagaaagaaagccgaagaagcacacaagattttcgagggattgggacccaaggtcgagctgccactctacaaccagccctcagatacaaaggtgtaccacgagaacatcaagaccggagtgccggcacgtcggatgatgaagaaccaggtgatgaggaagaagcttatcctattttttaaaagacgtaatcacgccaggaaacagagggaacagaaaatttgtcagcgctatgaccagctgatggaagcctgggaaaagaaggttgacagaatcgaaaacaacccacgaagaaaggctaaggagtccaagactcgggagtattacgaaaaacaattcccggagatcagaaagcagcgcgagcaacaggaacgattccaacgcgtgggtcagcgcggagcaggactaagcgccacaatcgctaggtctgagcacgaaataagcgaaatcatcgacggcctgagtgagcaagagaataacgaaaagcagatgcggcaactcagtgtcattccaccaatgatgttcgacgccgagcagcgtagggtaaagttcatcaacatgaatggcctgatggaggaccccatgaaggtctataaagataggcagttcatgaacgtgtggaccgatcacgaaaaagagattttcaaggataagttcattcaacacccaaaaaattttggactaattgccagttatctagagcgcaagagcgttccggattgtgttctgtactactaccttactaagaagaacgagaattataaggctctggtacgacggaactacggtaaaaggagaggtcggaaccagcagatcgctaggccctctcaggaggaaaaagtggaggaaaaagaagaggacaaagccgaaaaaacggaaaaaaaggaggaggagaaatag

SEQ ID NO: 30780 - DNA, 840 bp, Artificial Sequence
  Description of Artificial Sequence: Synthetic coding sequence
atgaaattcccttttctccccatcctggtaatgaagttcattgaaaaggcccagaatatgtccaaatatgtgttgattgacaccccagggcagatcgaggtattcacatggtcggccagtgggactatcatcaccgaggctctagctagctcatttccaacagtggtaatctacgtgatggataccagcaggagtaccaatcccgtcactttcatgtccaatatgctttacgcttgttccatcttatacaagaccaagcttcccttcatagtggtgatgaataagactgacatcattgatcactccttcgccgtcgagtggatgcaggactttgaagctttccaggatgctctgaaccaggagactacatacgtaagcaatttgacccgctctatgtcgctcgtgttggacgagttctattcaagcctgcgagtggtcggcgttagtgccgttttaggtacaggcctagatgagctcttcgtgcaagtgacatctgctgctgaagaatatgaacgggagtaccggcctgagtacgagcgcttgaagaaatccctggccaacgccgagagtcagcagcagagagagcagctagagagactgcgaaaggatatggggagcgttgctttagatgccggaacagccaaggattccctcagtcctgtgctccacccatctgacctgatcctgactcggggaactctggatgaagaggacgaagaagccgactcagatacagacgacatcgaccatcgagtgacggaggagagtcacgaagagcctgctttccagaacttcatgcaggaaagcatggcgcagtactggaaacgcaacaacaagtag

SEQ ID NO: 30781 - DNA, 1230 bp, Artificial Sequence
  Description of Artificial Sequence: Synthetic coding sequence
atgaaggacactcaagatatccaagaagcttctaaggctatgcagaataaagtccacgagcaggaagataagaatgagaaacagaagcaaagggaagataagttaggcgtgtactcactcgtgcacttcagtcctaaaatgctaggctcagtggccacaacactgcccctgtcttcttcaaactcttccgggatgcccctgggctactacctatcctctcctcagattagccgagtgactatctccaccactggccaacttacttccaaggccaccgtggggagttgttctcgcgttgagaactcgcttgacgccagccccttctccgtgccgaagaagcaggatgaatctccaatgataggcgacggcgaagattattttttgtcattgttcggtgactctaagaaactgacggcacactccaactatacccaaaagaccctgaagtatttcagtatgattttggaggaggtgggccagttcacgtcaagctctctaggcgacgtggagatcgcagaggtgaacgtgaagggccttttcgtgaagctgattaactcctcacttgacaaggaaatggcaatcggcgatcacatcctccagcagaacgtgaacggacaaacaatctccctgtaccgctttctgccaaacattgtgatgcaggcaaactccactgtcaccgtatgggccgcagcaagcgaggccaagcaccagcctccttcggattttctatggaaagagcaggataagtttagagcttccccagactgcataaccatactgtgtaaaccaaatggccaggccatcgcgtggtatacacctatccactggaaacaggcatgggaaaaacttgacgccgacgtggagtttaaccgatgttccgtagtgtcgcctactttccgaaagagggtctttcagtggactgcttctaccgccaccatcactaaggaaaagcaggaccagcccaaaaaagacatttcaaattaccaggtggagcaggctcaggtcctgttgaagagggaaaaggagatcccccctacagtttttcctaatcggtctccctggtgtcagaatccatacgtttcagcccacccgtattgcccactgatcgagccccacaataccagcactgccggtggcaggctggaccgccagccacggacacgtagtacacgccctaatcgcgcttctgggtccaaaaaaaagaagacctcagaatctcagaaacagtag

SEQ ID NO: 30782 - DNA, 2442 bp, Artificial Sequence
  Description of Artificial Sequence: Synthetic coding sequence
atgtccgaacagggtgatctcaaccaggctatcgcagaggagggcggtacagagcaagaaacggctactcctgagaacgggattgtgaagagtgagtctttggacgaagaggagaagttggagctccagcggagattggaggctcaaaatcaggagagacggaagtcgaagtcaggggctggaaagggcaaactgactcgctcattggctgtctgtgaggagtcttcagctcgcccaggcggagagtcactccaggaccaggagtctatccaccttcaactgtccagtttcagcagtctgcaggaggaggacaaatctcggaaagacgatagtgagagggagaaggaaaaagataagaacaaagacaagactagcgaaaagcccaagattcggatgctgtccaaggactgttcccaggagtataccgacagcaccggtatcgatctccatgagtttctgattaacacacttaagaacaacagtagagataggatgattttgcttaagatggagcaggaaataatagactttattgccgataacaataaccactacaagaaattcccccagatgtcttcatatcagcgtatgctcgtacaccgggtggcagcatacttcggcttagatcacaacgttgaccagaccggaaagtcggttatcattaataagacatcatctacacgcatccctgagcagcgcttttgtgagcatctgaaggacgagaagggggaggagtcccagaagaggttcatcttgaaacgagataattcttcaattgacaaagaggacaatcagtcggtttgctcacaagaaagtctgttcgtggaaaatagccgcctattagaggattccaatatatgcaacgaaacctacaaaaagcgccagttgtttcgcggaaatcgcgacggaagcgggagaacctcaggcagccgccagagtagtagcgagaatgaattgaaatggagcgatcaccagcgagcgtggtcaagcaccgatagcgactcctctaatcgaaacttgaagccagcaatgaccaaaaccgcgagttttggaggcatcactgtgctcaccaggggagatagcacttcctccaccagaagcacaggcaagctttcgaaagcaggctcggagagctcctcatccgccggatcttccggctcactcagtcggacacatccgccactgcagtcaacaccactggtgagtggcgtcgccgctggcagccctggttgcgtgccgtatccagaaaatggaattgggggtcaagtagcaccttcatctaccagctacatcctcctcccactcgaagcagccacaggcattccacccggttccatccttctaaacccccacacagggcagccctttgttaaccccgacggtacccctgctatttacaacccgcctaccagccagcaacccttacgctcggcgatggtgggtcaatctcaacagcaacctccacagcaacagccaagccctcagcctcagcagcaggtccaaccaccccagccccagatggcaggcccactcgttacacaatccgttcagggcttgcaggcctccagccagtccgttcagtatccagccgtcagttttccccctcagcatttgctgccagtttcgcccacccagcatttccctatgcgggatgatgtagccactcaatttggacagatgacactttctcggcagtcgtccggagaaacacctgagcctccttcagggcctgtctaccccagcagcctaatgccccagcctgcccagcagccttcatacgtcatcgctagtaccggccagcagctgcccacgggaggatttagcggcagcgggcctcctatctcgcaacaggtgttgcagcctcccccatctccccagggcttcgtgcagcagcctccgccagctcagatgcctgtgtattattatccttcaggtcaataccctacttctacaacacagcagtatcgtcctatggcaccagtgcagtataacgcccaaaggtcgcagcagatgcctcaagctgctcagcaggcaggctaccagccagtgctgtctgggcagcagggcttccagggtctcattggtgtccagcagccaccccaaagtcagaacgtgatcaacaaccaacagggtactccagtccaaagtgtcatggtgagctatcctaccatgtctagttaccaggtgcccatgacacagggctcgcagggcttgccacagcagagctatcagcagcctattatgctcccgaaccaggctgggcagggctccctccccgcaacaggcatgccagtttattgtaacgtaaccccaccgaccccgcagaacaacctacgcctcatcggccctcactgcccctcatcaacggtgcccgtgatgtcagcttcatgcaggaccaactgcgcctcaatgtctaacgccggatggcaggtgaaattctag

SEQ ID NO: 30783 - DNA, 1773 bp, Artificial Sequence
  Description of Artificial Sequence: Synthetic coding sequence
atgccatctcctcagctgttggtgttgtttggaagccagacggggactgcgcaggacgtaagcgaaagactgggccgagaggccaggaggcggaggcttgggtgtagagtacaggcactagatagctatccggtggtgaacttgataaacgagccactggtcatctttgtctgcgctacaacgggacaaggagacccgcctgataacatgaagaatttctggcgctttatttttcggaagaatttaccatcaactgcactttgccagatggacttcgccgtgctgggactaggagattctagttatgccaagtttaattttgtagccaaaaagctgcacagacggctgctccagctcggcggatccgcactgttgcccgtatgcctgggtgacgatcagcatgaactagggcctgacgccgcagtcgatccttggttgagagacctctgggaccgcgtccttgggctgtaccctcctcccccaggcctgacggaaatcccccctggagtgccactgccttcaaaattcactctgctcttcttgcaagaggcaccctctactggcagcgaggggcagcgcgtggctcatcccggaagccaggagccgccaagcgagagtaaaccatttctggcgcctatgatcagcaatcaacgggttaccgggccaagccacttccaggacgtgcggctcatcgagtttgacattttaggctccggaatttcattcgccgcaggggacgtggtactgattcaacccagcaactccgccgctcacgtgcagcggttctgtcaggtactgggccttgaccctgatcagctctttatgttacagccacgggagcccgacgtgtcttctcctacaagactgcctcagccctgttcgatgagacacctagtgtctcattacctggatatcgcttccgtgcctaggcgttctttttttgagcttctggcgtgcctcagtctgcatgagctcgaacgggaaaagctgctggaattttctagtgcgcagggacaggaagagctcttcgagtattgcaaccgaccaagacgcactatcctggaagtgctgtgcgatttccctcatacagccgctgccattcctcccgactacctgctggacctcatccccgtgattagaccaagggcattcagcatcgcatcctcacttctgatcttggtggcggtggtacagtttcaaacaaggctaaaggagcccaggagggggctgtgttctagttggttagcatcgctagaccccggacagggccctgtgcgggtccctctgtgggtgagacccggatctctcgcattccccgaaacaccggacaccccggtgatcatggtagggccagggaccggagtggcgccttttcgggctgccattcaggaacgcgtggctcaaggccaaaccggcaatttcttgttttttggctgcaggtggagggaccaggacttctactgggaagcagaatggcaagaactcgagaaaagagactgcctcaccctaatccccgcattcagccgggagcaggagcagaaagtgtacgtgcagcaccgcttgagagagctgggttctttggtgtgggaactcctggacaggcaaggtgcctacttctatcttgcaggaaatgctaagagcatgccggcagacgtatctgaagctcttatgtcaatcttccaggaggaaggcggactgtgctcccccgacgctgctgcgtaccttgctcgattacagcagactaggagatttcagacggagacatgggcctag

SEQ ID NO: 30784 - DNA, 2436 bp, Artificial Sequence
  Description of Artificial Sequence: Synthetic coding sequence
atgccattgtccagtcccaatgccgctgccactgcatccgacatggacaaaaattcaggttctaactcctccagtgcgtccagtggctcatctaagggacagcaacctccacgaagtgcctccgctgggccagccggtgagagcaaaccgaaatccgacgggaaaaattcgtcaggcagtaagcgctacaatcggaagcgcgaacttagctacccgaagaacgaatcgtttaacaaccagtcacgccgaagcagctcacagaagtcgaagacattcaataagatgccaccccagcggggtggcggatcttctaagctcttttcctcgagcttcaatggcggacggcgagatgaggtcgcagaggcacagcgggctgaattttccccagcgcaattctctggtccaaaaaagattaatcttaaccaccttctaaattttacctttgagccccgtggtcagactggccatttcgagggtagtggtcacggcagttggggtaaacgtaacaagtggggacataagccatttaataaagaactgtttctgcaggccaattgtcagtttgtggtgtccgaggaccaggattacacagcacactttgctgaccccgataccctggtgaattgggactttgtagaacaggtgagaatatgttcgcacgaggtccctagttgccccatttgtctgtacccaccaactgccgcaaaaatcactcggtgcgggcatattttctgctgggcctgtatcctgcactatcttagcctgtccgagaaaacctggtccaaatgtccaatctgttatagctccgtgcataagaaagacctgaagtctgtggtggctacagagtcccaccagtatgttgtgggggacacgattactatgcagctaatgaagagggagaagggtgtgctcgtcgcactgccaaaatcgaagtggatgaacgtcgaccaccctattcatctgggcgacgagcagcacagccaatactctaaattgctgcttgcgtccaaggagcaggtgttgcacagagtggtcctagaggagaaggttgccctcgaacaacagctcgccgaagagaaacacactcccgaaagctgttttatcgaggctgctattcaggaactcaaaacacgggaggaggccctcagcggactggccggaagccgcagggaagttacaggtgtcgtggccgcactagagcaactggtgctaatggctcctttggccaaggaatccgttttccagccaagaaagggcgttctcgagtatctctctgccttcgacgaagaaactactgaggtatgctcactcgacaccccctcccgccctctcgcgctccccctcgtagaagaagaagaagcagtgtcagagccagagccagaaggcctccctgaggcgtgcgacgacctggaactggcagatgacaacctcaaggaaggcaccatttgtaccgaatcttctcaacaggaaccaatcactaagtcgggcttcacgcgcttgagctcttccccttgctattacttctatcaggccgaggatggacagcacatgtttctacatcctgtcaacgtgagatgcctggtgagggagtacgggagtctagaacggtcccctgagaaaataagcgcaaccgtcgtagaaattgcaggatacagcatgagcgaggacgttaggcagcggcataggtacctctctcatcttcccctgacttgcgagttttccatttgcgagctggcgttacaaccacccgtggtgagcaaagagaccctggagatgttctcagatgatattgagaagagaaagcgtcagcgccaaaaaaaagctagggaagagagacgaagggagcgacggatcgagattgaggagaacaagaaacaaggcaagtaccctgaagtgcatatcccattagagaatctgcagcagttccctgcctttaactcatacacctgctccagcgactccgcactgggcccaacttctactgaagggcacggagctctgagcattagccccttgtcccgttctcctggcagccacgcagattttttgctcacaccactcagtccgacagcctctcaagggagtccatcattctgtgtaggcagcctggaagaggactccccttttccctccttcgcgcaaatgctgagagtgggaaaggccaaggcggatgtctggcccaagacagcgccaaaaaaggatgagaacagcctggtacctccagcacctgtagattctgatggagagtcagataattccgaccgggtgcccgttccatcctttcaaaacagcttctcccaggccatagaagctgcatttatgaagctggataccccagcgacctcagatcccttatctgaagagaagggcggaaaaaagagaaagaaacaaaagcagaagctgcttttctcaacttcagtggtgcacacaaagtag

SEQ ID NO: 30785 - DNA, 189 bp, Artificial Sequence
  Description of Artificial Sequence: Synthetic coding sequence
atgcccgagatcagggtcacccctcttggtgcctgccctgtgctgagctggaaccttgtgctgccccctgggagggggagcagggcacctagctctaccgacactcggactggctttcacgtgcttccccatggtgtgtctgccagctctgagggcgctcctagaccaggggtggacaccgttctgtag

SEQ ID NO: 30786 - DNA, 948 bp, Artificial Sequence
  Description of Artificial Sequence: Synthetic coding sequence
atgtcgggactcgtcttgggccagagagacgagcccgcaggacaccgattatctcaagaggagattctgggatcgacacggttggtgtctcaagggctagaggctctgcggagcgagcatcaggctgtccttcaaagtctgtcgcagacaattgagtgtctgcaacagggaggccacgaagaaggactggtgcatgagaaggctcggcagttgcggagatcaatggagaacatagaactgggtttgtccgaagctcaagtgatgttggccctcgccagccatctgtccactgtggagtccgaaaaacagaagctaagagcacaggtccggaggctgtgccaagagaatcagtggctcagagacgaactagctggcactcagcaaagacttcagagaagtgagcaggcagtcgcacaattggaggaggaaaagaagcatcttgagtttctggggcagttgaggcagtatgacgaggacggccatacatccgaagaaaaggagggcgatgcaacaaaagacagcctcgatgacctgtttccgaatgaggaagaggaggacccgtccaacggactttccagaggacagggcgctaccgccgcacagcaaggcggatacgagatccccgcacgcttgcgtacactgcacaacctcgtgattcagtatgccgcacagggtagatacgaagttgctgtgcctctctgtaagcaggcactcgaagatctggagcgaacctcggggcgaggacatccagatgtggccacgatgctcaacattctagcgctggtgtatagggatcagaacaaatacaaggaggccgctcacttattgaacgacgctctttctattcgggaatcaacactagggccagaccaccctgctgtctcaatcccttgtcccccacacccgactccaaggacaccacaccattgctgttttgggctgtcctag

SEQ ID NO: 30787 - DNA, 2055 bp, Artificial Sequence
  Description of Artificial Sequence: Synthetic coding sequence
atggagaacctgcaaactaatttttcactcgtgcagggatcgacaaaaaagctgaatgggatgggggacgatggctcgccacctgccaaaaaaatgatcaccgacattcacgccaacgggaaaactatcaacaaggtgcctactgtaaagaaagagcacttggacgattacggagaagcgccagtggaaactgatggggagcacgtaaagcggacctgcacatccgtccccgaaactctacacctgaaccccagtctgaagcacactctcgcccagtttcacctgtcgagccagtcttccctggggggtccagctgcattttccgcacgtcactcccaggaaagcatgtcacctacagtattcctaccgctgccaagcccacaggttctacctggacctctgctgatcccaagcgatagctcaacagaactgactcagacagtgctggagggagaatcaataagctgcttccaggtgggtggcgaaaaacgtttgtgtctaccacaggttcttaacagcgtcctcagggagtttactctgcagcagatcaacactgtgtgtgacgagctgtacatttattgcagcagatgcacctctgatcaactacacatcctgaaggttctagggatactacctttcaacgcaccttcttgtggactgataacacttacagacgcacaaagactgtgcaatgccctccttagaccccgtacatttccccaaaatggctccgtgctccctgcaaaatcttctctcgcccagcttaaagagacaggctccgcattcgaagtggagcatgaatgcctcggtaagtgtcagggactgtttgcccctcagttctacgtgcagcccgatgccccatgcatccaatgccttgagtgttgcggcatgtttgcacctcagacattcgtcatgcacagccatcgcagcccggataaacgtacatgtcattggggattcgaaagtgcaaaatggcactgttacctgcatgtgaaccagaaatatctcggcactcctgaagaaaaaaagctgaagattatcctggaagagatgaaagagaagttctctatgcggagcggaaagagaaaccagagtaagaccgacgccccatcaggcatggagctccaatcctggtacccagtaataaagcaggagggggatcacgtatcccaaacacatagcttcctccacccctcttattacctctatatgtgcgataaggtagtcgccccaaacgtctctctgacgtcagcggtttcacagagtaaagagctcacgaagaccgaggctagtaaaagtatctctcgccagtcagagaaagcccattcctcaggcaaactgcagaaaacagtgagttaccccgatgtctccctggaggaacaagaaaaaatggacttgaagacgtcacgtgaactgtgtagcagacttgacgcaagtatttccaacaattctactagcaagcggaagtccgagagcgccacatgcaatctggtgagggacataaacaaagttggcattggcttggttgccgcagccagctccccactcctcgttaaagatgtcatctgcgaggacgacaaaggtaagatcatggaagaggtgatgaggacatacctgaaacagcaggagaagctgaatctcattttgcagaaaaaacagcaactgcagatggaagtcaagatgctatcctcttcaaaatcgatgaaggagttgactgaagaacagcagaacctgcaaaaggagctagagagtctgcagaatgagcatgcgcaaaggatggaggagttttacgtagagcaaaaagacctggaaaaaaaactcgagcagatcatgaagcaaaaatgcacctgtgattccaacctcgaaaaagacaaggaggcagagtacgccggacagctggccgaacttagacagaggttagaccacgctgaagccgaccggcaagagcttcaggatgagctgcgccaggaacgtgaggcccgacagaaattggagatgatgatcaaggagctaaagctccagattctgaagtcatctaaaaccgcaaaggaatag

SEQ ID NO: 30788 - DNA, 4050 bp, Artificial Sequence
  Description of Artificial Sequence: Synthetic coding sequence
atggaggaaaacgagtcccaaaagtgtgagccatgcctgccctattctgctgataggcggcagatgcaagagcaaggcaagggcaatcttcatgtcactagccctgaggatgcagagtgccggagaacaaaagaacggttgtctaacgggaactcgaggggatctgtgagcaagtcaagccgaaatatcccgcgacgccatacgctgggcggacctcggagcagcaaggaaattctgggcatgcagaccagcgagatggatcgcaagagggaggcctttctcgagcaccttaaacagaagtatccacatcatgctagtgcgattatgggacaccaggagaggctgcgcgatcagaccaggagcccaaagctgtcgcactccccccagcccccatcattaggggaccccgtggagcatctgtcagagacctctgccgattctctggaggctatgtccgaaggcgatgccccaacaccgtttagccggggtagccgcacgcgcgctagcctgcctgtagtgcggtctactaatcaaaccaaagaaagatctctgggcgtgttatatctccagtacggcgatgagactaaacagctgaggatgcctaatgaaattacttcagccgacaccattagagccctgtttgtgtcagctttcccccagcagttaaccatgaaaatgttggagagcccttctgtggctatttatatcaaagatgagtcccgaaatgtgtactacgagctaaatgacgtgaggaatattcaggatagatccttgttaaaggtgtacaataaggaccctgcgcatgccttcaatcacacgccgaaaaccatgaatggtgatatgcggatgcagcgggaactggtttacgcccgtggcgatgggcctggggcacccagacccggttccacagctcatcctccacatgctattccgaactcccccccatcaacacctgtgcctcatagtatgccgccaagcccatcacgaatcccatacggcggaacacgctcaatggtagttccagggaacgccactatccctcgcgatcggatatcttccctccccgtgtcaaggcccatctcaccgagcccgagcgccatcctggagcggagagatgttaaaccagatgaggatatgagtgggaagaacatcgccatgtaccgaaacgaaggcttctacgctgacccctatctttaccacgagggcaggatgtctatcgccagttctcacggtggccatccattggatgtgcccgatcacatcatagcttaccaccgcactgctatcagatctgcgagtgcttactgcaaccccagcatgcaggccgaaatgcacatggagcagtcactgtatagacagaagagcagaaaatacccagacagtcatctgccaaccctaggctccaaaacacctcctgcatctccccacagggtttccgatctaagaatgatagatatgcatgctcactacaatgcacacgggcctcctcacactatgcagccagatcgcgcttcaccatccagacaagcctttaagaaagaacctggtacccttgtgtatatagagaagccccgatccgccgctggcctgagtagcctggttgacctggggccaccgctgatggaaaaacaggtgttcgcatacagcactgccacaattcccaaagatagagagacaagtgagaaaatgatgaaaactacagctaaccgcaaccacacggactccgctggcacccctcacgtttccggcggtaaaatgctatccgcacttgaatccaccgtgccaccatcccagccacccccagtgggcacctcagccatacatatgagcctgctggagatgcgcaggagcgtcgccgagcttcggttacagctccaacagatgagacagttgcaactccagaaccaggagttattgcgtgccatgatgaaaaaggccgaattggagataagcgggaaggtgatggaaaccatgaagagactggaggatcctgtccagcgtcagcgggtgctcgtggagcaggagcgccagaaatacctgcacgaggaagaaaaaatcgttaaaaagctctgcgaactggaggactttgtcgaggatctcaagaaggactctaccgcggcttcgagactggtgacattgaaagatgtggaagatggagcatttcttcttaggcaagtcggtgaggccgtggctacactcaagggtgaatttccaactctacagaataagatgcgggcaatcctgcgtatagaagtcgaggccgtccgattcctcaaagaggagcctcacaagctcgattctcttctgaagcgagtccgaagcatgaccgacgtgctgaccatgcttcgaagacacgtgacagacggcctgttgaagggtacggacgcagcccaggccgcacagtacatggctatggaaaaggctaccgccgctgaagtgctgaagtcgcaggaagaggccgcacataccagtggccagccttttcacagtaccggcgctcctggggacgcaaagtccgaagtggtgcccctttctggcatgatggtccgccatgcccaaagcagccctgtcgtaattcagccatctcagcactccgtggctctgcttaaccctgcacaaaacctgcctcacgtcgcgtctagccccgctgtgccacaggaggcaaccagcaccctgcagatgtcgcaggcaccccagtccccacagataccgatgaacggtagcgcaatgcagagtctatttatagaggaaatacactcggtctccgccaagaaccgagccgtctctatcgaaaaagccgagaagaaatgggaggagaagcgacaaaacttggatcattacaatggtaaggagttcgagaaactactggaagaggcgcaggctaacatcatgaaatcaattccaaacctcgaaatgcctcctgctaccgggccactgcccaggggcgacgcccctgttgacaaagtggaactgagcgaagactctcccaactctgaacaggatctcgagaaactcggcggtaaaagcccaccgccaccccctccaccgcctaggcgctcttacctgcccggttcagggctgaccactacccgatctggggacgttgtgtacacaggccgaaaggagaacataacagcaaaagcctcctccgaagatgcgggaccaagcccgcagacccgcgctacaaaatacccagcagaggaaccagcctcagcttggactccctcgccaccccctgtgacaacatcatcctctaaagacgaagaggaggaggaggaagaaggagataagatcatggctgaactgcaggcttttcagaagtgctctttcatggacgttaatagtaactcccatgccgagccatcaagagcggattcccatgtcaaagatactaggtccggagcaacagttccgcctaaagagaaaaaggggtctagcggcgctccccagacatctcgcatgcccgtgccaatgtcagcaaaaaatagacctgggacccttgataaaccgggaaagcagtctaaattgcaggatcccagacagtaccggcaggctaatgggtccgccaaaaagagcggcggagatttcaagcctacttcaccctcactacctgcatcgaaaatcccagctttgtcccccagctccgggaagtcatcatctctgcccagcagctctggggactcaagtaatcttcccaatcccccagctacaaagccatccattgcatcgaatcccttatccccacagacaggacccccagctcacagtgcatcacttatccctagcgtgtccaacgggtccttgaaattccagtctcttacccatactggcaaaggccatcacctgtcatttagcccacagagccaaaacggaagggcacctcctccccttagcttctcttcgagcccaccatccccggctagttctgtgagcctgaatcagggggcaaagggcacccgcaccatacataccccctctctgacgtcgtacaaagcccaaaatggttccagctcgaaggccactcctagcaccgccaaagaaacatcctag

SEQ ID NO: 30789 - DNA, 177 bp, Artificial Sequence
  Description of Artificial Sequence: Synthetic coding sequence
tgaatcatccacaaactggctatgcaactccgccacataggtgataacatagatcatcgcatggtgcgggaagatttacaacaggacggtcgggacgctctcgatcattttgttttcttttttttccggagagtacaagtcctcctgcacttcttttggaacaatcacctgctgtag

SEQ ID NO: 30790 - DNA, 429 bp, Artificial Sequence
  Description of Artificial Sequence: Synthetic coding sequence
atgcccgaagaccaggtgggcaagctcgaagccacggaaaacactatctctgccatggctgcggctgctgcggagcagcagcagttctatcttctgctcggaaacctattgtctccggacaacgtggtccggaagcaggccgaagagacttacgagaacatcccgggacagtcaaagattacattcttgctccaggcaatacgtaacacgactgccgcagaagaagcacgccaaatggcggcagttttgcttaggcgtcttctgagcagcgctttcgatgaggtttacccggcactgcccagcgacgtacaaacagccattaaatccgagttgctcatgatcatacagatggaaacacaatctagcatgcggaagaaggtgtgcgatatcgccgctgaactggctaggaatttaataggtgtgtactag

SEQ ID NO: 30791 - DNA, 93 bp, Artificial Sequence
  Description of Artificial Sequence: Synthetic coding sequence
atgggcagccggaagaaggagatcgccctgcaagtgaacatttccacccaggaactctgggaggagatgctgtcttcgaagggactgacatag

SEQ ID NO: 30792 - DNA, 645 bp, Artificial Sequence
  Description of Artificial Sequence: Synthetic coding sequence
atggccggagaaaactttgccaccccattccatggccatgtgggccgaggagcctttagcgacgtatatgagccagccgaggatacgtttctgttgctcaacgccctcgaagccgctgccgctgagttagccggtgtggagatatgcctcgaagttgggagtggctcaggtgtcgtaagcgcgttccttgcttctatgatagggcctcaggccttgtatatgtgtacagatattaacccagaagctgcggcttgcacactggagacagccaggtgcaataaagtgcacattcagccggtcatcactgacctggtgaagggcctgcttccaaggctcaccgagaaggttgatttgctagtattcaacccaccttatgtggtgaccccccctcaggaagttggctcacacggcattgaggcggcatgggcaggagggaagaatgggcgagaagtgatggacaggttttttcctctcgtcccagacctccttagccctaagggtcttttctatttggtcacaataaaggagaacaatcccgaagagatacttaaaatcatgaagaccaaggggctccaagggacgacagcgctttccagacaggccggtcaggagacgctgtccgtgttgaaattcacgaagtcttag

SEQ ID NO: 30793 - DNA, 1158 bp, Artificial Sequence
  Description of Artificial Sequence: Synthetic coding sequence
atgggacgctggtgtcagactgtagcccgtgggcaaaggcctcgtactagtgctccttcacgggctggagccctgctgctgctgctgcttctcttacggtcagctggttgctggggggctggcgaagcgcctggtgctttgagcactgccgatcctgcagaccagtcggttcagtgcgtgcctaaagccacttgtcctagttctcggcctcgcctgctgtggcagacaccgaccactcagactctcccttcgactactatggaaacccagtttccagtctcagaagggaaagtggacccatatcgcagttgtggattcagctacgaacaggatcctaccctgcgggacccagaagctgtggccagaagatggccgtggatggtttctgtccgcgctaatggtacccatatctgtgcgggaacgatcattgcctctcagtgggtgctgacggttgcacactgtctcatttggagagatgtgatatactccgtccgggtcggatctccctggatagaccaaatgacccagaccgcgtcagatgtcccggtactgcaggtgataatgcatagtaggtatcgggctcaaaggttctggtcttgggtaggacaggctaacgatattggcctgctaaagctcaaacaagagttaaagtatagtaactacgtacggccaatatgtcttcctggcacggattacgtgctaaaagaccattctcgatgcaccgtcactggctggggcttgtccaaggctgatggtatgtggccacaatttcgcacaattcaagagaaagaggttatcatcctgaacaataaggaatgcgacaacttctaccacaactttacaaagattcctacattggtgcagattatcaagtctcaaatgatgtgcgcagaggacacccaccgtgaaaaattctgttacgaactgaccggtgaaccgttagtttgctctatggaaggcacctggtatctggttggcttggtgtcatggggcgctggctgtcagaaatccgaggcacctcccatctatttgcaggtgtctagctaccaacactggatctgggattgcctaaacggccaagctctagctttgcctgctcctagcaggaccctgttgcttgccttgcccctgcccttgagcctgctcgccgcactttag

SEQ ID NO: 30794 - DNA, 255 bp, Artificial Sequence
  Description of Artificial Sequence: Synthetic coding sequence
atgtccggacttgtcttgggtcagagagatgagccagccggtcacaggctatctcaggaggaaattttgggaagcaccagactcgtgagtcagggtttagaggctctgcgcagcgagcaccaagcagtgctgcaatcactgtcacagaccatcgagtgtctgcagcaggggggtcacgaggagggcttggtacatgaaaaggccaggcagctgcgcaggagcatggaaaacatagaactgggcttaagtgagtag

SEQ ID NO: 30795 - DNA, 483 bp, Artificial Sequence
  Description of Artificial Sequence: Synthetic coding sequence
atgtcagtgaactcggaaaagtcttcttcaagcgaacgacccgagcctcagcaaaaggccccacttgtacccccaccacctccgccacccccacctccgccacctccgctgcctgatcccactcctcctgagcctgaagaagaaattctggggagcgatgacgaggagcaggaagatcctgcagattactgtaaaggcggttaccatccggtgaaaataggcgacctgtttaacggcaggtaccatgtgatcaggaagcttggctgggggcattttagtaccgtctggttgtgctgggatatgcagggaaagcgctttgtcgcgatgaaagttgtgaagtcagcccagcactacactgagacagccctcgatgaaataaagcttctgaagtgtgttcgggagtccgatccttctgatcctaataaagacatggtggtgcagttaattgatgactttaaaatttctggtatgaatggcatatag

SEQ ID NO: 30796 - DNA, 66 bp, Artificial Sequence
  Description of Artificial Sequence: Synthetic coding sequence
atgaatcccgcttccgctcctccccctctaccacctccaggacagcaggtgattcacgtcacatag

SEQ ID NO: 30797 - DNA, 1212 bp, Artificial Sequence
  Description of Artificial Sequence: Synthetic coding sequence
atgagtggcagcgatgggggactggaggaagagccagagctctccattaccctcacactgaggatgctgatgcatgggaaggaagttggctccattatcggcaaaaagggagagactgtgaagcggattagagaacagtctagcgcgagaattaccatctctgagggctcctgccccgagagaattaccaccattaccgggagtacggctgccgtgtttcacgctgtttccatgattgcttttaaacttgacgaggacctctgtgcagctccggctaacgggggaaatgtgagcagacctcctgtgaccctgaggctggttatccctgcaagccagtgtggatccctgattgggaaggccggtacaaagattaaggaaattagggagacaactggcgctcaggtgcaggtagcgggagatttattacccaactccactgaacgggctgtaaccgtgagcggcgtacccgatgccattatcctttgcgtcaggcagatctgtgcggtgatactcgaatctccgccaaagggagctacaatcccttatcatccctctctgagtctcgggaccgttctgctcagcgctaatcagggattctcagtacagggacagtacggggctgtcaccccggctgaagttacaaagttgcagcaactatctagccacgccgttccattcgctactcctagtgtcgtgcctggactggatccaggaactcagaccagctctcaggagttcttggtccccaacgacctgattggatgcgttatcggccgacagggaagtaaaatatccgaaataagacagatgagcggggcacatattaagattggtaaccaggctgagggggctggcgaacgtcatgttacaattacaggcagccccgttagcattgctctcgctcagtacctgattaccgcatgtttggagaccgccaagtcgacttccgggggtacccctagcagcgcccctgcagatctgcctgcccctttctcccctcctctcactgcactcccaactgctcccccaggcctgctcggcactccgtacgcaatctccctgtcaaattttattggactgaaaccaatgcctttcctggcactccccccagcatcccctggtccgcctcctgggctggccgcttatacagctaagatggcagcagccaacggaagtaagaaggccgaaaggcagaagtttagtccatactag

SEQ ID NO: 30798 - DNA, 5105 bp, Artificial Sequence
  Description of Artificial Sequence: Synthetic coding sequence
atgggtaattccgactcacagtacacattgcaaggttccaagaaccactccaacaccattactggagccaagcagatcccttgttccctgaaaatacgcggaattcatgctaaggaggaaaagtctcttcacggctggggacatgggtcaaacggcgcaggttacaagtctcgttctctggcgagatcgtgcctgtctcattttaaaagcaaccagccgtatgctagtcggctcggcggacccacatgcaaagttagccggggtgtagcctacagtacacaccgaactaatgctcctggtaaggacttccagggtattagtgctgccttctccacagaaaacggattccactctgtgggccacgagctggccgacaaccatataaccagcagggactgtaatgggcacctgctaaactgctacgggagaaacgaatccattgccagcacacccccaggcgaggatagaaaaagccctcgagtgctgataaaaacactaggtaaactcgacggttgtctgcgtgtagagtttcataatgggggaaaccctagcaaggtgccggctgaagactgctcggagccagtccagttgctccggtactcccctactcttgcctccgagacatcgccagtgcccgaggccaggcgcggaagcagtgccgattcgctcccttctcatagaccgagccctactgattcccgtctccggtcttcaaaaggcagcagtctttcaagcgaatcatcttggtatgacagtccttgggggaacgccggtgaacttagcgaggcggagggctccttcctggccccaggtatgcccgacccctctttgcatgcttcctttccccctggagatgcaaagaaaccttttaatcagtcgtcttcgctgtcaagcctacgagagctctacaaggacgccaatctgggcagtttatctccttcagggatcaggctttcagacgagtatatgggaacgcatgcatccctgtcgaatcgggtttctttcgcttcggatattgacgtcccaagtcgtgtcgcgcacggggacccaatccagtacagcagcttcacactcccgtgcaggaagccgaaagcttttgttgaggacaccgctaaaaaggactccttaaaggcccgaatgcgcagaatatctgattggaccggatcactgtcccgtaagaagcggaagctgcaggagccccgttctaaggagggctcagactatttcgactctaggtccgatggccttaacacggacgtgcaggggtcctcccaagcaagcgcgtttctctggagcggcggtagtacacaaatactcagccaaagatctgaaagcacccatgcaattggctcagatcccctgcggcaaaatatttatgagaactttatgcgagagctggaaatgagtcggactaacaccgaaaacatagagacttcaaccgagacggctgagtcctcaagcgagagcctatctagtctcgagcaactcgatctactcttcgaaaaggaacaaggggtggtgcgcaaagccggatggctgtttttcaaacctctcgtgactgtccagaaggagagaaaattagagttggtcgcgcgacggaagtggaagcagtactgggtgacgctgaaaggatgcacactgttgttttatgagacgtacgggaaaaattctatggaccagtctagcgctcctcgatgcgccctgttcgcagaggattctatcgttcaaagtgtgccggagcatcctaagaaagaaaacgtgttctgcctgtccaactctttcggcgacgtgtacctcttccaggccacgtcccagacagatcttgagaattgggtcacagccgtccattccgcatgcgcgtcactgtttgctaaaaaacacggtaaagaggatacactgcgcctgttaaagaaccaaacaaaaaacctgctgcagaaaatcgatatggattctaagatgaagaagatggcagagctgcagctgtcggtggtttcagacccaaaaaacaggaaagccattgaaaaccaaatacaacagtgggaacagaatttggagaaattccacatggacctgtttcgcatgcggtgctatttggcctcactccagggcggagagctgccaaatcccaagtctctgctcgcagcggctagccgaccaagcaagctggctctcggaaggttggggatcttatctgtttccagttttcatgctcttgtgtgttcccgagacgattctgctctgaggaagaggaccttaagcctaacacagcgcggtagaaataagaaggggatattctctagtctcaaagggctcgatacactagcgaggaagggtaaagaaaaaaggcccagcataacccaggtggacgaactactgcatatctacggaagcactgtggacggggtgcctcgcgacaacgcgtgggaaatccagacttacgtgcatttccaggataaccacggggtgacagtcggcatcaaacctgaacaccgggtagaagatatcctcaccttggcttgtaaaatgcggcaactggagccctctcactatggccttcagctgcgaaaacttgtcgatgacaatgtggaatactgtattcctgccccatacgaatacatgcagcaacaggtttacgatgaaatcgaagtattccctctgaacgtgtacgatgttcaacttaccaagaccggtagcgtgtgcgatttcggattcgcagtgactgctcaggtggacgagagacagcatctctcacggattttcattagcgatgtgcttcctgatggtcttgcatatggagaaggcctgcgcaagggcaatgaaattatgaccctcaacggcgaagcagtaagtgacttggacctgaaacagatggaggcactgttcagcgaaaaaagcgttggcctcaccttaatagccagacctcccgatacaaaagccactctgtgtacatcctggagcgactcagacctgtttagccgagatcagaagagcctcctaccaccacctaatcagtcacaactgctggaggaattcctagacaactttaagaaaaacacagccaacgatttttccaacgtcccagacatcaccacggggctgaagagatcgcagacggacgggacattggatcaggtcagccatagggagaagatggaacagacctttcgctctgccgagcagatcactgccctgtgtcggtctttcaacgattcacaggcaaatggtatggagggcccacgagaaaaccaggacccgccaccccgttctctcgcaagacatctcagcgacgccgatagacttcgcaaagtcatccaggagttggtggacacggaaaaaagttacgtcaaagacttgtcttgtctattcgagttgtatctggaacctttacagaacgaaaccttcctcacacaagacgaaatggaatctctgttcggatcactcccggaaatgctggaatttcagaaggtgttccttgaaaccttagaggatggcattagcgcctccagtgacttcaacaccttggagactccatcgcagtttcgcaaactattgttcagcttaggcggatcctttttgtactacgcggatcatttcaaattatattctggtttttgcgcaaatcacattaaagtccaaaaagttctcgagcgggcaaagactgacaaagctttcaaagcttttctggatgccaggaaccccaccaaacaacattctagcacactagaaagctacctgattaagccagtgcaacgagtgttaaagtatccccttctcctgaaagagcttgtgtccctaacagaccaggagtctgaggagcactatcaccttacggaagctctgaaagccatggagaaggtggcatcccacataaacgagatgcagaagatctacgaggactacgggacagttttcgatcagttggtggccgaacagagtgggactgagaaggaggtaacggaactgtcaatgggtgagctgcttatgcactctactgttagctggcttaatccgttcctatcccttggaaaagcgcgtaaagacctcgaattgactgtgttcgttttcaaaagagccgtaattcttgtctacaaagagaattgcaagttgaaaaaaaagctgccttctaacagtagaccagctcataattctaccgacctggaccccttcaagtttagatggctgattcccattagcgctcttcaggtgcggttgggcaaccccgcaggcaccgaaaataattctatctgggagttaatccacacaaaatccgaaattgagggccgtcccgagacaattttccagttatgctgtagtgattcggaaagtaagactaatatcgtgaaagtcatccggtctatattaagagagaacttcaggaggcacatcaagtgtgagctccctctagaaaagacttgcaaagacaggcttgtgcccctgaagaacagggttccagtatccgcgaagctcgcttctagcagaagcctgaaggtcctgaaaaactctagttcaaacgagtggacaggggagacaggcaaagggactctgttggactctgatgagggctctctgagctcaggtacccaaagttctgggtgccctactgctgaaggtcgtcaggacagcaagagtacatcccccggaaaatacccccacccaggactagccgacttcgcagataatctgatcaaggagtcagatattctgagtgacgaagatgatgatcacaggcagactgtgaagcaaggatcccccacaaaggacattgagattcagtttcaaagactccggatttcagaggatcctgatgtgcacccagaggccgaacagcagcccggacccgagtctggggaaggacagaaaggaggagaacagccgaagttagtaagaggccatttttgcccaataaaacggaaggctaatagcacaaagagggaccggggtaccctccttaaggcgcaaatccgccatcagtccctggattcccagtctgaaaatgctactatcgacctaaacagcgttttagaaagagagttctccgtccagtcccttaccagtgtcgttagcgaagagtgtttctacgagactgaaagccatggaaagagtta

SEQ ID NO: 30799 - DNA, 408 bp, Artificial Sequence
  Description of Artificial Sequence: Synthetic coding sequence
atgggaaaatcctgtaaagtcgtcgtttgtggacaggcatctgtgggtaaaactagcatcctagaacagctattgtatggcaaccacgtggtcgggtctgaaatgattgagactcaggaggacatatacgtcggtagtatagagaccgaccgaggagtccgagagcaagtcaccatcgtagtcttgggcaataagtgcgacctccaggagcagcgaagagtcgacccagatgtggcacagcactgggccaagtctgagaaggtgaagctctgggaagtgagcgtggctgacaggcgctccctcctcgagcccttcgtctacttagccagtaagatgacccagccacaatcaaaatcagctttcccactgagtcgaaagaacaaaggatccggctcactggacgggtag

SEQ ID NO: 30800 - DNA, 3693 bp, Artificial Sequence
  Description of Artificial Sequence: Synthetic coding sequence
atgcctcgaaaaggaacacagccctcgacagcgagaaggagagaggagggcccacctcctcccagccccgatggagcctcttctgatgccgagcccgagccccctagcggccgaactgagtcaccagccaccgctgccgagactgcctcggaagagctcgataatagatctctagaagaaattcttaacagtattcccccaccaccaccacctgccatgaccaacgaggccggagccccacgtctgatgatcacgcatattgtgaatcagaactttaaatcatacgctggggaaaagatacttgggccttttcacaaacgctttagctgtattatagggcctaacggctctggtaagtccaatgtgattgatagcatgctctttgtattcggatatagggcacagaagattcgatccaaaaagttgtcagttctcatccacaatagcgatgaacataaggatatacagtcttgtactgttgaagtgcactttcagaaaatcatagataaagagggcgatgactatgaagtgattcccaacagtaatttctacgtgtccagaaccgcatgtcgcgacaacacgtctgtttaccatataagcggtaagaagaagacctttaaagacgtaggtaatctgttgcgctcccacggcatcgacttggaccacaaccggtttctgattctgcaaggtgaagttgagcagattgccatgatgaagccgaaaggacagacagaacatgatgaaggcatgctagagtacctagaggacattatcggatgtggcaggctcaacgaacccattaaggtactttgccgacgggtggagatactcaatgagcaccgaggagaaaagctgaacagggtgaagatggtagaaaaggaaaaggatgccttggaaggagaaaagaacatcgcgatcgagttcctgacactggagaatgaaatttttagaaagaaaaaccatgtgtgtcaatactacatctatgagctccagaagcgtatcgcggagatggaaacacagaaagaaaagatacacgaagacaccaaggagattaacgagaagtcaaacatcctgagcaatgagatgaaagccaaaaacaaagacgtgaaagataccgaaaaaaagcttaacaagataactaaattcattgaagagaataaggaaaagttcacacaactggacctggaagatgtccaggttagggagaaactgaagcacgctacatcgaaggcaaagaaactggaaaaacagttgcagaaagacaaagaaaaggtggaggagtttaaatcgattccagccaaaagcaacaacatcatcaacgaaacaaccaccaggaataatgcactggagaaggagaaagaaaaggaagaaaagaagctcaaggaagtcatggactccctgaagcaggagacccaggggcttcagaaagaaaaggagtcaagagagaaggagctgatgggcttcagtaaatccgtgaatgaggctcggagcaagatggacgttgctcagagtgaattggatatttacctgagcagacataataccgccgtgtcacagctgaccaaagcgaaagaagccttgatcgccgcttcagaaacactgaaggagcggaaagcagccatccgggatatcgaaggcaagcttccgcagacagagcaagagctgaaggagaaagaaaaagagctccagaagcttactcaagaagagacgaactttaagtcattggtccacgatctgttccagaaggtagaggaagccaaaagcagcctggccatgaacagatcccgaggcaaagtgctcgatgcgatcattcaagaaaaaaagtccggccgtattccgggaatctacggcaggctgggagatttgggggcaattgacgaaaagtacgatgtggctatcagctcctgctgtcatgcgctggactatatcgtagtggacagtatcgatattgcacaggaatgtgtgaattttcttaaacgccagaacatcggcgtggcaacgttcattggcctggacaagatggccgtttgggccaagaagatgacagaaatccagactccggagaacaccccccgtttgtttgatctggtaaaagttaaggacgaaaaaatccgtcaggcattctacttcgccctgagagataccttggttgctgataatctcgatcaggccactagggtggcataccagaaggaccggagatggcgtgtcgttacactgcagggtcagattatcgaacagtctggtactatgacaggaggcggaagcaaggtgatgaaaggtcgaatggggagttccttagtaatcgaaatttctgaggaggaagtcaataagatggagtctcagctgcagaacgattcgaagaaggccatgcaaatccaagagcagaaagtgcagctggaggagagagtggtcaagctgcgccattctgagcgggagatgagaaacaccctcgagaaattcacggcatcaatccagagactcattgagcaagaagaatacttaaacgtgcaggtaaaagaactggaagccaatgtgctcgccactgcccctgataagaaaaagcagaagctcctggaagaaaatgtaagtgctttcaaaacagagtacgacgctgtcgcggagaaagccggtaaagtcgaggccgaggtaaagaggctgcataacactattgtggagataaacaatcacaagctaaaggcgcaacaggacaagttggacaaaatcaacaaacagctggacgagtgtgcctcagctataaccaaggcacaagtcgccattaagactgctgacaggaatctgcagaaggcccaggattcagttctgcgcaccgagaaggagatcaaagatacagagaaagaagtggacgacctaaccgcagaacttaaatcccttgaggataaagcagctgaagttgtgaaaaacaccaatgcagcagagatctccaagatttcactgcatccaattgaagataatccaattgaggagatttctgtgttaagtcccgaagatctggaagccattaagaaccccgattctatcaccaatcagattgcactcttggaagcacgctgccatgagatgaaaccaaaccttggcgctattgcagagtacaagaagaaggaggagttatatctgcagcgtgtggccgagctggacaaaatcacttacgaacgcgactcattccggcaggcttacgaagatctccgcaaacagcggttgaatgagttcatggctgggttttacatcatcaccaacaagctgaaagaaaattaccagatgcttacactagggggagatgccgagctggagctggtggactccttagacccttttagtgaggggattatgtttagtgtgagacctccgaaaaaatcctggaaaaagatctttaacctgtcggggggagaaaagacattgagcagcctggctctcgtcttcgcgttgcaccattacaagccaacacctttatactttatggatgaaattgacgccgcattggatttcaagaacgtttccattgtggcattttacatctatgagcagacaaagaatgcacagttcataattatttcactgcgaaataacatgtttgagatttcagatcggctcatcggaatttacaagacctataacataacgaaatcagtggctgtgaaccccaaagaaatcgcatccaaagggctttgctag

SEQ ID NO: 30801 - DNA, 267 bp, Artificial Sequence
  Description of Artificial Sequence: Synthetic coding sequence
atgcccgaagatcaggtcggcaagctagaggctaccgaaaataccatcagcgctatggccgctgcggcagccgagcagcaacagttctatttgcttctgggcaacctcttgagtccagataatgtcgttaggaagcaggctgaggaaacgtacgagaatatcccaggccagtcgaagataactttcctcctgcaggccattcgtaatactacagcggcagaggaggctcgacaaatggcggcagtccttcttcgcaggctgttgtag

SEQ ID NO: 30802 - DNA, 3627 bp, Artificial Sequence
  Description of Artificial Sequence: Synthetic coding sequence
atggattctctgcccgatgagtttttcgtgcgtcaccccgcagtggaggaccaacggaaggaagaaacggagaacaaattggagaagtccagcgggcagctcaataaacaagaaaacgacatcccaacagatctggtacccgttaatctactgctcgaggtgaagaagttactcaatgctatcaatacactccctaagggggtagtgccccacattaaaaagttcctacaagaggacttttcctttcagaccatgcagagggaggtagctgccaattcccagaacggcgaggagatcgtcccagcactcactctgcgctttctgatcactcagctggaagcagcgctacggaacattcaggcgggaaactacaccgcacatcaaatcaatataggatattatctcactctgctgtttttatacggggtggccctgacagaaagagggaaaaaggaggattataccgaggctgagaataaattccttgtaatgaagatgatgatccaggaaaatgaaatttgcgagaactttatgagccttgtctactttggccgaggcttgctgaggtgtgctcagaagcgctataacggaggccttcttgagttccacaagagtctccaggaaattggggacaaaaatgatcactggttcgacatcgaccctactgaggacgaggatctgcctactacatttaaagatctattgaacaatttcattaaaacaacggagagtaatatcatgaagcagaccatctgttcctatctggattgtgaaaggagctgcgaggctgacatcctaaaaaatacctcctacaaggggttctttcagctaatgtgcagtaagagctgctgcgtgtacttccacaagatctgttggaagaagtttaaaaatttgaagtaccccggagagaatgaccaaagtttttcagggaagaagtgtctgaaagaagggtgcactggggacatggtgcgtatgctgcagtgcgacgtacctggcattgtgaagatcctttttgaagtggtacgaaaggatgaatacattactattgagaacctaggcgcttcctaccgaaagttaatttccctgaaaattaccgatactgacattcggcctaaaatttcactgaaatttaacactaaagacgagatgcctattttcaagttggactacaactatttttaccaccttctccacatcattataatttcaggcaccgacattgtgaggcaaatcttcgatgaagccatgcctccacccctattgaagaaagaactgttaatacacaagaatgttctggaatcctactacaaccacctctggaccaaccaccctttgggcggtagctggcacttattgtacccgccaaacaaagaacttccacaatctaagcagttcgacctgtgcctgttgcttgctctcatcaagcacttaaatgtctttcctgcaccaaagaaggggtggaacatggaacctccgtctagcgatatatccaagtcggcagatatcctgcggctgtgtaaatatcgggacattttgctgtcagagattctcatgaacggcctcacggagtctcaatttaatagtatatggaagaaggtcagtgacatcctcttgcgcctcgggatgatgcaggaggatattgataaagtgaaggagaacccaatcgaaaatatttctcttgactaccatcagctgtctgtgtaccttggaatccccgttccggagatcatccagagaatgctatcctgctatcagcaagggatcgctctccagtccattaccgggtctcaaaggattgaaattgaagagcttcaaaatgaggaagaggaattgagcccaccgctgatggagtataatattaacgtaaagagccaccctgaaatacagtttgccgaaattaataaggatggcacctcaatcccgtcagagtcctccacggagagcctcaaagacttgcaggaggtcaaaagcaaacagcggaagaagaaaaagacaaagaacaagaaaaataaggactccaaggaggaccaggtaccttacgtggtggaaaaggaagagcaactgagaaaggagcaggccaacccgcactcagtgtctcggctcattaaagacgacgcatccgatgttcaggaggattctgccatggaggataagttctacagtctcgacgaacttcacattctggatatgattgagcagggctccgcgggaaaggtgacaacggattacggcgaaaccgagaaggagcgcctagcacgacagcggcagctgtacaagctccattaccagtgtgaggactttaaaagacaactcaggacagttactttccggtggcaagagaaccagatgcagatcaagaaaaaagacaaaatcatcgcgagcctgaaccagcaggttgccttcggtatcaataaagttagcaagctacagagacagatccacgccaaggacaatgaaattaaaaatctcaaggagcagcttagcatgaaacgctcccagtgggagatggaaaagcacaatctggagtccaccatgaaaacctatgtctctaagttgaatgcggaaacatcgcgcgcactgactgcagaggtgtacttcctccagtgccggcgagatttcggtcttcttcatttggagcagactgaaaaagagtgtttgaaccaactcgccagggtaacacatatggcagcctccaatctcgagagtttgcaacttaaagccgctgtcgactcttggaatgccatcgtggcggacgttcgcaataaaattgcattcctgcgtacacagtataacgaacagattaacaaggtgaagcagggatttgccctttccaccctacctcccgttcagctcccccctccccctccaagccctgaaattctaatgcaacaatttctggggcgtccacttgttaaggaaagtttctttcggcctatactgacagtgcctcaaatgcccgctgtgtgtccaggcgtcgtaagcgcaaccggtcagcctagggcacctctgatgaccggtatagcatgggccctcccggcacctgtcggagatgcagttccaccttcggccggtctacggtccgatccatccatcatgaattgggagcgaattactgaccggctgaagacagcttttcctcagcagacaaggaaagaactgacagactttctgcgcaagctgaaggatgcctacggcaaatccctatctgagctgaccttcgatgagatcgtttgcaaaatcagtcagtttatagaccccaagaagtctcagtcacagggtaagagcgtttctaacgtgaactgtgtctcccccagccactcccctagccagccagatgcagctcagcctccgaagcccgcttggaggcctctcacatcccagggccctgctacatgggaaggcgcatccaacccagatgaagaagaggaggaagaggagccctgcgtcatttgtcacgaaaatctcagccccgaaaatctgtctgtgctgccgtgtgcgcacaagtttcacgcacaatgtatacgtccttggttaatgcagcaaggcacctgcccaacttgccggttgcacgtgttgcttcctgaggagtttcccggacaccccagtcggcagttacctaaaatttag

SEQ ID NO: 30803 - DNA, 1743 bp, Artificial Sequence
  Description of Artificial Sequence: Synthetic coding sequence
atggttcttgtgggcactcaggatgccatcagtgccgcaaatcctagggtgatcgatgattcccgagcaaggaagcttagcactgatcttaaaaggtgcacgtactatgaaacatgtgctacctacggcttgaacgttgagagggtgtttcaggacgtggcccagaaggtggtcgcactccgcaagaagcaacagttagccatcgggccttgcaaatccctgccgaatagcccctcgcactctgccgtttctgccgctagtattccagccgtccacatcaatcaagccaccaacggcggaggatctgcatttagcgattatagttcttcagttcccagtacaccttctatctcacagcgagagttacgaattgagaccatcgctgcaagctcgacgcctaccccgatccggaagcagtctaagagacggtctaatatcttcactagtagaaaaggagccgacctggatagagagaaaaaagccgctgagtgcaaggtggacagtatcgggtcagggcgagcaatcccgatcaagcagggcattctcctgaagagaagtggcaagtcattgaataaagaatggaagaaaaaatacgtcactctgtgtgataatggcctgttaacttaccatccttcccttcatgattacatgcagaacattcacggtaaggaaattgatttgctgcggacaaccgtgaaggtcccagggaaacgcttgccgagggcaacgccggcaactgccccaggtacaagccccagagctaacggcctctctgttgagagatctaacacccaacttgggggaggcacggaggctgaagagtccttcgagttcgttgtcgtctcgttgactggccagacttggcatttcgaagctagcacggccgaagaacgtgaactgtgggtgcagagtgtccaggcccagattctcgccagtctacaagggtgtcgctcagccaaggataaaacacgcctcggcaatcaaaacgcagccttggccgtgcaggctgtgagaacggtgagagggaatagcttctgtattgattgcgatgcccctaatcctgattgggcttcactgaacctgggcgcattaatgtgcattgagtgctcaggcatacatagacatctgggtgctcatttaagtagagtccgcagtttagatctcgatgactggccccctgagctactcgccgtaatgactgcaatggggaacgccctggctaatagcgtatgggaaggcgcattgggaggatatagcaagccgggacccgatgcatgccgggaggagaaggagaggtggattagagccaaatacgagcagaagcttttcttggcaccactcccatcatcggacgtccctctgggccagcagcttctacgggctgtcgtggaggacgacctgcgacttctggtcatgctgcttgcacacggaagcaaggaagaagtgaacgaaacttacggcgacggcgatggacggaccgctttgcatctgtcaagtgccatggccaacgtagtctttacacagttgttgatctggtatggggtagacgtccgtagcagagatgcacggggactgacaccacttgcctatgccagacgggctggatctcaagagtgcgctgacattttgattcagcatgggtgcccaggcgagggatgcggcctcgcgccaaccccaaatcgggagcctgcgaatggcaccaatccaagtgcagaacttcacagatcgccctctctcctgtag

SEQ ID NO: 30804 - DNA, 312 bp, Artificial Sequence
  Description of Artificial Sequence: Synthetic coding sequence
atggcggaacttatccagaagaagctgcagggcgaagttgagaaatatcagcagctgcagaaagacttatcaaagtctatgagtggacgtcagaagctagaagcccagttgacagagaacaacatagttaaggaggaattggcgctgctagatggctcaaacgttgtgttcaaactgctgggacccgtgctcgtgaagcaagaactaggagaagcccgtgcgacggtggggaaacggctggattacatcacagccgagattttcttgcgtacaatcccagatcctggggatgtcccagactcctttttttag

SEQ ID NO: 30805 - DNA, 453 bp, Artificial Sequence
  Description of Artificial Sequence: Synthetic coding sequence
atgaccagccgcaagaaggtgctgctgaaggtgattatactgggagacagcggcgtaggaaagacaagtcttatgaaccagtatgtcaacaagaaattcagcaaccagtataaggccacgatcggagcagactttctcacgaaggaagtgatggtggacgaccgcctggtcactatgcagatttgggataccgccggacaggaaaggtttcagagcctcggagtggctttctatcggggagctgactgctgtgtactagtgttcgacgtcacggcccctaatacttttaaaacccttgattcttggcgcgatgagttcctgattcaggcctctccgcgagaccctgagaacttcccttttgtcgtgctgggcaataaaatcgacctggaaaacagacaggtagcaactaagagggctcaagcctggtgttactccaagaacaacattccatag

SEQ ID NO: 30806 - DNA, 540 bp, Artificial Sequence
  Description of Artificial Sequence: Synthetic coding sequence
atgaccgacttggtagccgtgtgggacgtggctttgtcagacggagtgcacaagattgagtttgaacacggcaccacttcaggcaaaagggtcgtttatgtggatggtaaggaggagattagaaaagagtggatgttcaagctagtcggcaaggaaaccttctacgtcggagccgctaagaccaaggctaccattaacattgatgcaatcagtgggttcgcctacgagtacaccctggaaatcaacggcaaaagtctgaagaagtacatggaagatcgtagcaagaccactaatacatgggtgctgcatatggacggcgagaacttcaggatcgttcttgaaaaagatgccatggacgtttggtgcaacgggaagaaactggaaaccgctggagagtttgtcgatgatgggacagagacccacttttccatcggcaatcacgattgttatatcaaagcagtatcctcagggaaacgaaaggagggaatcatccacactttaatcgtcgacaatcgggaaatcccggaaatcgcctcctag

SEQ ID NO: 30807 - DNA, 171 bp, Artificial Sequence
  Description of Artificial Sequence: Synthetic coding sequence
atggactctagcattcacttgtcatcactgatctccaggcacgatgatgaggctacacgtacatcaaccagcgaaggacttgaagagggagaagtggaaggagagacccttctgattgtggagtccgaagaccaagctagtgttgatctaagccatgaccagagcggctag

SEQ ID NO: 30808 - DNA, 153 bp, Artificial Sequence
  Description of Artificial Sequence: Synthetic coding sequence
atgtgcagtaccagcggatgtgacctagaagaaatcccactagatgatgacgacctgaacaccattgagtttaagatcctagcttactatactcgccaccacgtttttaagtccacacctgccctgttcagccccaagctgttgaggacttag

SEQ ID NO: 30809 - DNA, 1203 bp, Artificial Sequence
  Description of Artificial Sequence: Synthetic coding sequence
atgaaccctgcaagcgcccctcctcccttgccgcctcccggacagcaagtgattcacgtgacccaggatctggatactgatctggaagcccttttcaacagtgtgatgaatccaaagcctagttcatggcggaaaaagatcctgccagagtctttctttaaggaacccgattctgggtcacatagcaggcagtcctcgacagactcctcaggtgggcatcccggaccaagattggccggaggtgcacagcatgtgagaagtcactctagtcctgcgtccctacagctcggcactggcgctggcgctgcaggatcgccagcacagcagcacgcccacctccgacagcagtcatacgatgtgacagatgagctgcccctccctcctggctgggagatgaccttcactgccaccggacagcgctatttcctcaaccatatcgaaaaaattacaacatggcaggacccgcgaaaggctatgaatcagcccctgaatcacatgaaccttcacccggcagtcagctccacacctgtgcctcagcgatctatggctgtgagccagcccaacttggtgatgaaccaccagcatcagcagcaaatggccccttccacactgtcacaacagaatcaccctacgcagaaccccccagccggtttgatgtctatgcccaacgctttgacgacacaacaacagcaacagcaaaagctgaggttgcagcgaattcaaatggaaagggaacgtattcggatgcggcaggaggagttaatgcgccaggaggcagcactctgccgccagctgccaatggaagcagaaactctggcacccgttcaagccgcagtaaatccaccgaccatgacaccggacatgagaagcatcactaacaattctagtgatccatttctaaacggcggaccgtaccattctcgggagcagtcaacagactccggcctcggactgggatgctactccgttcccacaacccctgaggatttcctctctaatgtcgatgaaatggacactggggagaacgcaggtcaaacacctatgaacatcaatcctcaacagactcgatttccagactttttagattgcctaccaggaactaatgtagacctgggcactttggagtctgaggacctcattcccctgtttaacgacgtcgaatctgccctcaacaaatccgagccctttcttacttggctttag

SEQ ID NO: 30810 - DNA, 513 bp, Artificial Sequence
  Description of Artificial Sequence: Synthetic coding sequence
atgccacggaagggaacccaaccctccacagctcggcgacgcgaagagggccctcctcccccaagtcctgatggcgcatcttccgatgccgagcctgagccaccatctggcaggaccgagagccctgcaactgccgctgaaacggctagcgaggaactggacaacagaagcctagaagagatccttaactcaattccaccccctcccccacctgccatgacaaatgaggcaggagctccgaggctgatgataacccatatcgttaatcagaatttcaaaagttacgctggagaaaagatcctgggcccatttcacaaaaggttctcctgcataatcggtcctaatgggtccggcaagagcaacgtcatcgatagcatgctgtttgtcttcggctaccgagctcagaagattagatctaaaaaattgagcgtgctaatccacaatagcgatgagcacaaagatatccaaagctgtaccgttgaagtgcatttccagaagattatcgataaatag

SEQ ID NO: 30811 - DNA, 504 bp, Artificial Sequence
  Description of Artificial Sequence: Synthetic coding sequence
atggagaaggccgtgaacgatggcagtcattcagaggagttattttgccacctaaagactattagcgaaaaggaagacctgcctaggtgtacatccgagtcccacctgagctgccttaagcaggacatcttgaacgaaaaaactgagctcgaggccaccctgaaggaggcagagctagttacccattctgtggagctcctcttgccactgtttaaggacaccatcgaaaaaattaacttcgagaacgccaacctcagtgctctgaatctcaaaatttctgagcagaaggaaattctgatcaaggaactggatacatttaagtccgtcaagctggcccttgagcatcttctgcgtaaaagagactacaaacagacaggggacaatctgagtagcatgctgctggaaaatctgactgacaacgagagtgaaaatacaaatctgaagaaaaaggtctttgaaaaggaggctcacattcaggagctttcctgcctatttcaaagctag

SEQ ID NO: 30812 - DNA, 2376 bp, Artificial Sequence
  Description of Artificial Sequence: Synthetic coding sequence
atgagtaaccagcaggaaaaatacgaagcacagaacatagtgaatagcaccgaggaaagcgatgacgctttcgacaccgtgaccatacctgtcccaagcgaggagccccaggaatcggatcagaccgaggagcacgagtctggaatcgagcaatttagcgaatctcacgccatccacgtagaggaacagtctgatcagagttttagctcactcgagccagataatgaacagttaatggaggaagtcatctctccccgacaagtgtcctacacaccccagcaccatgagaagcagtacgcgatgcagcgccctaatgatgatagtctggcattcttggacaagatcaaaagtgttaaagaatcccttcaagagtccgttgaggactctctggcaactgtcaaggtggttctcattccagtgggccaagagatcgtgattccgttcaaggttgatactattcttaagtacctcaaggaccatttcagccatctcctggggattccacattctgtcctgcaaataaggtattccgggaagatcttgaaaaataacgagacgctggttcagcacggggtgaaaccccaagagatcgtccaggtagagatctttagtaccaacccagacctttatcccgtccggagaattgacggcctgaccgacgtgtctcaaatcattaccgtcaccgttcagaccggccttgaccaataccaacaggtacctgtcgagatcgtaaagagtgatttccacaagccattcctcggtggatttcgacacaaagtgactggggtggagtatcacaacgctggcactcaaactgtgcctaaaaggataccagagcgcctctccattttttgccgggatactcagaccgtcttccagaagaaaaatctgcaacaaaccactaacactacaagcacccagatgacgaacatcggagtttatgtgtccaacatgaccgataaactggtgacaccgggtaaatattttagtgctgccgagtatcacgcgcaaagactaaaagctgtgatcgtgattcaaacctattataggcagtggcatgcaaaaatctttgtggaaaatctccggaggcagaaatctttgcgcctggaatgggagactcagcaggaactcaggaaaatccgtgagaaagaggaatggatcaagctcgattaccacagacggcataatcctaagaccaatgaagacttcgaattcctttacaatgcactggagttctggcgccaagaggaactgacgaggataaatcagtccttcactggcgcagagcgtaaggccgctttgtgcgagctgctggaaaaagagacccagattatcgccagcataggtcggcaccgttatattgcttacatggctaaccaagaggccgcaattcaggcatttctggacaagtgttccgccccaaagatctggagaacgccaaacgggaaaactatcgaaatggacacccagtttaccatacgtgccagagaactacagaacatttacaagtgcattatgctgaaaaatattagccaagacgaacgccttgacgtgctgctgacgctgaaacatacagtcaaggaacacgagtgcaaactcactcaagagattctggagctgatcgacagagaagtggatctcatgatgcggggtgtcaagcatcacaacctggaaggactgcgtaagcggatcgccacgctattctttcactatatcaaaacaccactcttcaaccctgaggtcgctaagtacctgaaggtaccccaggaccccctcaagttctacaagaaaatctatttctgtcactcctgtcaattgtacctcccatctaccgagtttagcgtgtctagcacctcacggcgaatctatcgttgtcgcaactgtatcaacttacagaacgaagcccaaaaaagagaaagctttttgaagtataagtgcctgctacagcagttgtactacaccgaggccgattatgaggacgattcgaagattgcattcctgatgcaactacaagatatccagtatctcactgaaaatatatgggcgtcccagtctgtgctatccgcctgcgacaatctgagtgacctggtgatggtccgttggaataaatctctggagtggtccccttggaactgtattctgctgaccaaagatgaggctgctgctcaccttaagttaacttctattgaagaggggtatgaaagaagttttatccataagattaagcacaaacacatcctcgccaaaaactacttctcacaggttcctgtactggcctcatttattttggatgatggggagatcgatgagatcaggtggaagtaccactcggatacaacccctaaaatcatcgaatctcaacgtccgccacactag

SEQ ID NO: 30813 - DNA, 687 bp, Artificial Sequence
  Description of Artificial Sequence: Synthetic coding sequence
atgacagaccaaacttactgcgacaggctggtgcaggacactccattcctcacaggccacggaaggttgtccgaacagcaagtggatagaatcatcttgcagctgaacagatactatcctcagatactcaccaacaaagaagctgaaaaattccgtaatcccaaagctagcctgcgtgtgcgtctatgtgacctgttgtcacacctgcagagaagcggggaacgcgactgtcaagagttttatcgagcgctttatatccacgctcagcccttgcattctcgcctgccaagtaggcacgccttgcggaagtttcacattacaaaccacgcttgcctggtgctggcgcgaggtggacatcctagcctgccactgatggcatggatgagctctatgactacacaggtctgttgttctccgggtctggcgtcccccctcgcctcagcacctccccagagaccgcctagcggtcctgagggacgggtatggcaggcccaggccgtgcagatgcttgtgagcgtgtcccatttcctaccgcttcctccctcactgagccatggctcgttccataccgcttggggaattctatacgtgcactcatgtccttcattctccaatctgatacctcgaggatcgctgcacgtctgcgtggatagtaatctggtcccaaccgccgcatggcgctcttag

SEQ ID NO: 30814 - DNA, 948 bp, Artificial Sequence
  Description of Artificial Sequence: Synthetic coding sequence
atgcccggactaagttgccgcttctatcagcacaaattcccagaggttgaggacgtggtgatggttaatgtccgaagcatagcagagatgggcgcttacgtaagcctgttagagtacaataacatcgagggtatgatcctactaagcgagttatcacgcaggaggattaggtctatcaacaaacttatccgtataggccgaaacgagtgtgtggttgtcatcagagtggacaaagagaagggctatattgacttaagcaagagacgcgtttcacctgaggaagcaatcaagtgcgaggacaagttcacaaaatccaagactgtgtacagtattttgaggcatgtggcggaggtactggagtacactaaggatgagcaattagaaagcctttttcagaggaccgcttgggtttttgacgataagtataaaagaccagggtacggagcttacgacgcttttaagcacgccgtttctgatccgagcatcctcgacagtctcgatttaaacgaagatgaaagggaggtgcttatcaataatataaatagacgtctgaccccccaggcagtgaagattagggctgatatcgaggtagcttgctatggatacgagggtattgatgccgtgaaagaagcgcttcgagccggattgaattgttcaaccgaaaacatgcctatcaagattaacttaattgccccaccacggtatgtcatgaccaccacaaccctggagcggaccgagggcttatcagtccttagccaagccatggccgtaataaaagagaagattgaggagaagagaggtgtcttcaatgtccagatggaaccaaaagtggtaaccgacacggatgaaaccgagcttgccagacaaatggaacgactcgagagagagaacgcggaggttgatggggacgacgatgctgaggaaatggaggcaaaggccgaggactag

SEQ ID NO: 30815 - DNA, 1203 bp, Artificial Sequence
  Description of Artificial Sequence: Synthetic coding sequence
atgaaccccgcttctgcccctccacccctaccccctcccggtcagcaagtgattcacgtaacccaggacttggatactgatctcgaagctttatttaacagtgttatgaatccgaagccttccagctggagaaagaagatactcccagagtcattttttaaggaaccagactcaggctctcactctaggcagagctctaccgatagctctggtgggcaccccggacccaggttggccggaggcgcacaacatgttcggtcacactcgtctcctgcatctctacagttggggactggagctggcgctgcgggttcccctgcacaacaacacgcacaccttagacagcaatcttacgacgtcaccgatgaacttcctctgccccctggctgggagatgacgttcaccgcaactggccagcggtatttcctgaaccatattgagaagatcactacctggcaggatccgcgtaaggctatgaatcaacccttaaatcacatgaacctccatccggctgtgtcttccacccctgtgccacagcggtcgatggctgtaagccaacctaacctggtgatgaatcaccagcatcagcagcagatggcaccctcaactctgagccagcagaatcaccccacccagaaccccccagctggcttaatgagcatgcccaatgcactgaccacccagcaacaacagcagcaaaagctgaggctgcagcggattcaaatggaacgggaaaggatccgaatgcggcaggaagagctcatgcgccaagaagctgcactctgcagacagctgccgatggaagccgagaccttggccccagtccaagcagcagtgaacccccctactatgacccccgacatgagaagcatcaccaataacagctctgatccattcctgaacgggggaccctatcactctcgggagcagtccactgacagcggactcggactgggttgctacagtgttccaactactcctgaggattttctgtctaatgtggacgaaatggatacaggggaaaacgctggtcagacacccatgaacattaacccccaacagacacgctttccagatttcctggactgtttgcctggtaccaacgtcgacttaggcaccctagaatcagaggatctgattcctctgtttaatgacgtggaatccgccctcaataaatccgagcccttcctcacttggctgtag

SEQ ID NO: 30816 - DNA, 381 bp, Artificial Sequence
  Description of Artificial Sequence: Synthetic coding sequence
atggttctgatcttgggcaggagattgaaccgcgaggatcttggagtgagagattctccagctaccaagaggaaggttttcgagatggatcccaaatcattgaccgggcatgaatttttcgacttttcatcagggagttcacacgctgagaacatcctccaaatctttaatgaattccgcgacagtcgcttgttcaccgacgttattatctgcgtggagggtaaggaatttccctgccaccgcgctgtactttcggcttgctcttcttattttagggccatgttctgtaacgaccacagggagtcaagggagatgttagtggaaataaatggcattttggcagaggcgatggaatgttttttacagtacgtttatacttag

SEQ ID NO: 30817 - DNA, 312 bp, Artificial Sequence
  Description of Artificial Sequence: Synthetic coding sequence
atggccgaactgatccagaaaaaactgcagggtgaagtagagaaataccagcaactgcagaaagacctttctaaatcgatgagcggccgacagaagctggaagctcagttaacggaaaacaatattgtcaaagaggagctggcactgttagacggtagcaacgtggtgtttaagctgctgggacctgtactggtgaagcaggagctgggtgaggcacgggctacagtgggtaaacgcctcgactacattacagcagaaattttcctgcgcacgatcccagatcccggtgatgtgccagattcattcttttag

SEQ ID NO: 30818 - DNA, 237 bp, Artificial Sequence
  Description of Artificial Sequence: Synthetic coding sequence
atggtgctaatcctggggaggcgtctcaatcgtgaagaccttggcgtgcgcgattcaccagcgactaaaaggaaggtgttcgagatggaccccaaaagcctcacgggccacgaattttttgatttcagctcagggtcctctcacgctgagaacatcctgcagatcttcaacgagtttcgcgactccagactctttacagacgttatcatttgcgtcgaaggcaaagagtttccctag

SEQ ID NO: 30819 - DNA, 1320 bp, Artificial Sequence
  Description of Artificial Sequence: Synthetic coding sequence
atggcggctaatctgtcccgtaacggcccagccctccaggaggcctatgtgcgcgtggtgactgaaaaaagccccaccgactgggccctgtttacttatgaagggaactccaatgatatcagggtggccggaactggggagggaggcttggaggagatggtcgaagagctgaatagcgggaaggttatgtatgccttttgccgcgtgaaagaccctaattccggcctgcctaagtttgtgttgatcaactggaccggggagggcgtgaatgacgttcggaaaggggcatgcgcatcacatgtgtcaaccatggcgtcattcctgaagggagcccatgtgacaattaacgctcgtgcggaggaggatgttgaacccgaatgtatcatggaaaaggtggccaaagctagtggagcgaactactccttccacaaagagagcggcagatttcaagacgtgggcccacaggcccctgtgggctctgtataccagaagaccaatgccgtgtccgagatcaaacgggtcggcaaggatagtttttgggccaaagcggaaaaggaggaggagaatcgccgtctcgaggaaaagagaagagctgaggaggctcagcgtcagttggaacaagaacgacgcgagcgggagctccgtgaggcagcgaggagggagcagagataccaagagcagggcggagaggcttccccacaatctcgtacctgggagcagcaacaggaagtggtttccagaaatagaaacgaacagggaagcacctgtgcaagtctccaggagtcagcggtgcatccacgcgagattttcaagcaaaaggagcgcgctatgtctaccactagtatctcatccccacagcctggcaagttaaggtcccctttcctgcagaaacagcttactcagcctgagacacatttcggtagggaaccggctgctgccattagccgccctcgagccgatctcccagcagaagaacccgctccttctacacctccatgcctggtacaggcagaggaggaggccgtttacgaagaaccacctgaacaggagaccttttacgaacagccacctctagtgcagcagcaaggcgcaggcagcgaacacatcgaccaccacatacagggtcaaggcctatcaggtcagggtttgtgcgccagagcactgtacgactatcaagcagctgatgacactgagatttcattcgaccctgaaaacctgattacaggaattgaggtgatcgatgaaggatggtggagaggctatggaccagatggacattttggcatgtttcccgctaattacgttgagctgatagaatag

SEQ ID NO: 30820 - DNA, 219 bp, Artificial Sequence
  Description of Artificial Sequence: Synthetic coding sequence
atgagctaccaacagcaacaatgtaagcagccttgccagccaccacccgtttgtcccgctcctaaatgtcctgagccctgtccaccgccaaaatgtcctgaaccatgcccaccaagcaaatgccctcagagctgtcctccccagcagtgccagcagaaatgccctcccgtgacgccatcccccccttgtcaaccgaaatgtcctcctaagtctaaatag

SEQ ID NO: 30821 - DNA, 342 bp, Artificial Sequence
  Description of Artificial Sequence: Synthetic coding sequence
atgtcagccatccagaaccttcacagcttcgatccattcgccgacgcgagtaagggagatgacctgttgccagcaggaactgaagattatattcacattcggattcagcaaagaaatggcaggaagacgctaacaacagtgcagggaatcgcagatgactacgacaaaaagaaactcgtcaaggcttttaagaaaaagtttgcgtgcaacggaacagtcatcgagcatcctgagtacggcgaggtgatccaactgcagggcgatcagagaaagaatatctgccagtttctcgtcgagattggtttagccaaagacgaccagttaaaagtccatggcttttag

SEQ ID NO: 30822 - DNA, 927 bp, Artificial Sequence
  Description of Artificial Sequence: Synthetic coding sequence
atggcaagtagcaacacagtccttatgagactggtggccagcgcttatagtattgctcagaaagcaggcatgatagtaaggcgcgtgattgctgagggggatttagggatagtggaaaagacttgtgctactgatctacaaactaaggccgacaggctagcccagatgtcaatatgttcttcactcgccaggaagtttccgaaattgaccatcataggcgaggaggatctgccatctgaggaagtcgaccaggagcttatcgaagatagccaatgggaggagattctcaaacagccttgtcctagtcagtatagcgccatcaaggaggaggacctggttgtgtgggtggatccactggatggtaccaaagaatacaccgaggggctgttggacaacgtgactgtccttatcggtattgcttatgaagggaaagccatagccggagtcatcaaccagccatattataactacgaagctggtcctgacgctgtgttaggcaggaccatatggggcgtgctgggactgggtgcctttggattccagctaaaggaagtcccagccggtaagcacattatcacaaccacaagaagtcacagtaataaactggttaccgactgtgtcgctgccatgaatcctgatgctgttctgagagttggaggagcaggcaataagattattcagctaatcgaagggaaagcctccgcctacgtctttgcgtctcctgggtgcaaaaagtgggatacttgtgcccctgaggttattctccatgctgtgggtggcaagttgactgatatacacgggaacgtgctgcaataccacaaggatgtcaagcacatgaactcagccggtgtgctggccacactgagaaactacgattattacgctagccgcgtgccagaatccattaaaaacgcactggtgccttag

SEQ ID NO: 30823 - DNA, 1809 bp, Artificial Sequence
  Description of Artificial Sequence: Synthetic coding sequence
atgatcgaaaaaatgcagggatcaagaatggatgaacagcgctgttccttccccccacccctcaagactgaggaagactacataccttacccttcggtgcacgaggttcttggccgtgaggggcctttcccccttattcttctaccacagttcggaggctactggatagagggcactaaccatgaaattaccagcattccagagacggaacctctccagtctcccaccactaaggtcaagcttgagtgtaatcctactgccaggatttaccggaagcacttccttggcaaggaacacttcaactactactcactagatgctgccttgggccacctggttttttctttgaagtatgacgttattggcgatcaagagcatttgagactcctgctcaggacaaaatgtcggacctaccatgacgtgatacccatttcatgccttacggagttccccaatgtggtgcagatggccaaacttgtctgcgaggacgtgaacgtggacaggttttaccccgtactctaccctaaagctagtaggctcatagttaccttcgatgagcacgtgatttccaataactttaaatttggcgtaatatatcagaaactggggcagacatccgaggaagagctcttttcaacaaatgaagaatcacctgccttcgttgagttcctggaatttcttgggcagaaagtcaagctgcaagattttaagggctttcgtggaggtctggatgtaacccatgggcagacaggaacagagtcagtgtattgcaacttccggaataaagagatcatgtttcacgtgagcaccaagctgccatatacggaaggcgacgcacagcagctgcagcgaaagcggcacatcgggaacgacattgtcgcggtcgtgttccaggacgagaacaccccattcgttcccgacatgattgccagcaatttcctacacgcttacgtggtggtgcaggccgagggcggtgggccagacggaccgctctacaaggtgtctgtaaccgcgagggacgacgtaccttttttcggaccaccgttacctgatccagccgtgttccgaaaaggaccggaattccaggaattcttactcacgaagctcatcaatgcggaatatgcctgctataaagccgaaaaattcgcaaaattggaggagaggacccgcgctgcactgctggaaacactgtacgaagaactgcatattcatagccagtcaatgatggggttgggtggagacgaggacaaaatggaaaatgggagcggaggagggggattcttcgagtccttcaagagggtgataaggtccaggtctcaatcaatggatgccatgggcctcagcaacaagaaaccaaacacagtcagtaccagtcactcaggctccttcgccccaaataaccctgacctggccaaggcagccggaatctctttgattgtccctggaaagagcccaacccgaaagaagtccggaccctttgggtcacgaaggagctccgccatcggaatagaaaatatccaggaggtccaagagaagagggaatcccctcccgctggccagaagactccagacagcggccatgtgtctcaggagcctaagagcgagaactcttccactcagagctccccagaaatgcctactactaagaaccgcgcagagaccgctgctcagagagccgaagcactgaaagatttctccaggtcctcttcttccgcctcatcatttgcctcggttgtagaagaaactgagggagtggatggggaggacaccgggctccacgtggcaggaggtcaatgtcagcatcattag

SEQ ID NO: 30824 - DNA, 177 bp, Artificial Sequence
  Description of Artificial Sequence: Synthetic coding sequence
atgggacgggtttgggatctacctggcgtgttaaaagtggaaggctttagagccaccatggcacagcgcctggtacgggtcctccaaatatgtgccggacacgttccaggagtgagcgcattgaatctgttgtccctcctcaggtcgtccgagggcccaagccttgaagatctatag

SEQ ID NO: 30825 - DNA, 2199 bp, Artificial Sequence
  Description of Artificial Sequence: Synthetic coding sequence
atgctgccctgtgcagctggagctcgcggtcggggtgccatggtggtgctgagggccggtaagaaaacctttttgcccccattatgtcgggctttcgcctgcagggggtgtcagctggctcctgagagaggcgctgaacggagagataccgccccatcgggggtgtcacgtttttgccctcctcgaaagagttgccatgattggatcggtcctcccgacaagtattctaacttaagacctgtgcatttttacattcccgagaatgagtctcccttggagcagaaattacggaagctgagacaagagacgcaggaatggaatcaacagttttgggccaatcagaacttgacttttagcaaagagaaagaagagttcatccacagcagacttaagacaaaagggcttggcctgcgcacggagtccggacagaaggcaactctgaacgctgaggaaatggctgatttctacaaggaattcctgtctaaaaacttccagaaacacatgtattataaccggatgtacgacaacatgagcaccatggtgtatattaaagaagacaaactcgaaaagttgactcaggacgagattattagtaagacaaagcaggtcattcaaggcctcgaagccctgaaaaacgaacacaatagcattctgcagagccttcttgagacactgaagtgtctgaagaaggacgatgagagtaatttggttgaggaaaaatccaacatgattcgcaaatcgctggaaatgctggagcttggcttatccgaagcgcaagtgatgatggctctgagcaaccatcttaacgccgttgagtccgaaaaacaaaaactcagagcacaggtgcgccgactgtgtcaggagaatcagtggctgagggacgaattagccaacacgcagcagaagctccagaagtctgagcaaagtgtagcccaactggaagaggaaaagaaacacctggagttcatgaatcagctcaaaaaatatgacgacgacataagccctagtgaagacaaggacacagactccaccaaggagccactggacgatctgttccccaacgatgaggatgacccaggacagggaatacagcaacagcattccagcgctgcagccgctgcccaacaaggcggttatgagatcccggcaaggctgcgaacactgcataacttagtgattcaatatgcctcccagggaagatacgaagtggccgtccctctgtgcaagcaggcgctggaggatttggaaaagaccagtggtcatgatcaccccgatgtagccaccatgctaaacatcctggcgcttgtctaccgggaccagaataagtacaaagacgccgcaaacttattgaacgacgctctcgcaatcagggagaaaactttggggaaggaccaccctgccgttgccgcaacactgaataacctagctgttctgtatggaaagcgtggaaagtacaaggaagctgagcccctgtgcaagagggccctggagatacgggagaaggtcctcggcaaagatcaccctgatgttgccaaacagctgaataacctggcactgctgtgtcagaatcagggcaaatacgaagaggtcgaatactattaccagagggcgttggagatataccagactaaactgggaccagacgacccaaacgtggccaagactaagaacaatttggcatcttgctatctgaaacagggtaagttcaagcaagctgagacactttacaaagaaatcctcactagggcccacgaaagagaattcggatcggtcgatgatgagaacaaacccatctggatgcatgccgaagaacgggaggagtgtaaaggaaaacagaaggatgggaccagttttggagaatatggagggtggtacaaagcatgtaaggtagattcccctacagtcacaacgactctaaaaaatctgggtgcactttaccggaggcagggcaaatttgaggcggctgagactctagaggaggctgctatgcgctcccggaagcagggacttgacaatgtacacaagcagcgagtcgcggaagtcttgaatgacccagagaatatggaaaaaagacgctctagagagagtctcaacgtcgatgttgtcaaatacgaatccggacccgatggaggcgaggaagtctcaatgagtgtcgaatggaatggcatgcggaagatgaagctgggtctcgtaaattag

SEQ ID NO: 30826 - DNA, 249 bp, Artificial Sequence
  Description of Artificial Sequence: Synthetic coding sequence
atgagcgggctggtcttaggacagcgtgatgagcctgccggacatcggctgtcccaggaggaaatcctaggctctacccgcctcgtcagtcaggggctggaagcacttcggtctgaacatcaggccgtgttgcagtctctcagtcagactatcgaatgtctccagcaggggggtcacgaagagggcctggtccacgagaaggccaggcagctgcggcgatccatggagaatatcgaactggggctgtag

SEQ ID NO: 30827 - DNA, 222 bp, Artificial Sequence
  Description of Artificial Sequence: Synthetic coding sequence
atggtcctgatattaggacgcaggttgaaccgcgaggacctcggggtgcgggatagtccggctaccaaaagaaaagtgtttgaaatggatccaaagagtctgactggccacgaatttttcgatttctcttctgggtcttctcacgcagaaaacattctgcagattttcaatgagtttagggacagtagactatttaccgatgtgataatctgcgttgaatag

SEQ ID NO: 30828 - DNA, 1191 bp, Artificial Sequence
  Description of Artificial Sequence: Synthetic coding sequence
atgaactttcaagctggaggagggcagtccccccagcaacagcaatccctggctgccccagggggaggcggtgctgccgcacagcagctcgtgtgcggcggtcagttcgggggtgctgggcctggagctggcggtggaggaggacctagtcagcagcttgcagggggaccaccccaacagtttgccctcagcaacagcgccgcaattcgggctgaaatccaacggttcgaatcagtgcacccgaacatctacgccatatatgacctgatcgagcggattgaggacctagccctgcagaaccagatccgtgagcatgttatcagtatcgaggattcatttgttaacagccaagaatggacgctttctagatctgtccccgagctgaaggttgggatcgtaggtaacctcagttccggaaagtccgccctggtgcaccggtacctcaccggcacatatgttcaggaggagagccctgagggcggacgattcaagaaggagattgtggttgacggacagtcataccttcttctgattcgggacgaaggcggtccacctgagctgcagttcgccgcttgggtggacgcagtggttttcgttttcagtctggaagatgagattagctttcagacggtgtataactactttcttcgactttgctctttccgtaacgcttccgaggtaccaatggtgctcgtgggcacacaggacgccataagtgcagcgaaccccagggtgatcgatgattctagagcgcgaaaactcagtactgatctgaaacggtgcacctattacgagacctgcgctacttacggccttaatgtagagagagtgttccaggatgtggcccagaaagtggtcgcactgcgcaagaaacagcaactagccatcgggccatgcaagagcctgcccaattccccgagccactctgcggtctccgccgcaagcatccctgccgtacatattaaccaagcgacaaatggagggggatcagcctttagcgattatagcagctccgtgcccagcacccccagtatctctcagcgcgagctacgcattgaaaccattgccgctagtagcactcctacaccaattcggaagcagtcaaaaagacggagtaacatttttaccatctgcgccacagtgtcaaacttctcttcaactaagcgacctttccagctgttgccaaattag

SEQ ID NO: 30829 - DNA, 1110 bp, Artificial Sequence
  Description of Artificial Sequence: Synthetic coding sequence
atggatagctgtctgatggtgtggcatatgaagcctcagtctagggcataccggtttacagggcacaaggatgctgtaacatgcgtgaatttctctcctagtggccatctgctggccagtggcagcagagacaaaaccgtgagaatttgggtgcccaacgtaaagggtgaatccaccgtgtttcgggcacataccgccaccgtccgctctgtgcacttctgtagtgatggacaaagctttgtgactgccagcgacgacaaaaccgtgaaagtgtgggccacgcatcgacagaaattcctcttcagcctgtctcagcatattaattgggtccggtgcgccaaattctcccccgacggacggctgattgtgtcagcgagcgatgataaaacggtaaagttgtgggataagagttccagagaatgcgttcattcatattgtgagcacggcggattcgtcacctacgtggacttccatccctccggtacctgtatcgcagctgccggtatggacaatactgtgaaagtctgggacgttcgcacgcatcggctgttgcagcactatcagttgcactcggctgccgtcaatggcctgtcatttcatccttctggaaattacctgatcaccgcatcaagtgactcaaccctcaagattctcgatctgatggaaggtagattgctgtataccctgcatgggcaccaaggacccgctaccaccgtcgccttcagtcgtaccggggaatattttgctagcggaggctccgatgagcaggtaatggtttggaaaagcaatttcgatattgttgatcacggcgaggtgaccaaagtcccccgaccacctgcaaccctggcctcttctatgggcaacctccctgaggtcgactttcctgtaccaccagggcgagggagatccgtcgaaagtgtgcagtctcagccacaagaacccgtttccgttccccagacactgacctccacgttagaacacatcgtcggacagctggacgtgttaacacagacagtgtctattctcgagcagcggttgactctgacggaggataagttaaaacagtgtcttgagaatcagcaactcatcatgcaacgcgctaccccttag

SEQ ID NO: 30830 - DNA, 312 bp, Artificial Sequence
  Description of Artificial Sequence: Synthetic coding sequence
atggccgagcttattcagaagaaattgcaaggggaagtcgaaaaatatcagcagttgcaaaaagaccttagcaagagcatgtccggtcgccagaaactcgaggcccagctgactgagaataatatcgtgaaagaagagttggcactgttggacgggtcaaacgtggtattcaaactcctagggcctgttctggtaaagcaggaactgggggaggcgagggcaactgtgggaaaaagactggactacattaccgccgagattttcttgagaaccatccctgacccgggagacgtgcccgattcattcttctag

SEQ ID NO: 30831 - DNA, 270 bp, Artificial Sequence
  Description of Artificial Sequence: Synthetic coding sequence
atgagtgaacaaggcgacctgaaccaagcaatcgccgaagagggcggtacagaacaagagacagccacacccgagaacggtatcgtgaagtccgaaagcctggacgaagaagagaagctggagcttcagcggcgactagaggcacagaatcaagagaggaggaagagcaaatcaggagccggaaagggaaagctcacacggtctctggccgtctgcgaggaaagcagcgctaggcctggaggggagtctctgcaggaccagacactgtag

SEQ ID NO: 30832 - DNA, 1140 bp, Artificial Sequence
  Description of Artificial Sequence: Synthetic coding sequence
atgtggcaccttgatttcggcttgcataccgggaagacatttcagcctctcccctttattatcgtggtctacccgggagcgggtaggcgttgggggctggtgctttccctggcgagtcaccggaggcgaaccgaggccggagggggtacaggacctacaagtgacacaggctggggttgcatgctcaggtgtggtcagatgatctttgcccaggccctggtgtgccggcatctaggacgagattggaggtggacgcaaagaaagaggcaaccagattcctacttttccgtcttgaatgcctttattgataggaaggattcgtattattccatccaccagatcgcccagatgggagtaggagagggcaaaagcatcgggcagtggtacgggccaaacaccgtggcccaggtgctcaaaaagctagccgtgttcgatacatggagttccctcgcagtgcatatcgcgatggacaacacagtggtgatggaggaaatccgtcgcttgtgccgcacctctgtgccgtgtgccggtgccacagcctttcccgcagattcggatcggcactgtaacggctttcctgctggcgcagaggtgaccaatcgaccctctccctggcgccctttagtcttgttaatccctctaagactgggcttgactgacatcaacgaagcctacgttgaaacgcttaaacactgctttatgatgcctcagagtctgggagtcattgggggaaagcctaattctgctcactactttattggttatgtgggtgaggagttgatttacttggacccccatacaacccagcccgcagttgagcccactgacgggtgttttattccggatgagtcttttcattgtcaacacccaccttgtcggatgagcattgctgaactggaccctagcattgcagttgggtttttctgtaaaaccgaggatgacttcaacgattggtgccagcaagtgaagaaactctccctattgggaggggcattgcctatgtttgagctggttgagttgcagccatctcatctggcctgcccagatgtgttgaacctaagtctggactcttccgatgttgagcgtttagagcgcttcttcgatagcgaagatgaagacttcgagattctatccctgtag

SEQ ID NO: 30833 - DNA, 1683 bp, Artificial Sequence
  Description of Artificial Sequence: Synthetic coding sequence
atgagcgagcacagccgcaattcagatcaagaagagcttctcgacgaggaaattaatgaagatgaaatactggccaacctttctgctgaagaattgaaggaactccagtcagaaatggaggtgatggcgcctgacccttctctacccgtcggaatgatccagaaggatcagacagacaagcccccaaccgggaactttaatcacaaaagtctggtggactacatgtattgggaaaaggcctcacgccgtatgcttgaagaagaacgcgtgcccgttacatttgtgaaaagcgaggaaaagacccaggaagaacatgaagaaatcgagaagagaaacaagaatatggcccagtacctcaaagagaaactcaataacgaaatcgtagccaacaaacgcgagtccaaggggagtagtaacattcaggagactgacgaggaggacgaggaggaggaggacgacgacgatgacgacgaaggcgaagacgacggcgaagaatctgaggagactaacagggaggaggaaggcaaggcaaaggagcagattcggaattgcgagaataattgtcaacaagtcactgacaaagccttcaaagagcagcgtgacaggcccgaggcacaggaacaaagcgaaaagaagatttccaagttggatcctaaaaagctcgcattggatacaagtttcctcaaggttagtactcgccctagcggtaaccagactgatttggacgggagcctgcgcagggtgaggaagaatgatcctgatatgaaggagctgaatctcaataatattgagaacatcccaaaggaaatgttgctggactttgtgaatgccatgaagaaaaacaagcacattaagacattcagtctcgccaacgttggcgctgacgagaacgtggcattcgcccttgctaacatgttaagagaaaacaggtcaattactacgctcaatatcgagtcaaatttcataacaggtaaggggatcgttgccatcatgagatgcctccagtttaatgaaacattgactgagcttcgatttcataaccagaggcatatgttaggtcatcatgctgagatggaaattgctcggctcctgaaagcgaataatactctgctgaagatgggctatcattttgaactgcctgggccaaggatggtggttaccaacctcttgacacgcaatcaggataaacagcgccagaagaggcaggaagaacaaaagcagcagcagctgaaggaacaaaagaaactgattgctatgttggaaaatggactcggcctgcccccaggtatgtgggagctgctaggcggacccaaacctgactctaggatgcaagagttctttcagcccccacccccaagaccacccaacccccagaatgttcctttttcccagagatctgagatgatgaagaaacccagtcaagctcccaagtataggacggaccctgactcgttcagagtagtgaagcttaaacggattcagcgaaagagccggatgccagaggcgagagaaccgccagaaaagacaaaccttaaagacgttataaaaaccctgaagcccgtccctcggaaccgaccaccacctctcgtcgagataacgccacgggaccagttactgaatgacatccgccacagttcagtggcatacctgaagcccgttcagttgcctaaggagctggcctag

SEQ ID NO: 30834 - DNA, 330 bp, Artificial Sequence
  Description of Artificial Sequence: Synthetic coding sequence
atgaacccagcctccgcgcctcctccactgccaccccctgggcagcaggttattcatgtgactcaggatttagacacggatctcgaggcccttttcaactctgtgatgaatcccaagccgtcttcttggaggaagaaaatcctgcccgagagtttctttaaggaacctgatagcggatcccattcacggcagtccagcaccgactctagtgggggtcaccctggcccaagactcgctggcggagctcagcacgtccgctcacattccagtccggcatccctgcaactaggtaccggggcaggggctgccggaagtcctgcccagcaatag

SEQ ID NO: 30835 - DNA, 609 bp, Artificial Sequence
  Description of Artificial Sequence: Synthetic coding sequence
atgggtagcaggaagaaagaaatagcactgcaggtcaatatatcaacccaagaattgtgggaggagatgctcagctcaaaaggcctgacagtggtcgatgtataccaaggatggtgtggaccatgtaaaccagtggtgtccctgtttcagaagatgaggatagaggtggggcttgacctgttacactttgcacttgctgaggccgacaggttggacgtgctggaaaagtacagaggaaagtgcgaacccacttttctcttctatgctggtggggaattggttgctgtagttaggggagccaacgcccctctgttgcagaagacaatcctggaccagctggaggccgagaagaaggtgctcgccgaaggacgcgagcgaaaagtcattaaggacgaggccctgtccgatgaggatgagtgcgtttcacacggcaaaaataatggggaggatgaggacatggtttccagtgaaagaacttgtacgctggcgataattaaaccagatgccgttgcacacggcaaaacagatgagatcattatgaaaatccaggaggcaggcttcgaaatcctcactaacgaggagcgcaccatgactgaagctgaggtgtag

SEQ ID NO: 30836 - DNA, 195 bp, Artificial Sequence
  Description of Artificial Sequence: Synthetic coding sequence
atggcacctcagaaagaccggaagcccaaaaggagcacgtggagattcaacttggaccttactcacccggtggaagatggtatatttgattctgggaactttggcacattcccttcagagtatttaggcttcagcagcttggttcttcactttttctgctttaagatcggggcaataagcacaggagaagggtag

SEQ ID NO: 30837 - DNA, 372 bp, Artificial Sequence
  Description of Artificial Sequence: Synthetic coding sequence
atggagaacctacagactaacttttcgcttgtgcagggctctactaagaaactgaacggtatgggagatgacgggagtcctccagcaaaaaaaatgattaccgatatccacgctaacggtaagaccataaataaggtgcccactgttaaaaaggagcacctcgatgattacggggaggcgccagtggagaccgacggtgagcacgtaaaacgaacctgcaccagcgtgcccgaaaccctgcatttgaatcctagcctgaagcacacccttgcacaatttcacctgtcatcacagagctcacttggcggacctgcggcattctccgccagacactctcaagagtcaatgtcacctaccgtttttctcccctag

SEQ ID NO: 30838 - DNA, 201 bp, Artificial Sequence
  Description of Artificial Sequence: Synthetic coding sequence
atgaatccatcaatgaaacaaaagcaggaagagataaaagaaaacatcaaaaacagtagcgtgccacgcagaaccttaaagatgatccagcctagcgcctccgggtccctggtagggagggaaaatgaactgtcagctgggctcagcaaaagaaagcatagaaacgatcaccttacgtccacgacctcttcccctgggtag

SEQ ID NO: 30839 - DNA, 1614 bp, Artificial Sequence
  Description of Artificial Sequence: Synthetic coding sequence
atggtgcttattctggggagaaggctcaacagagaagacctcggcgtcagggattctccagcaacaaaaaggaaggtctttgagatggatccaaaatctctgacaggccacgagttcttcgactttagcagcggaagcagccacgccgagaatatactgcagatatttaacgagtttcgtgatagccggctgttcaccgacgtaataatctgcgtagagggcaaagagtttccttgccacagagccgtgctgtcggcatgcagttcatacttcagagccatgttttgtaatgaccacagagaatcgcgcgaaatgctggtggaaatcaacggtatcctggctgaggctatggagtgtttcttgcagtacgtttataccgggaaggttaagataacgaccgagaatgtccagtacctgttcgagacctctagcctgtttcagattagtgtcctgagggacgcgtgcgccaagttcctggaagaacaactggacccttgcaactgcctgggcattcaacggttcgccgacactcatagcctgaaaaccctgtttacgaagtgtaaaaactttgcccttcagacttttgaagatgtttcgcagcacgaagaattcctcgagctcgacaaggacgaactcatcgattacatctgttccgacgagttagtgataggaaaagaggagatggtctttgaagctgtgatgcggtgggtgtatcgagctgttgatctgaggcggccactgctgcacgaactcctcacccacgttcgcctgcctctgcttcatcccaactatttcgtgcagactgtggaggttgaccagcttatccagaatagccctgaatgttatcaattactccatgaggcgcgtcgctatcatatccttggaaacgaaatgatgtctccccgaacacgaccaagacggagcaccggctattccgaggtgatcgtcgtcgtcgggggatgtgagcgtgtgggtggcttcaatcttccctatactgagtgctatgaccccgtgaccggtgaatggaagagtctagcaaaactccctgaattcactaagagtgaatatgctgtctgcgccctgaggaatgacatcctagtctccggaggcagaattaatagccgcgacgtctggatatataactctcaactgaatatctggattagagtcgccagtcttaataaaggccgatggcgacataaaatggctgtcctcctggggaaagtgtacgtagtcgggggatacgatgggcagaaccggctctcaagcgtggaatgttatgatagtttctcaaaccgctggaccgaggtcgctccattgaaggaagccgtgagttcacctgccgtcacctcttgtgtcggaaaactttttgtgatagggggaggcccagatgataacacgtgctccgacaaggttcagtcatatgaccctgagaccaacagttggctgctgagggccgctattcctattgccaagcgatgcataacggccgtgagccttaacaacttaatttatgtagcaggtggactcacaaaagcaatttactgctatgaccctgtcgaggattattggatgcacgtgcagaacactttttctagacaggtgatcacctag

SEQ ID NO: 30840 - DNA, 1611 bp, Artificial Sequence
  Description of Artificial Sequence: Synthetic coding sequence
atgaggttggaggagctaaagagactgcagaatcccctcgaacaagtgaacgatggcaagtatagtttcgagaacatccagcgagcatggagagagtatctccagcggcaggaaccattgggcaagcggagcccttcaccaccatctgtttcttcagaaaagctgagcagcagtgtctcaatgaacacgttctctgattcttcaacccctgactacagggaagatggtatggacctcggcagtgacgcagggtcaagcagtagttcaagtcgggcttctagtcagtcaaatagtacaaaggtgactccttgtagcgaatgcaaatcaagttcatctcctggtggcagcctcgatcttgtgtctgcactggaggattacgaagagcccttccctgtgtatcaaaaaaaggtcatagacgagtgggctccagaagaggacggggaggaagaagaagaggaggacgagagggaccagcgaggttatcgcgacgatcggagccccgcaagagagcccggagatgtgagcgccaggactaggtccggcggagggggagggcgttcagcaaccacagctatgcctcctccggtgcctaacggcaatctgcaccagcacgacccacaagacctgagacacaacggaaacgtggtagttgcaggacgtccaagctgctcccgcggaccgagacgcgctatccagaaaccccaacccgctggagggcgtcggagtgggagaggtccggcagctggcggactgtgcctgcaaccacctgatggagggacatgcgtccctgaagaacctccagtgccacctatggactgggaggccctggagaaacatcttgctggactgcagttcagggagcaggaagtacgaaatcaggggcaggctagaacaaacagcacaagcgcccagaagaatgaacgggagtccatcagacagaagctggccctgggaagctttttcgatgacgggccaggaatttatacaagctgttcaaagtccggaaagcccagtctgagctctaggctacagtccggaatgaacctgcagatttgctttgtcaacgactccggaagtgacaaggactccgatgcagacgatagcaagaccgagacctcattggatacaccgctgagcccaatgtccaaacagtcttcctcttactctgacagagataccaccgaggaagagtccgagtctctcgatgatatggatttcctcacccggcaaaagaagcttcaggccgaggccaagatggccctggccatggcaaagcccatggctaaaatgcaagtggaagtcgagaaacaaaaccgcaagaagagtcccgtcgccgacttgctaccacatatgcctcacatctccgagtgcctgatgaagcggagtctgaagcccactgacctgagggacatgaccattggtcagctgcaggtgatcgtgaatgacctgcactcccagattgagtctctcaatgaggaactggttcaactcctacttatacgagatgagctacataccgaacaggacgccatgcttgtcgatatcgaagacctgactaggcatgcggagtcccaacagaaacacatggcagaaaaaatgccagctaagtag

SEQ ID NO: 30841 - DNA, 630 bp, Artificial Sequence
  Description of Artificial Sequence: Synthetic coding sequence
atgagcgaaaacgccgctcctggcctgatctctgaactgaagttggccgttccatggggtcatatagccgctaaagcttggggctcgttacagggaccgccagtcctttgtctacatgggtggctggataacgctagcagcttcgataggctgattcctctcctcccacaagatttctactacgtagcaatggatttcgggggacatgggttaagcagtcattatagtcctggtgttccctactatctccagactttcgtgagcgagatccgaagagtggtcgccgcactgaaatggaaccgcttttccatcctgggtcacagctttgggggagtggtggggggaatgttcttctgcacttttccagagatggtggataagcttatactgctagatactcccttgttcctgctggagtcggacgagatggagaacctcctgacctacaagcgcagggccatcgagcacgtgctgcaagtggaggccagccaggaacccagtcacgtcttctccctcaaacagctgctgcagcgtcttcttaaatccaactcccacctgagcgaggagtgcggagaactgctcctccagcgtgggaccaccaaagttgcaacagggagagagcagcattag

SEQ ID NO: 30842 - DNA, 201 bp, Artificial Sequence
  Description of Artificial Sequence: Synthetic coding sequence
atgccagaagatcaggtaggcaaattggaagcgacagagaacacaataagcgcaatggccgcagccgctgccgagcagcaacagttttacctgctgctcggcaatctgctgtccccagacaacgtggtccgtaagcaggcagaggaaacatatgagaatattccaggtcaaagtaagattacatttcttttgcaggcctag

SEQ ID NO: 30843 - DNA, 2061 bp, Artificial Sequence
  Description of Artificial Sequence: Synthetic coding sequence
atggccatttcacagcatcaattttaccttgatcggaagcagtcaaaagcaaaaatcccgtcagcacgatctttggacgagatcgccatggacctgacggagaccggcactcagagagccagtaagttggtgactctggagaccaagtctcaatttattatggccagcaatggaagcctgatatcttccggatcgcaggactccgaggttagtgaggagcagaaaagggaaaaaatcctggaattaaagaaaaaggaaaaacttttacaggagaaactactcaagaaagtggaggaactcaagaagatctgtttgagggaggctgaattgactggcaaaatgcccaaagagtatcctctgaacattggggagaaaccccctcaagtgcgtcggcgagtcggcacagcctttaaactggacgacaacttgcttccctcagaagaggaccccgcactccaggagctggagagcaatttcctgatccagcaaaagctggtggaggccgctaagaagctggcaaacgagccagacctgtgcaagactgtaaaaaagaagagaaaacaggattacacagatgccatgaagaaactgcaggaaattgagaatgcgattaacgagtacaggatccgctgcggaaagaaaccctcccagaaggctaccgtactgcccgaagacattattcccagcgagtcgagcagcctgagcgacacaacaacatatgatgatccatcagatgcctttacctttccaggccagagaagcagcagtgtcccacatagtcccaggattcttcctccaaagtccctgggtattgaacgtatccattttcgcaaatcgtccattaacgaacaattcgtggataccagacagtccagagagatgctctccacccatagctccccatataaaactttggagaggcgcccacagggcggtcgctcgatgcctactacaccagtcctgactcgcaacgcttactcctccagccatttagagcctgagagtagcagccagcactgccgacaacgatccggttcactggagtctcaatctcatctcttgtccgagatggatagcgacaaaccatttttcagtctcagtaagtcacagagatcatcatcgacggagatactggacgacggaagcagctacactagccagtcttctacagaatactactgcgttactccggtcaccggaccatactacaccacccaaacccttgatacacgtacccggggacggagaaggtcaaagaaacagaatgtcagcacaagtaactcaggttcaatgcccaatttggcacaaaaggatagtctgcgaaacggagtatactccaaatcccaggaacctccatcgagttcgtattatatcgccggatacacaccatacgcagaatgcgatttttactacagtggagggtacgtctatgaaaatgacaccgagggccaatacagcgtaaacccttcttaccgctcctctgcccattatggctatgagcgccagcgcgactactctcggtcgttccacgaggacgaagtggaccgagtacctcataacccctacgcgaccctcaggcttcccaggaaagcggcagctaagtctgagcacatcaccaaaaacattcataaggccctcgttgccgagcacttgagaggatggtatcagagggcatcaggacagaaagatcaggggcacagtccacagacctcttttgactctgaccgcggatcccagcgctgcctggggtttgccggattgcaagttccgtgttcccctagctctcgtgcatcatcttattccagcgtgtcctccacaaacgcttcgggtaactggcgcacccagctgacaataggtctgagtgattacgaaactccagctcatagcagttatacctcttgttacggaaacgtgtataatcctctgcctagtccatctcgtcagtataccgaaatttcccagcttgatggaacagatggtaatcaattagaagacaacttagaatcaagcgagcagagattattttggcatgaggattcgaagcctggcactctggtttag

SEQ ID NO: 30844 - DNA, 219 bp, Artificial Sequence
  Description of Artificial Sequence: Synthetic coding sequence
atgatggaggagatttctattatggttgcctacgacgcgcacgtcttctcacagctgcatgacgaggacttcctgacatcattggtagctattagcaaacccagatccatggtaccgaccaagaagcttaaaaagtatgagaaggagtaccagacaatgagagaatctcaactgcagcaggaagaccccatggataggtacaaatttgtctacctttag

SEQ ID NO: 30845 - DNA, 1965 bp, Artificial Sequence
  Description of Artificial Sequence: Synthetic coding sequence
atggacagtttacctgatgaatttttcgtgaggcacccggctgttgaggaccagagaaaggaggaaacagaaaacaaactggagaagagctccggtcaattgaacaagcaagagaatgacatacccacagacttggtgcccgtcaatcttctgctcgaggtgaagaagttactgaatgccatcaatacgctcccaaaaggcgtggtcccacacatcaaaaaattccttcaagaggatttctctttccaaaccatgcaacgggaggtggccgctaactcacagaacggcgaggagatcgttcccgctctgacgctgagatttctgatcacacagctggaagctgcactgaggaacatacaggccggaaattacacagcccaccagatcaatattgggtactaccttactttactcttcttgtacggcgtcgcgcttactgaacgcggaaaaaaggaggactacacagaagccgagaataagtttcttgttatgaaaatgatgatccaagagaacgagatttgcgagaacttcatgtctcttgtatactttggccgagggttgctcaggtgtgcacaaaaacgctacaatggaggactgctcgagttccacaaatctcttcaggagatcggcgataaaaacgaccactggtttgacatcgaccctaccgaagacgaggaccttcctaccactttcaaggaccttctgaacaacttcattaagactacggaatcaaacataatgaagcagacgatctgtagttacctcgattgtgagaggtcctgtgaagcggacatcctgaagaacacctcatataaggggttctttcagttaatgtgttctaaatcctgttgcgtctacttccacaaaatatgttggaaaaagttcaagaacctgaaatatccaggggaaaatgaccaatcattttcaggcaagaagtgtctgaaggaaggctgtacgggagacatggttagaatgcttcagtgtgatgtgccaggaatcgtaaaaatcctgtttgaggtagtgcgcaaagacgagtacatcactattgagaacctgggagccagttaccgtaagcttatcagtttgaaaataacagataccgacatcaggccgaaaatctccctgaagtttaatactaaggatgagatgcccatctttaagcttgactataattacttttatcatctgctgcacatcatcattatttccggtaccgatatcgttaggcagatctttgatgaggcaatgccgcctccactgttgaaaaaggagcttctgattcataagaatgttcttgaatcgtactacaaccacctgtggaccaaccaccctttgggaggatcgtggcatctgttatacccgccaaataaagagctccctcaaagcaagcagttcgacctttgtttgttgttggcgctgattaagcatctcaacgttttcccagctcctaagaaaggttggaatatggagccaccatcatctgacatctccaagtccgccgacattcttcgtctttgtaagtatcgtgacattcttctgagtgagatcctcatgaacggcctgacggaatcacaatttaattccatctggaagaaagtgtccgacattttattgcgactcggtatgatgcaggaagacatcgataaggtgaaagaaaaccctatcgagaatatttctttagactaccatcagctcagtgtgtatctggggatacctgtacctgagatcattcaacggatgctgagttgctatcagcagggaatcgctttacagtcgataaccggttcgcagaggattgagatcgaagagcttcagaacgaggaagaagagctgtctccaccactgatggagtacaacattaacgtcaagtctcaccccgagattcaattcgcagaaattaataaagatgggaccagcatcccttctgagtcttcgaccgaaagcctgaaggatctccaggagtag

SEQ ID NO: 30846 - DNA, 570 bp, Artificial Sequence
  Description of Artificial Sequence: Synthetic coding sequence
atgaatccggctagtgctccaccccctctcccgccacccggacagcaggtgatacacgtcactcaagatcttgacaccgacctcgaggcactgttcaattccgtcatgaatcctaagccttccagttggaggaaaaagattctgccagaaagcttctttaaggaaccggactctgggtctcacagccggcagtcctccacagattcatcagggggacatcctggcccaagactggcaggtggcgcacagcatgtaagatcccactcttctcccgcaagcctgcagttgggaactggcgcaggagctgccggtagtcctgctcaacaacatgcccacctgcgccagcagagctatgatgtgacggacgagttgccactccctcccggatgggaaatgaccttcaccgccactgggcaacggtactttctgaatcacattgaaaagatcactacgtggcaagatccccgaaaggcgatgaaccagcctctgaatcatatgaaccttcatccagctgtgtcatccacgcctgtaccacaaaggagcatggctgtaagtcaacctaacctgtag

SEQ ID NO: 30847 - DNA, 849 bp, Artificial Sequence
  Description of Artificial Sequence: Synthetic coding sequence
atgggtcctctgccgcgaacggtcgagctgttctacgacgttttgagtccttattcatggctaggattcgaaatactttgtaggtatcaaaacatctggaacatcaacctgcagctaagaccaagtctgatcactgggattatgaaagatagcggcaacaagcctcccggactgctgccccgaaaaggcctttatatggctaacgacctgaagctgttaagacatcatctgcagatccctatccacttcccaaaagacttcctgtctgtgatgctcgaaaaagggtccctgtctgctatgcgcttcctcacagccgttaacctcgagcaccctgaaatgctcgaaaaagcttccagggagctctggatgagggtgtggtctcgcgtgagcgttggtctctgggaaagctctggacgcactctagatgatttcttaactttccccaggcacgttttcagagttatgatcctccctccgcctggtgggtcgactgtgctgcctgtgacaccactgagtccgcacaggcttccagccgtgttttcttcttcccagaacgaagacattactgaacctcagagtatcctcgccgctgcggagaaggctggcatgagtgcggaacaggctcagggcttattggagaagatcgcaacaccaaaggtcaaaaaccagctgaaagagaccactgaggctgcatgtaggtacggagccttcgggttacccattacggtggcccacgtggacggacagacccatatgctctttggtagtgacagaatggagctcctggctcatctactcggcgagaagtggatgggccctatcccgccagccgtcaatgcacggttatag

SEQ ID NO: 30848 - DNA, 1221 bp, Artificial Sequence
  Description of Artificial Sequence: Synthetic coding sequence
atggaccagttagagaacgccaagatggaacacactaacgcctctttcgatacctttttttgtgaaactcgcgctggcaagcacgtccctcgcgctctcttcgtggatttagagcccacagtcatcgatggtataaggacaggccaacacaggagcctgttccatccagaacagctcctgtctgggaaggaggatgccgcaaacaattacgcacggggtagatattcagtaggaagcgaagtcatcgacctcgtgctcgaacgaacacgtaaattggccgagcagtgtggcggtctgcagggctttctaatctttaggtctttcggcggaggcacaggttcagggttcacatctctgctaatggaacgtcttaccggtgagtactctagaaagacaaaactggagttcagcgtgtacccagcgcctcggatcagcactgccgtggtcgaaccctataactccgtgctcaccacacactctaccaccgaacatacagattgcactttcatggtcgacaatgaggctgtctatgacatatgccaccgcaagcttggggtcgagtgccccagtcacgcctcaattaaccgtttagtggtccaagtggtgagcagtatcactgcatccttacgttttgagggccctctaaacgtggacttgatagagttccagaccaatctggtcccgtaccccaggatacacttccccatgacagcctttgccccaatcgtgagtgcagataaagcttatcacgagcagttctctgtgtctgatatcaccacggcatgtttcgaatcgagtaatcagctggtaaagtgcgatcccaggctaggaaaatatatggcttgctgcctactttataggggggacgttgtgcctaaggaggtaaacgcagccatagcggctaccaaatctagacactctgtgcaatttgtcgactggtgccccaccggatttaaggtgggcattaataatcggcctcccaccgtgatgcccggaggtgacctcgcaaaggtgcatagatccatatgcatgcttagtaatacaaccgcaattgtggaggcttgggcacgacttgatcacaagtttgatttgatgtacgccaagcgggcttttctacattggtatcttagggaggggatggaggaagcggaattcctagaggcacgggaagaccttgctgccttggagcgcgactacgaggaggttgcccagagcttctag

SEQ ID NO: 30849 - DNA, 1860 bp, Artificial Sequence
  Description of Artificial Sequence: Synthetic coding sequence
atgtccggccttgtgctcggtcagcgggacgaacctgccggacaccggctgtcacaagaggagatactgggatcaacccggttggtgagccagggcctggaagccctcaggtcggagcatcaagccgtactccagtccctatcacagaccatcgagtgcctgcagcaaggaggacatgaggagggactggttcacgaaaaggccaggcagctgcgacgttctatggagaacatcgagttaggtctgtccgaagctcaggtgatgctggcgcttgcttcacatctctcaacagtggagtcggagaaacagaaactcagagcccaggtgaggcgactttgccaggaaaaccaatggttgcgggacgagctagcgggtacccaacagcgactgcagagaagcgagcaggcagttgcccaactggaggaggagaaaaagcacctggaatttcttggccagctgagacagtatgatgaagacggacatactagtgaggagaaggagggcgacgcaaccaaggactctctggatgacctctttcccaatgaagaggaagaggatcccagcaatgggctgtccagaggacaaggagctactgccgcacaacagggaggctacgaaatacctgctagactgcggactctacacaacttagtcattcagtacgcagcgcagggaagatacgaggttgctgtacccctctgtaaacaggctctggaggatctggaacgcacatctgggagaggacatcctgatgtagcaacgatgctgaatatcctggcactcgtgtacagggatcagaacaagtataaagaggccgcacatttactcaacgatgccctttctatacgcgagtctacattggggccagaccatcctgctgtggcggcaacgctgaacaacctggcagttctctacgggaaacgaggcaagtacaaggaggccgagcccctgtgtcagcgtgcactggagatcagggagaaggtgctcggaacaaatcatcccgacgtcgcgaaacagctgaataatttagccctattatgccagaaccagggtaaatacgaagctgtggagcgctactaccaaagagctttggctatatacgaggggcagctggggccagacaaccccaacgttgccaggactaagaacaatctcgcgagctgttatctgaagcaaggaaagtatgccgaggccgagactctttataaggagattctcacgagagcacacgtccaggaattcggaagcgtcgatgacgatcataaacctatttggatgcatgcggaggagagagaagaaatgagtaagtctagacatcacgaaggcggaactccatatgcagagtacgggggttggtataaagcatgtaaggtctcttcccctacagtgaatacaactctgcggaatcttggcgctctgtaccgaaggcaaggtaaactcgaagcagcggaaactttagaagagtgtgctctccggtcccggaggcaggggacagaccccatttcccaaaccaaagttgccgagttgcttggggaatccgatggtcgcaggaccagtcaggagggaccgggagattccgtcaagtttgaggggggagaggatgcatccgtcgctgtggagtggtccggggacggaagcggcactctgcaaaggtccggttctctcggcaaaattagggacgttctgcgcagaagtagtgaacttcttgtccggaagttgcagggcactgagcccagaccgtcatcctccaatatgaagagagccgcttcccttaattacctgaatcagccctctgccgctcccctgcaagttagccgcggactgtccgcctctacaatggatttatccagttcttcatag

SEQ ID NO: 30850 - DNA, 294 bp, Artificial Sequence
  Description of Artificial Sequence: Synthetic coding sequence
atgggtaagtcctgcaaggttgtggtgtgcgggcaggcatccgtggggaaaacctctattttggaacaactgctatatggaaaccatgtggttgggtcagaaatgatcgagacacaggaggacatttacgttggctcaatagaaaccgaccgcggagtgcgggaacagattgctgagagtctgttttccgtgtggagttgctctcgcaggcgcctgactaatccacgaactagacgtcgctcccccagctggagcctcgccacctctgtaacttaccgctcatctggcgtgtag

SEQ ID NO: 30851 - DNA, 387 bp, Artificial Sequence
  Description of Artificial Sequence: Synthetic coding sequence
atgacagacctcgtagccgtttgggacgtagctcttagtgatggagtgcataagatagaattcgaacatggcacaaccagtggcaaacgtgtggtctatgttgatggaaaggaagaaatacgcaaagaatggatgttcaagctcgtgggtaaggagaccttttacgtaggcgctgccaaaacgaaagctacaattaacatagacgctatctctgggtttgcatacgagtatacgctggaaatcaatggtaagagtttgaagaaatatatggaggatcgctctaagactaccaacacgtgggtgttacatatggacggcgagaatttccgcattgtcctggaaaaggatgcaatggatgtgtggtgtaacgggaagaaattagaatag

SEQ ID NO: 30852 - DNA, 879 bp, Artificial Sequence
  Description of Artificial Sequence: Synthetic coding sequence
atgaccgtgagtaaatttatggctattcagaaggcattgcagcccgattggttccagtgcctaagtgatggggaggtgtcttgcaaggaggccacttccatcaaacgcgtccgaaaaagtgtagatcggagcttgctgtttctcgataactgcctgagactgcaagaagagtctgaggtgcttcagaaatctgtcattatcggtgtcatcgaaggcggtgacgttatggaagaaagactgcgaagtgctagggaaaccgcaaaaaggccagtcggcggttttctgctagatggtttccagggcaatccaaccacacttgaagcgcgtctgcgactgctcagttcagtaacagccgagttacctgaagataagccaagactcattagcggagtcagcagaccagatgaagtgctagagtgtatagaacgcggagtggatctctttgagagctttttcccgtaccaggttactgagcggggatgcgcgttgactttttcctttgactatcagccaaatcctgaagagacccttctccaacagaacggaacacaggaggaaatcaagtgcatggaccaaataaagaaaatcgaaactaccggatgcaaccaggagatcacctctttcgaaatcaatctgaaagaaaaaaaatatcaggaggattttaatcctttggttaggggatgttcgtgctattgttgtaagaaccacaccagagcctacatccaccacctgttggtcaccaacgaactcttagctggcgtattactgatgatgcacaactttgagcattatttcggatttttccactacattcgggaagctcttaagtccgataagttagcacagttaaaggagctgattcatcgccaggccagctag

SEQ ID NO: 30853 - DNA, 600 bp, Artificial Sequence
  Description of Artificial Sequence: Synthetic coding sequence
atgcgcttccgtttttgcggcgacttggactgccctgattgggtgctggcggaaataagcacccttgccaaaatgtcttccgttaagttgcgcctgctttgttctcaggtactcaaagagctgctgggccagggcatcgactacgaaaaaatcctcaagctgaccgcggatgccaagtttgagtccggtgatgttaaagcgacggtggcagtgctgtcctttattctgtcatccgcagcgaagcactccgtcgacggcgaatctctgtcaagcgaactgcagcagttgggattacccaaagaacatgccgcaagtttgtgcaggtgctatgaagagaagcaaagtccactccagaagcacctgagggtttgttccttaaggatgaaccgtctggccggagtcggctggcgtgttgattacaccctctcctctagtctgctccagtctgtggaggagcccatggtgcacctccgcctagaggtggccgcagcccctggcactccagcacaacctgttgcgatgtccctgagcgcggataagttccaggtgctgctcgccgagctgaagcaagcccaaaccctgatgagttctttagggtag

SEQ ID NO: 30854 - DNA, 354 bp, Artificial Sequence
  Description of Artificial Sequence: Synthetic coding sequence
atgccagaggatcaggttgggaaattggaagctactgaaaacacaatatccgccatggcagccgcagctgccgaacagcagcagttctatctgctgctcggcaacctactgtcccctgataatgtagtccggaaacaggccgaagaaacctacgaaaatatcccagggcagtcaaagattacctttcttctgcaggctatcagaaacaccactgctgccgaagaagcccgacaaatggcggcagtgctgcttaggagactgctgtcctctgcgtttgatgaggtctaccccgctctgccgagcgacgttcagacagctatcaagagtgagctcctgatgatcatccagatgtag

SEQ ID NO: 30855 - DNA, 888 bp, Artificial Sequence
  Description of Artificial Sequence: Synthetic coding sequence
taaacaaagttggctaccggcagtaaagacaccacagttatcatctggcaggttgatccagatacgcacctgctaaaattgttgaagacgctggagggacacgcttacggcgtgtcctatatagcctggtcacctgacgacaattacctagttgcttgcggacccgatgattgctcagaactctggctctggaacgtgcaaactggtgagctgcgcactaagatgtctcagtctcacgaagacagcttgacttcagtcgcttggaacccagacgggaagcggttcgttactggcggtcagagggggcaattttaccagtgcgatcttgacggaaacctgctggatagttgggaaggagtaagggttcagtgcttatggtgcttatcagatggaaagactgttctggctagtgatacccaccagcgtatacgcggatacaattttgaggatttgactgacagaaatattgtacaggaagatcaccccataatgagcttcaccatctctaagaacgggcgtttagctttgttaaatgttgctactcaaggcgtacatctgtgggatctccaggatcgcgtgctggtccggaagtatcagggggttacacagggcttctacacaatccactcctgtttcggtggccacaatgaggattttattgcatccggctcagaggaccataaagtttatatctggcataaacgttctgagctgcctatcgctgagctgacggggcacaccagaactgtgaattgcgtcagctggaatccacagattccttctatgatggcctcagcatctgacgatgggacagttcgtatatggggcccagcaccattcatcgaccatcagaacatagaagaagagtgctcgagcatggactcttag

SEQ ID NO: 30856 - DNA, 1053 bp, Artificial Sequence
  Description of Artificial Sequence: Synthetic coding sequence
atggcaaggtggattcccaccaagcggcaaaagtatggagtggccatatataattacaatgccagccaggacgtcgaactttctctacagatcggcgacacagtgcatattctcgagatgtatgagggatggtatcggggttataccttgcagaacaagtctaaaaagggaatcttccccgagacttatatccacctcaaagaggccacggtggaggaccttgggcaacatgaaaccgttattcccggagagttgcccctagttcaggaactcactagcacacttagggaatgggcagtgatctggcgtaagctctacgttaataataagctgactctgtttagacagctccagcagatgacatactccctgatagaatggaggagtcagattctgtccgggactctgcctaaggacgaactggctgaattaaaaaaaaaagtgaccgcaaagatcgatcacggcaatcgcatgctcggactggacctggtggtgcgggatgataacgggaacatcctggacccggacgaaacatccacgatcgcacttttcaaggcccacgaggtggcctctaagcgcattgaggagaagatccaagaggagaaatcaatcctgcagaacctggatcttcgtggccaaagcattttttccacaattcatacttacgggctctatgtcaatttcaagaatttcgtgtgtaacattggcgaggatgctgaattgttcatggccttgtatgaccccgatcagtccacatttatctctgagaactacctcataagatggggcagcaacggaatgccaaaggaaatagagaagctcaacaacctacaggccgtgtttacagatctttcctccatggatctcatacgtccacgtgtgtctcttgtgtgtcagattgtgagggtcggtcatatggagttaaaagaagggaagaagcacacgtgcggcctgcgtaggcccttcggagtcgccgttatggatattaccgatattatccacgggaaagttgatgatgaagagaaacagcactttataccgtttcagcagtag

SEQ ID NO: 30857 - DNA, 360 bp, Artificial Sequence
  Description of Artificial Sequence: Synthetic coding sequence
atgccagaggatcaggttggcaagctggaagctacagaaaacaccatcagtgccatggccgcagccgcagccgagcagcaacaattctacctgctgcttggaaacctgttatcgcccgacaatgtggtgcgaaagcaggcggaggaaacatatgagaatatccccggtcagagcaaaatcacattcctgctgcaggctatccggaataccaccgcagctgaggaggccagacaaatggccgctgtgttactgagaagactgctctctagtgcgtttgatgaggtctacccagctctcccctccgacgtgcagaccgccattaaatcagaactgttgatgatcatccaaatggaaacttag

SEQ ID NO: 30858 - DNA, 279 bp, Artificial Sequence
  Description of Artificial Sequence: Synthetic coding sequence
atgtctggactggttctaggacagagggacgagccagcgggacaccggctttcacaggaagaaatcctcggatctaccaggctggtttcccaggggctagaagctttgcgctccgaacaccaggctgtgctgcagagcctctcccagacaatcgaatgtctccaacagggaggacacgaagagggtctggtgcacgaaaaggcacgacagctgagaaggagcatggagaatatagagctgggattaagtgaagctcaagtgatgctcgcgctggcctag

SEQ ID NO: 30859 - DNA, 405 bp, Artificial Sequence
  Description of Artificial Sequence: Synthetic coding sequence
atggtcctgatactagggagacgtctaaatagagaggatttgggagttagagacagtcccgcaacaaaacgaaaagttttcgagatggaccctaagtcactcaccggacacgagttctttgacttttcaagcggatcaagccatgccgagaatatactgcagatctttaacgagttccgagattcccggcttttcaccgatgtaatcatctgcgttgagggtaaggaatttccttgtcaccgcgcagttctgtctgcctgctcatcatacttccgggctatgttctgcaatgaccatagagaatccagggaaatgcttgtggaaattaacgggattctcgctgaagcgatggagtgtttcctccagtatgtatacactgggaaggtgaaaatcaccaccgagtag

SEQ ID NO: 30860 - DNA, 312 bp, Artificial Sequence
  Description of Artificial Sequence: Synthetic coding sequence
atggcagagctgatccagaagaaattgcagggcgaagtggagaagtaccagcagttacaaaaggacttgtctaaatccatgtcgggccgtcagaaactggaggctcagcttacagagaacaatatcgtgaaggaagagttggccctcctggacggtagtaacgtggtgttcaaactacttggacctgtactcgtgaaacaggaactcggcgaagctcgggctaccgtgggcaaacggctggactacatcacagctgagatctttttgagaacaatccccgaccctggggacgttcctgactcattcttctag

SEQ ID NO: 30861 - DNA, 1923 bp, Artificial Sequence
  Description of Artificial Sequence: Synthetic coding sequence
atgggcaggagaagcggcctcctgggattgagacccggtccggaaccagttgctctggagcgtgtgataaataaggtgcacctgaaagcaaatcatgtggtgaagagagatgtcgacgagcatttgcgcatcaagactgtttacgataaatccgtcgaagaacttctgcccgagaaaaagaatctagtgaaaaacaaattattcccacaggctatctcctacctggagaaaaccttccaggttaggcgtccagccggtaccattctcctttcgcgacagtgcgcaaccaaccaatacctcaggaaggagaacgatccgcataggtactgtacaggcgaatgcgcggcacacaccaagtgtgggccagtgattgtgcccgaggaacatctccagcagtgcagagtgtatcggggagggaagtggccccacggagctgtgggagtgccagatcaggaggggatttccgatgctgatttcgtgctgtatgtcggggcactcgctaccgagagatgcagccatgagaatattatcagttacgccgcttactgtcagcaagaggcaaatatggataggccaatcgctggctacgcaaacctgtgtcctaatatgatttcgacacaaccccaggagttcgtcgggatgttgagcactgtcaaacacgaggtgattcacgctctcggtttttcagccggtctcttcgccttctaccacgacaaagacggcaatcccctgacctcaaggtttgccgacggattgccccctttcaattactccctggggctgtatcagtggtccgacaaggtcgtgcggaaggtagaaagattatgggatgtgagggacaataagattgtgaggcacacagtctaccttctagtgacacccagagtcgtcgaagaggccagaaaacactttgactgtccggtccttgaaggaatggaacttgagaaccaaggaggggttggcacagaactgaaccactgggagaaaagactgcttgaaaatgaagcgatgacgggttctcatacacaaaacagggtgctcagcagaataactctagcactcatggaagacaccggatggtataaagccaactactcgatggcagagaagttggattggggcaggggaatgggctgcgatttcgtgagaaagtcctgcaaattttggatagatcaacaacgacagaagcgtcaaatgttatcgccctactgtgatacacttcggtctaatcccctccagctgacatgtagacaagaccagagggctgtggcagtgtgcaatctgcagaagttcccgaagccactgccacaggagtaccaatacttcgacgagttgagcggcatccctgcagaagatcttccgtattacggagggagcgtagagattgcagattattgtcctttcagccaggagttttcttggcacctgtccggtgagtatcagcgcagttccgactgtcgaatcctcgaaaaccagccggaaatctttaagaactacggcgctgagaagtacggccctcactccgtctgtttaatccagaagagtgcctttgtcatggagaaatgcgaacggaagctcagctaccccgactggggctctgggtgttaccaggtgagctgttcccctcagggcctgaaggtttgggtccaggatactagttacttgtgtagccgcgctgggcaggtgctgcccgtttccattcagatgaatgggtggatccatgacggcaatctgttgtgtccttcctgctgggacttctgtgagctgtgtcccccagagacagacccgcctgcaaccaacctgactcgggctctgcccctggacctgtgttcctgcagctcctctctcgtggtaacattgtggctgctcttggggaacctgttcccactgctagctggctttctgttgtgtatctggcactag

SEQ ID NO: 30862 - DNA, 783 bp, Artificial Sequence
  Description of Artificial Sequence: Synthetic coding sequence
atgaatttggattccgatggaatggacgacataatatctcaggagtcttcactcgatatggaaggcaattacaagaaagcgcagaagaatgagagggagagcatccgacagaagctggcactcggatcatttttcgacgatggtcctggaatctatacctcttgttccaagtccggcaaaccatcgctgtcatccaggctgcagagcggaatgaacctgcagatctgtttcgtaaacgattccggatccgacaaggacagcgatgcggatgactctaaaaccgaaaccagtttggacacgcccctgagccctatgtctaaacagagctctagctattcagacagagacaccactgaagaggagtctgagagccttgatgacatggactttctgacccgtcagaagaagctgcaggcagaagcgaaaatggccctagcgatggcaaaacccatggccaaaatgcaggtggaggtcgagaagcagaatcgcaaaaagagcccagtcgccgacctgttaccccacatgccgcacatcagtgagtgtctcatgaagagatctttgaaacctaccgatcttcgggacatgacaattggtcagctacaggtgatcgtcaacgatcttcactcacaaatcgagagtctcaatgaggagctcgtgcaattactgctgattcgcgatgaactgcatacagagcaggatgccatgctggtcgatattgaagatctgacacggcatgcggagtcccaacaaaaacacatggccgaaaaaatgccggcaaaatag

SEQ ID NO: 30863 - DNA, 633 bp, Artificial Sequence
  Description of Artificial Sequence: Synthetic coding sequence
atggccgctagcgtggagcaacgtgaggggaccatacaggttcagggccaagccttgtttttcagggaggctcttcctgggtctgggcaggctagatttagcgtgctgctattacatgggatacggttctcttccgaaacttggcagaaccttggcacgttgcacaggctggcacaggccggatacagagctgtggccatcgacctccccggtctggggcacagcaaggaagccgctgcgcctgcccctatcggtgagctcgcaccagggagctttcttgccgctgtagtcgatgccctggagctagggcctcctgtcgtcatctcaccgtccctgtctggtatgtattccctgccgtttctgacagcacctgggtcccaacttcccggttttgttcctgtggcgcctatctgtacggacaaaattaatgctgctaattatgcatccgtgaaaacccctgctttgatcgtctatggagaccaggacccaatgggccagacaagttttgagcacttgaagcaactgccaaaccatagggtgctaattatgaagggtgcaggtcacccctgttaccttgacaagccggaggaatggcatacggggctcctagattttttacaggggttacagtag

SEQ ID NO: 30864 - DNA, 381 bp, Artificial Sequence
  Description of Artificial Sequence: Synthetic coding sequence
atgaaccagcgatcccacttggggacaacttacctggacacagcaaagggggctgtagaaacttttatgaaacttagggctagggacccagcttcccggggagataggtatatgctagtcacatttgaagagcccccttacgccattaaagccggttggaaagagaatcatgctactttcatgaatgaattgaagaaccttcaggccgaaggactcaccactctgggacagtccctgcgaaccgctttcgacctgcttaatctgaacagactggtaactgggatcgacaattatggtcagggtcgaaatccatttttcctagagcctgccatcattatcaccatcacagatggatccaaattgacgacaaccagcggatag

SEQ ID NO: 30865 - DNA, 1188 bp, Artificial Sequence
  Description of Artificial Sequence: Synthetic coding sequence
atggcaaacgaccctctggagggatttcacgaggtaaacttagcttctcccacgtcgcccgatctactgggggtgtatgaatctgggacccaagagcagaccactagcccttccgtgatctacagaccccatccatctgcactttcatcagtacccatccaggctaatgctctggatgtatctgagcttcccacccagccggtgtattcatctccccgaagactgaactgcgctgagatatcatccatttcattccacgtgactgaccctgcaccgtgctcgaccagcggcgtcactgcaggactgactaaactgacaacacgaaaggacaattacaatgcagagagggaattcctgcagggggctactattacagaagcctgtgacggctccgatgatattttcggcctgtcaactgacagccttagccggctgaggtccccttccgtgctggaggttcgtgagaaaggctacgaaagactgaaagaggaattggccaaagcgcagcgagagctcaaactcaaggacgaggaatgtgagcgattgagtaaggtccgggatcagctggggcaggagctggaggagctgactgcaagcctgttcgaggaagcccacaagatggtcagagaggcaaatatcaagcaggctactgctgagaagcagctgaaagaggcccagggaaaaatcgacgttttacaggctgaagtggccgctctgaagaccttggtcctgtcatcatctccgacctcgcctacacaggagcccctgcctggtggcaagacaccattcaagaaaggacatacaagaaataagtccaccagctcagctatgtcaggttcccaccaagacctttccgtgattcagcctatcgtgaaagattgcaaagaagctgatttatctttatataatgaatttcggctgtggaaggacgagccgaccatggacagaacttgtccattcctggataagatttaccaggaggacattttcccatgtctgacattttcgaaaagcgaactcgcttcagcagttctagaagccgttgaaaacaataccctcagtattgagcccgtgggactccagcctatccggttcgtcaaggccagcgcagtggagtgtggcggaccaaaaagtctcctatacgtcacttttctgcataccttcgatacattctccagagactcatag

SEQ ID NO: 30866 - DNA, 786 bp, Artificial Sequence
  Description of Artificial Sequence: Synthetic coding sequence
atgggctcccggaagaaggaaattgcactgcaggtcaacatctccacccaggaactttgggaggagatgctcagctcgaagggcctgactgttgtcgatgtctaccaagggtggtgcggcccttgtaaaccggtggtgtcactgttccagaagatgcgaatagaagtgggcttggacctgctgcactttgctttaattaaggacgaggccctgagtgacgaagacgaatgtgttagtcatggcaaaaacaatggcgaagacgaggatatggtgtctagtgagcgcacctgcacactggctatcatcaaaccggacgctgtagcgcatggcaaaacagatgagataattatgaagattcaggaggccggtttcgagattcttacaaacgaagagcggactatgaccgaggctgaggtaagactgttttaccaacacaaggctggcgaagaggcatttgaaaaattagtccaccatatgtgttccggtcccagtcatttgctaatcctcaccagaactgagggcttcgaggacgtcgtgactacctggcgcactgtcatgggacccagagatccaaacgttgccaggcgggagcagccagaaagcctgagggcacaatacgggaccgagatgcctttcaacgcagtgcacggcagccgggatcgagaggatgcagaccgagaactcgcactgcttttcccctcgctgaaatttagcgacaaggatacagaagcaccccaaggggagtcctcaacacaacctaggcttaagatcactgatttggattag

SEQ ID NO: 30867 - DNA, 1284 bp, Artificial Sequence
  Description of Artificial Sequence: Synthetic coding sequence
atggtgtgctggcaggacctggaggaatcactccggatgaagctgagtctcactaaagtggttaatggatgcaggttgggcaagattaagaacctgggaaagaccggggatcacacgatggacattcctggatgcctactgtacacaaaaactggctctgccccacacttgacccatcataccctgcataatatccacggtgtgccggctatggcacaactcaccctatcttctctggctgagcaccacgaagttcttacagagtataaggaaggggtcggcaagtttatcgggatgcccgagagtctcctgtattgctcactgcatgaccctgtgtctccctgtcccgctggctatgtcacaaacaaaagtgtctccgtgtggtcagttgccggtcgagtggaaatgaccgtttctaaatttatggccatccagaaggccctccagcctgattggtttcaatgtctctcggacggggaggttagctgtaaggaagccacatctatcaaaagggtgagaaagagtgttgacaggtccctgctgtttttggacaactgtcttcgactgcaggaggagagtgaggtattacagaagagcgtgattatcggcgttatcgaagggggagacgtaatggaagagagactacgcagcgctcgggaaaccgcaaagcgaccagtcggtggatttttactcgatggatttcagggaaaccctacaacacttgaagcaagactgaggctcttgtcatccgtgactgccgaactgccagaagacaagccccgtttgatctccggagtatcccggccagacgaggttctcgagtgtatcgagaggggcgtagacctattcgagtcgttcttcccataccaggtaaccgagcgcggttgcgcactcaccttctcctttgattatcagccgaatcccgaagaaactcttctgcagcagaatgggacgcaggaagagatcaaatgtatggaccagatcaagaaaatcgagactactggctgcaaccaggagatcacgagtttcgagataaacctcaaagagaaaaagtatcaggaagatttcaaccctctggtgcggggatgtagctgttactgctgcaaaaaccacacccgcgcttacatccatcatcttctggtgacaaacgaactgctcgctggtgtcctcctgatgatgcacaattttgaacattattttggattcttccactatataagagaggccttgaagagtgacaagctcgcccagctgaaagagttaattcacagacaggcaagttag

SEQ ID NO: 30868 - DNA, 393 bp, Artificial Sequence
  Description of Artificial Sequence: Synthetic coding sequence
atgaaccaaaggtcgcatcttggaaccacttatctcgacacggcgaagggcgcagtcgaaacattcatgaagctgcgcgctagggacccagcctctagaggcgaccgctacatgctggtcacatttgaagagcccccatacgctatcaaagccggatggaaggagaatcatgcaacatttatgaatgaactcaaaaacttacaggcagagggcctgaccactctcgggcagagcctccggaccgctttcgaccttctgaatctcaatcgactggtcactggaatcgacaattatgggcagggcagaaaccctttctttttagaacctgcgattataatcaccatcaccgacggctccaagcttacaaccacgtctggagtgcaagacgagtag

SEQ ID NO: 30869 - DNA, 417 bp, Artificial Sequence
  Description of Artificial Sequence: Synthetic coding sequence
atgaatcctgcttccgctcctccaccattgccgccaccaggacagcaggtgatccatgttacgcaagatctggacacagacttggaagcactgttcaattctgttatgaatcctaagccatcatcctggagaaaaaagatcctgcctgaaagttttttcaaggagccggactctgggtctcactctcggcagtcatccaccgattcttctggcggacatccaggccctcgcctcgctgggggtgcacagcatgttaggtcccacagtagcccggctagcctgcaactcggaactggtgctggtgccgctggaagcccagcccagcagcacgcccacctgcgccagcagagctacgatgtgaccgatgaactccctttgccccctggatgggaaatgacatttaccgctactggctag

SEQ ID NO: 30870 - DNA, 1692 bp, Artificial Sequence
  Description of Artificial Sequence: Synthetic coding sequence
atgcgactggaagagctcaagaggctccagaatcctcttgagcaagtgaacgacggaaagtattcttttgagaaccaccagctggccatggacgccgagaacaatatagagaaatatccactgaacctgcaaccgctggagagcaaggtcaaaattatccagcgcgcatggcgcgaatacctacagagacaggaaccactgggcaagcgcagcccaagcccaccatcggtttcatcagaaaaattgagctccagcgtcagcatgaacaccttcagcgatagcagtaccccagattatagagaggacgggatggatctcggcagtgacgcaggctcgagctcttccagcagcagagcctcatcacagtccaactctaccaaagtcacaccttgcagtgaatgtaaatccagctcgtcaccagggggaagcctcgatctggtgagcgctctggaagactacgaggaacccttccccgtgtaccaaaagaaagtaatcgacgaatgggccccagaagaagacggtgaggaagaggaggaggaagacgaacgggatcagcgtggatatagggacgaccggtcacccgctagggagcccggagacgtcagtgccagaacacggtccggtgggggaggcggacgatcagccactactgcaatgccccctccggttcctaacggaaatctacaccagcatgaccctcaggatctacgccataacggaaacgtggtggttgcaggtcgaccaagctgcagcagagggcctagaagagccatccagaagccacagcctgccggtgggcgtaggagcggaagaggcccagccgcaggaggcttgtgtctccagcctcccgacggcggaacatgtgtgccagaagagccgcctgtgccccctatggactgggaggcactagagaaacaccttgcgggactgcagttccgcgagcaggaggtgcggaatcagggtcaggcaagaaccaatagtactagcgcgcagaaaaatgaaagggaaagcattcgccaaaaactggctctgggctcgttcttcgatgatggtcccggaatctatacttcctgcagtaagtccgggaagccatcgttgtcctcaagactgcagtctggcatgaatctgcaaatctgcttcgtaaacgattccggctctgacaaggatagcgacgccgacgactccaaaacagagacttcgctcgacacccctttgagtcctatgagcaagcaatcctccagttacagcgaccgggacactaccgaagaggagtcagaatcattagatgatatggatttcctcactaggcagaagaaactgcaagcagaagcgaaaatggcactcgcaatggccaagcctatggccaagatgcaggtcgaagtggagaaacaaaaccgcaaaaagtcacccgtcgccgacctgttgcctcacatgccacatatctccgaatgtctgatgaagcgatcacttaagccaacggatcttagggatatgaccattggccaactccaggttatagtaaacgacctccactctcagatcgaatccttgaacgaggaactcgtgcagctcctgctgattcgcgacgaattgcatacagagcaggacgccatgctagtagacattgaggacctgacgaggcatgcggagtcgcaacagaaacacatggcagagaagatgcccgcaaagtag

SEQ ID NO: 30871 - DNA, 228 bp, Artificial Sequence
  Description of Artificial Sequence: Synthetic coding sequence
atgcccgaagaccaggtgggtaagttagaggcaacggaaaataccatttctgcaatggccgctgcagctgcagaacagcagcaattttacctccttttgggaaatttactgtcccctgacaacgtcgtgagaaaacaagctgaggagacctatgagaacattcctggccaaagtaaaattacttttctgttgcaggccatcagaaacactacggccgcagaagagtag

SEQ ID NO: 30872 - DNA, 2712 bp, Artificial Sequence
  Description of Artificial Sequence: Synthetic coding sequence
atgcccgagcagttcagtgttgctgagttccttgccgttactgccgaagatttaagtagtccagcaggggctgcagctttcgcagcaaagatgcctcgctacaggggtgccgcacttgcacgtgaggaaattctggagggggaccaggccatcctgcagaggatcaaaaaggctgtcagagccattcattcaagcggactagggcacgtggaaaacgaggagcagtaccgcgaggcagtagaatctctagggaacagtcacttatctcaaaacagtcacgagctctccacagggttcttgaatctcgctgtatttacaagagaggtggccgctctatttaagaatttgatccagaacctaaataatattgttagctttcctctggactctctcatgaaggggcagttaagagacggtaggcaagactcgaaaaagcagctggagaaggcttggaaggactacgaggctaaaatggctaagctggaaaaggagcgcgatcgcgctcgggtaactggtggaatccctggcgaggtcgcccaggacatgcagcgtgaacggaggattttccagctccatatgtgtgagtacctgctcaaggcgggagagtcgcagatgaaacaaggcccagattttctgcagtcactgataaaattctttcatgcccagcacaactttttccaggacggctggaaggccgcacagagcttgtttccatttattgagaagctggctgcctcagttcatgccctgcaccaggcgcaggaggatgaacttcagaaactcacccagctgcgcgatagcttgcgcggaactctgcagttggagagccgggaggaacatctaagtaggaaaaactctggatgcggttactccattcaccagcaccaggggaacaagcaatttgggacagagaaagtcggcttcctctacaaaaagagcgacggaataagacgcgtctggcagaaaagaaagtgtggggtgaagtatgggtgcctgaccatctctcactctacaatcaatcggcctcccgtgaagctaaccttgcttacctgtcaggttcggcctaaccctgaggaaaagaaatgtttcgacctcgtgacgcataaccgaacgtatcacttccaggcagaagatgagcacgagtgcgaggcatgggtgtccgtgttgcagaattccaaggacgaagccctcagctctgcctttctgggggagccaagcgctggacctggtagttggggcagcgctgggcacgatggtgaaccccacgacctgacaaagctgctcatagccgaagtgaaatcacgaccagggaactcccagtgttgcgactgtggcgctgccgatccgacctggctctccacgaaccttggggtgttgacctgtatacagtgttcaggcgttcaccgagagttaggagtcagattcagtagaatgcagagtctgacactcgacttattggggccttctgagcttctcctggcactgaatatgggtaatacgtcatttaatgaggtgatggaggcccagctaccatctcatggaggacctaagccttccgctgaaagtgatatgggcacgcgcagggactatattatggccaagtatgtcgaacatcgtttcgctagaaggtgcacacccgagccccaaaggctatggaccgcgatatgtaacagagacctgctgagcgttcttgaggcatttgccaacggacaggattttggtcagccccttccaggccctgatgctcaagccccagaggagctggtgctgcatcttgcagttaaagtagccaatcaagctagcctcccgcttgtggacttcattatccagaatggcggacatctggacgcaaaggccgcagacggcaatactgccctacactatgccgctttatacaaccaacccgactgtttgaagctgttgttgaagggaagggcacttgtggggacagtaaatgaggccggagaaaccgccctggacatcgccagaaagaagcaccacaaagagtgtgaggagttattggaacaggcgcaggctgggacatttgctttccctctgcacgtggattattcttgggtgatcagtacggaaccaggtagtgacagcgaggaggacgaagaagagaagcggtgtctactgaagctgccagcacaggcccattgggcatccggcaggttagatattagtaacaaaacatacgagacagtggcctccttgggcgctgcaaccccccagggcgagagtgaggactgccctccgcctctcccagtcaaaaatagttccagaacactggtacagggctgcgccagacacgcctcaggggaccggtccgaagtatcctcgttgagctccgaggcacccgaaactcccgaatcactcggatctcccgcatcctctagctccctgatgtctcccctggaaccaggggacccgtcccaggcacctccaaatagtgaggagggcctaagagagccaccaggcacttcgagacccagcctgacttctggcaccaccccttctgagatgtacctgcctgttcggttctcaagcgaatctactcgatcctaccggagaggtgcacgaagccctgaagacgggccatcagcccgacagccattgccaagacggaacgtgcctgtcggtattacagaaggagacggatcgagaacagggagtctgccggcaagttcagtccaactgctgcaggactag

SEQ ID NO: 30873 - DNA, 522 bp, Artificial Sequence
  Description of Artificial Sequence: Synthetic coding sequence
atgccacggaaaggtacacagccgagcacagctaggcgccgtgaggagggcccacctcctccatctccagacggggcttcctccgatgcagagcccgaacccccatcggggcgaaccgaatccccagccactgccgcagaaaccgcaagcgaggagctggacaacaggtctcttgaggagattctgaactccatccctcccccaccccctcctgccatgactaacgaggccggagcccctaggcttatgattactcatattgtgaaccagaactttaagtcttatgccggtgagaagattctgggaccctttcataagcggttcagttgcattatcggacccaatgggtccggcaaaagcaatgtcatcgacagtatgttgtttgtgttcgggtaccgagcccaaaagataagatcaaaaaagcttagtgtcctgatacacaattccgacgagcacaaagacatccagagttgcacagtggaggtgcatttccagaagatcattgataaggagggtgactag

SEQ ID NO: 30874 - DNA, 2262 bp, Artificial Sequence
  Description of Artificial Sequence: Synthetic coding sequence
atgtattctcccattatataccaagccctttgcgagcatgtgcaaacccaaatgagtctcatgaacgacctgacaagcaagaatatccctaacggaattccagctgtaccgtgtcacgccccttcgcacagtgagagtcaagcaacgcctcactcttcctacggcctttgcacatcgacacccgtgtggtcacttcaacgtcccccttgcccccctaaggttcatagtgaagtgcaaaccgacggcaatagccagtttgcctcccaaggaaagactgtgtccgcaacttgtacagacgttttaagaaatagctttaataccagccccggagtcccttgcagtctccccaaaacagacatcagtgcgatcccgacactacagcagctggggctagtcaacggcatcctgccccaacaagggattcacaaggagacagacctgctgaaatgcatccagacttatctcagtctcttcagaagccatggcaaggagactcacttagatagtcaaacccaccgcagccctactcagagccaaccagcttttctcgctaccaatgaggaaaagtgcgccagggaacagataagggaggctacgagcgaaaggaaagatcttaacatccatgttagagacactaaaacagtaaaagatgtgcagaaagccaagaatgttaataaaaccgccgagaaggttaggatcattaaatatctgctgggcgagctgaaagctcttgtggcagaacaggaggatagtgagatccagcggctgattactgaaatggaagcatgcatctctgttttacccactgtgagcgggaacactgatatccaagtagaaatcgcgctcgcgatgcaacccctaagatctgagaatgcccagttaagacgacaattgcggattttgaaccagcagctccgcgaacagcagaaaactcagaagccctcaggcgcagtggactgcaacctggagcttttttcacttcaaagcctaaatatgagcctccagaaccagctggaggaatcgcttaaaagccaggagctgctgcagagcaaaaacgaggagctcctaaaagtaattgaaaatcagaaagacgagaataaaaagttctcaagtatcttcaaagataaggaccagacaatactcgaaaacaagcaacaatatgatattgagattactaggatcaagattgagcttgaggaggccttagtgaatgttaaatcatctcaattcaaattggaaacagccgagaaggagaatcaaatcctgggtatcaccctgcggcagagggatgccgaggtgactcgactcagggaactgacgaggacactgcaaacaagcatggctaagctgttgtccgatctgagtgtggacagtgcacggtgtaagccaggtaacaatctgactaagagcttacttaacatacacgacaaacagctgcagcatgatcccgctcctgcccatacctccatcatgagctacttgaacaagcttgagaccaactactcattcacacattcagagccactgtctactataaagaacgaagagaccatcgaaccggataaaacctacgagaacgtgctgtcctccagagggcctcagaattctaatactcgcggtatggaggaagccagcgctcccggaataatttcagctctgagcaagcaggacagcgacgaaggatccgagacgatggctcttatcgaggatgaacataatctagataataccatttatattcccttcgctaggtcaacccctgaaaagaagagccccctgtcgaagcggctctcgccccagccacaaatccgagccgctactacccaactcgtcagtaacagtggactcgcagtgtcaggcaaggaaaacaaactgtgtacacctgttatatgctcaagctcaactaaagaggctgaagacgcacccgaaaagctctctagagcttccgatatgaaagacacccagctgcttaaaaaaataaaagaagccataggcaagatccctgctgctacaaaggaacctgaagagcaaacagcttgccacggaccctcaggatgtttgagcaacagcctgcaggtcaaggggaataccgtctgtgacggcagcgtgttcaccagtgatctcatgagcgactggtccatttcgtcctttagcacctttactagcagggacgagcaggattttcgaaacgggcttgccgcactcgacgctaatattgccaggttgcagaaatcccttaggacaggcttgctggagaaatag

SEQ ID NO: 30875 - DNA, 219 bp, Artificial Sequence
  Description of Artificial Sequence: Synthetic coding sequence
atgatggaggaaatttccataatggtagcttacgatgcgcatgtgttctcgcagctgcacgatgaggatttcctgacctcactggtagcaatctcaaagcctcggtcaatggtccctactaagaaactgaagaaatacgaaaaagagtatcagacgatgcgagaatcacagttgcagcaggaggaccctatggataggtacaaattcgtgtatttgtag

SEQ ID NO: 30876 - DNA, 588 bp, Artificial Sequence
  Description of Artificial Sequence: Synthetic coding sequence
atgtggcatatgacccggaattggccactggtggggaaaacttccctgataacgcgttttatgtacgattctttcgataacacctaccaagctacaattggcattgatttcctgagcaaaacgatgtatctcgaggatcgaacagtgagactgcaactttgggacaccgcaggacaagagagatttcgtagtctgattccaagctacatacgcgattccacagtggcagtcgtggtttacgacatcactaacctcaattcattccagcagacatctaaatggatcgatgatgtacggaccgagcgtgggagcgacgtcattatcatgctggttgggaacaaaacagacctggcggataagcgccagatcactatcgaggagggggagcagcgggcaaaggaactgagtgtgatgtttattgagaccagcgccaagacgggctataatgtgaaacagctgttcaggagggtagcctctgctttgccagggatggagaacgtgcaggaaaagagcaaagagggcatgatcgacataaaactggacaaaccccaggagccacctgcaagtgaagggggttgttcgtgctag

SEQ ID NO: 30877 - DNA, 1047 bp, Artificial Sequence
  Description of Artificial Sequence: Synthetic coding sequence
atgtcgctaccgaggtttcagcgcgttaactttggcccttatgacaactacatacccgtctcagagctgtccaagaaaagctggaaccagcagcatttcgccctgctctttcctaagccgcagcgtcccggaaccaaacgacgctccaaacccagccagattagagacaatacggtgtcaattatagatgaggagcaactgcggggagatcgcagacagcccttatggatgtataggtcgttgatgcgtatatccgaacgcccatctgtgtacctggccgcaaggcgccagccgcttaaaccaactaggaccgtggaggtcgactccaaagcagcagagatcggcaaaaaaggtgaggataagactacccagaaggataccactgactcggaatctgagttgaagcagggaaagaaagattctaagaagggcaaggatatcgaaaagggtaaagaagagaagctcgacgccaagaaagattcgaaaaaaggcaagaaggatgctgaaaaaggcaaggactcagccacagagagcgaggatgagaagggtggcgcaaaaaaagacaacaagaaggacaaaaaggattctaacaagggcaaagattcagcgaccgagagtgaaggagaaaagggcggaaccgagaaggatagtaagaagggcaagaaggacagcaagaaaggtaaggatagtgcaattgaactccaggctgtcaaagcagacgagaagaaggacgaggatggaaagaaagacgctaataagggggacgaaagtaaggatgccaagaaggacgcaaaagaaatcaaaaaagggaagaaggacaaaaagaaaccgagttcaactgattcggacagtaaggatgatgtcaagaaagaatccaagaaggatgcgacgaaggacgcgaaaaaggtggcgaaaaaggacaccgagaaggagtccgccgactccaagaaagacgccaaaaagaatgcaaaaaaagacgcgaagaaggatgccaagaagaacgccaagaaggacgaaaaaaaagatgctaagaaaaaaggcaagtag

SEQ ID NO: 30878 - DNA, 2862 bp, Artificial Sequence
  Description of Artificial Sequence: Synthetic coding sequence
atgaagcggggaattagacgggatccattccgtaaaagaaagctcgggggacgggcaaaaaaagttcgtgaacccaccgcggtgaattccttttacagagaggcttccctgccctctgtatgggccagtcttagacggagggaaatggtacgctcaggcgcaagacccggacaggtgctttcctccggcaggcacacgggaccggctaagctaacgaatgggaagaaagccacctacctccgtaagatccctaggttcaatgctgatagcggctacagcattcattctgattccgagtcccaggctgagacagttcacgggctggatggttgcgcctccctgttgcgggacatattgaggaatgaagactcaggaagcgaaaccgcttatctcgaaaaccgttccaatagcagacctctcgaatcaaagcgctacggttcaaaaaagaaacgtcacgaaaaacacaccatccctctcgtggtgcaaaaggagacaagctcaagtgacaataagaagcagatcccaaatgaggcctccgcacggagtgagagagacacgagcgacctggagcagaactggagtctgcaggaccattaccggatgtacagccctatcatttaccaagctttgtgtgagcacgtccaaactcagatgtctcttatgaacgatctgacctcaaagaacattccaaatggcatccccgctgtgccatgccacgccccatctcattcagagagccaggccaccccccactcctcttacggactgtgtacctccacccccgtgtggtccttgcagagacccccttgccctcctaaagtgcactcagaggtccagaccgatggcaacagtcagttcgcctcccaaggaaaaaccgtgtctgccacatgtacggacgtgttaagaaactcctttaatacttcccctggagtcccctgctccctgcctaagacggacatctctgctatccctaccctccagcagctgggcttggtcaacggtatcttaccgcagcagggaattcataaagagaccgatcttttgaagtgtatccaaacctacctttccctgtttcgcagccatgggaaggaaacacatcttgactcccaaactcatcggagccctacccaatcgcagcccgcttttctggccaccaacgaggaaaagtgtgcgagggagcagataagagaggctacttccgagcgtaaggacctaaacatacatgtgcgagacacaaaaaccgtgaaggatgtgcagaaggccaagaacgtcaataagaccgccgaaaaagtgagaatcatcaagtatctcctgggcgaactgaaagccctggtcgccgaacaagaggactcagaaattcagcggctgataaccgagatggaggcctgcatcagcgtcctgccgactgtttctggaaataccgatattcaggtagaaatagccctagctatgcagcctctcagaagcgagaacgcccagttaaggcggcagcttcgtatcttgaatcaacagctccgcgaacagcagaagactcagaaaccatctggagcagtggattgcaaccttgaactcttcagcttacagtctctgaacatgagtctccagaatcagctagaagagtctctgaagagtcaagagctcctgcagagcaaaaacgaagagctgctgaaggttatcgaaaatcaaaaggacgagaacaaaaaattttccagcatttttaaagataaagatcagactatacttgaaaacaaacaacagtatgatatcgaaatcacaagaatcaagattgagctggaggaggcactggtcaacgtgaagagctcgcagttcaaacttgagactgccgagaaagagaaccaaattcttggcattaccctgaggcagagagacgctgaggtgactaggctcagggagttgactaggacccttcaaacctcaatggccaaactcctgtctgatctgagcgtcgactccgctcggtgcaagccgggaaacaatctgaccaagagcctcctcaatatacacgacaagcaattgcagcatgaccccgctcctgcccacaccagtatcatgagctacctgaacaaactggagacaaactactccttcacgcactcagagcccctcagcaccattaaaaacgaagaaaccatcgaacctgataagacctatgagaacgtactgtcctcaagggggccacagaattcaaacacccgtggaatggaggaagcgagcgctccgggtatcatatctgccctgagcaagcaggattccgatgaggggtctgagaccatggcattaattgaggacgagcataaccttgacaacacaatctacataccctttgcaagatcaacccccgaaaagaagtcaccactcagtaagagactcagtccacagccccagattcgggctgccacaacacagctagtgagcaactctggcctagccgtgagcggcaaggagaacaagctgtgcaccccagtgatttgctcaagcagtacaaaagaagccgaagatgctcctgagaaactctctagagcttccgacatgaaagatactcaactcctgaagaagattaaagaggccattggaaagatccccgctgccacgaaagagcccgaggagcaaactgcgtgccacggcccttcaggctgcttatcaaacagcttgcaggtgaaagggaatactgtatgtgacggtagtgtgttcacatccgacttaatgagtgattggagcatcagttcattttcgaccttcacttccagggacgaacaggactttcgtaacggacttgcagccctcgacgctaacatcgctagactccagaaatccctccggaccgggttacttgagaagtag

SEQ ID NO: 30879 - DNA, 1683 bp, Artificial Sequence
  Description of Artificial Sequence: Synthetic coding sequence
atgagtgagcattcaaggaattcagatcaggaagagttactggacgaggagatcaatgaggacgaaattctggccaacttgtccgccgaggaacttaaggagttgcagtccgagatggaggtcatggcccctgacccttcgctgcctgtcggtatgatacaaaaagaccagaccgataagcctccaactgggaattttaaccacaagtctttggttgattacatgtactgggagaaagcatcccgcagaatgctggaagaggagagagtacctgtgaccttcgtgaagtcagaggagaagacccaggaggagcacgaggagatcgagaaaaggaataaaaacatggcccagtatttaaaagaaaagctgaataatgagatcgtggcaaacaagagggagtcgaagggttcgtccaacattcaggaaaccgatgaagaggatgaagaggaagaggatgatgacgatgacgatgagggcgaagacgatggcgaggaaagcgaggagacgaatcgggaagaggaggggaaagccaaagaacaaatcaggaattgcgagaataattgtcagcaggtgactgataaggccttcaaggagcaaagagatagacccgaggctcaagaacaatccgaaaagaagatatcaaagttggatcccaagaagcttgctttggacacctcttttctgaaggtcagtactaggccctctggaaaccagacagatctagatggctctctgaggagggtcagaaaaaacgaccccgatatgaaggagctgaacttgaataacatcgaaaatatccccaaagaaatgctcctggactttgtgaacgcaatgaaaaagaataagcacattaagaccttctctttagccaacgtcggcgcagatgaaaatgtcgccttcgccctcgctaatatgctgagagagaataggtccatcactactctgaatattgaatctaattttataactggcaaagggattgtcgccatcatgcgatgcttgcagtttaacgagacattgacagagctccgattccataatcagagacatatgctgggacatcacgctgagatggaaatcgccagactcctaaaggctaacaacactcttttaaagatggggtaccacttcgaactgccaggacctcggatggtggtgacaaatctcttaaccaggaaccaggacaaacaacgtcagaagaggcaagaggaacaaaagcaacagcagcttaaggaacagaaaaaactgattgccatgttggagaacggccttggactgcccccaggcatgtgggaattgctcggaggtcccaaaccagactcacgtatgcaggagttttttcagccaccaccccctcgcccacccaatccacagaatgtgcctttttcgcagagatcagagatgatgaagaaaccatctcaggcgcctaagtatcgaacagaccccgacagttttcgggtcgttaagctgaaaagaatacaacgaaagtcacgcatgcccgaagctagagagccacctgaaaagactaatttgaaggacgtgatcaagacgttgaaacctgtcccacgcaatagacctccccctctggtcgagatcacgccgagggatcagttactcaatgatattcgccatagctcagtggcatatttgaaacctgtccagttgccaaaggaactagcttag

SEQ ID NO: 30880 - DNA, 153 bp, Artificial Sequence
  Description of Artificial Sequence: Synthetic coding sequence
atgcctgaggaccaggtagggaagctcgaggcaaccgagaacacgatttctgccatggcagcagctgcggcagagcagcagcagttctatctgcttttaggtaacctgcttagccccgacaatgtggtgcggaagcaggctgaggttacttag

SEQ ID NO: 30881 - DNA, 288 bp, Artificial Sequence
  Description of Artificial Sequence: Synthetic coding sequence
atggccattggaaaaagattggccactcttcctactaaggagcagaagactcagagactgatctctgagctgtccctcctcaaccacaaactgcctgccagagtgtggctccctaccgccggattcgaccaccatgtggtgagagtgccacatacgcaggccgtcgtgcttaatagcaaggacaaggctccatatctcatatacgtggaggtgctggaatgcgaaaacttcgatactacctctgtgcctgccaggatacccgagaatagaatcaggagcaccagatag

SEQ ID NO: 30882 - DNA, 1260 bp, Artificial Sequence
  Description of Artificial Sequence: Synthetic coding sequence
atggcgggaagtggctgcgcatggggagcagagcctccccgatttcttgaggcattcggcagactgtggcaagtgcagtctcgcctagggagcggatctagtgcaagcgtgtaccgggttagatgctgtggcaacccagggtctcccccaggggcactcaagcagttcttacccccagggaccacgggagccgcagcgtcagccgcagaatacggcttcaggaaggagagggctgccctcgagcagcttcagggacacaggaatatagtaacattgtatggtgtttttacgatacacttctccccaaatgtaccatctagatgtctgctcctggaacttctggatgtctctgtttcagagttgctgctctattcaagtcaccaagggtgcagcatgtggatgatacaacactgcgccagagacgtgctggaggccctggcattcttacatcatgaagggtatgtacatgccgatctgaagcccaggaacattctatggagtgcagagaacgaatgcttcaagctgatagatttcggactcagcttcaaagagggaaaccaggacgtgaaatatatccaaacagatggctatagggcccctgaagctgaactgcagaactgcctggcccaagcgggtctgcaatcagataccgagtgcacttcagctgtagacttgtggagccttggcatcattctgctggaaatgttctccggcatgaagctcaaacatacagttagatcccaggagtggaaggcgaattcaagcgctataattgaccacatctttgcctccaaggccgtcgtgaatgccgctatcccagcttaccacctgagggatttaattaagagcatgttacatgacgatcccagccgcaggattccggcagagatggctctgtgctcaccctttttttcgatcccctttgcccctcacatcgaggacctcgtcatgctgccaaccccagtgttgaggctgttgaatgtccttgacgatgattatctggagaatgaggaggagtatgaagacgtagtggaagatgttaaggaagagtgtcagaaatatgggcctgtcgtgtccctcctcgtgccaaaagaaaaccctggcaggggacaggtgttcgtggagtacgctaatgcgggagattccaaagccgctcagaagctgttgactggccgaatgtttgacgggaagttcgtggtggcaacattttatccattatcggcctacaaaagagggtacctctaccagaccctgctttag

SEQ ID NO: 30883 - DNA, 1272 bp, Artificial Sequence
  Description of Artificial Sequence: Synthetic coding sequence
atgccccgaaaggggacccagccttccaccgcccgtcggagggaagaaggaccccctccacctagcccagatggggcttcatctgatgcagaaccggaacctccatccggcagaactgagagcccagcaacggcagctgagaccgccagtgaggagctagacaatagatccttggaggaaatcctgaactccatcccacctcctccaccacccgctatgaccaacgaagcaggcgcaccacgcctaatgataactcatattgtcaatcaaaatttcaaaagttacgctggtgagaagatactcggaccctttcacaagcgcttttcatgcatcatcgggcctaacggatcagggaaatccaatgtgatcgactcaatgctctttgtgtttggctatcgcgctcagaagatccgtagcaagaagctctccgtacttatccacaatagtgacgaacacaaagacattcagagctgcactgttgaggtgcacttccagaaaatcattgataaggagggcgacgattacgaggtcattccaaatagcaatttttacgtgtctcggaccgcctgccgcgacaatacgtcagtgtatcatattagcggtaagaagaagacattcaaggacgtgggtaaccttcttagatctcacgggatagaccttgaccataacagattccttatcttacagggggaggtggagcaaattgccatgatgaagcctaagggccaaaccgaacatgatgaaggaatgttggagtatctggaggatattatcgggtgcgggcgtctgaacgagcctataaaggtcctatgcagacgcgttgagatattgaatgaacaccgcggagagaaattaaatcgcgttaagatggtcgaaaaagaaaaagacgcattggaaggagaaaaaaacatcgcaattgagttcttgactctggagaacgagattttccgcaagaagaatcacgtgtgtcagtattatatctacgaactgcaaaaacggatcgctgagatggagacacagaaggagaagatccacgaagataccaaagaaatcaatgagaaaagtaacatcctgagtaacgagatgaaggccaagaataaagacgtgaaagacactgaaaaaaagctgaacaagataactaagttcattgaggagaataaagagaagttcacacaactcgatctcgaagacgtgcaggtgcgagaaaagttaaagcacgccacttccaaggctaaaaagctggagaaacagctgcagaaggataaagagtag

SEQ ID NO: 30884 - DNA, 1113 bp, Artificial Sequence
  Description of Artificial Sequence: Synthetic coding sequence
atggaagagggagtcccttgtcccgcacccgcagcaaagctaacacctcctgtaaaaaaatctcaagatatgcatgacgaacgatctaagctcgtgaacgaatacgcttgtagggtgttggagctgctgggcatggggcacagactcttcgtgcccaggcttctggccacatcgaaagaggatctgctgcaggccgacttcgagggagccctgaaatttttccgcgtgcaactcccaaagcggtaccgcgcagaagagaatgccaggcggcttatggagcaggcatgcaacattaaagtgcccactaaaaaactaaaaaaatatgagaaagaataccagacaatgcgggaatcacagctccagcaagaggaccccatggaccgctataaaagagaaaaccgccgactgcaagaggcctccatgagactggagcaggagaatgacgaccttgcccatgagcttgtgaccagcaagattgcgctccgtaatgacctggaccaggccgaggacaaggccgatgtgttaaacaaggagctgctgctgactaaacaacgcctggttgagaccgaagaagagaaaaggaagcaggaggaggagacggctcagctgaaggaggtgttcaggaagcagctcgagaaagccgagtacgaaattaaaaagacaaccgccataatcgccgagtataaacagatttgtagccaactaagtacccggctcgagaagcagcaggctgcgtccaaagaggagctcgaggtggtgaaagggaagatgatggcctgcaaacactgttcggacatttttagtaaggagggagccctgaaactcgcagctaccgggagagaagaccagggtatagagaccgacgacgagaaggactccctgaaaaagcagctaagagaaatggaactggagctcgcacagaccaagctgcaacttgtggaggccaaatgtaagatccaggagctcgaacatcagagaggtgccctgatgaatgaaatccaggccgctaagaacagctggttctccaagaccctgaacagcatcaagaccgcaactgggacacagccgctccaacccgcacctgtcacccagccacccaaggagtccacatag

SEQ ID NO: 30885 - DNA, 2262 bp, Artificial Sequence
  Description of Artificial Sequence: Synthetic coding sequence
atgtactcgcctatcatatatcaggctctctgtgaacacgtacaaacacaaatgtccctgatgaacgacctgacctccaagaatatcccaaacggcatcccggctgtgccctgtcatgcccctagccacagcgaaagccaagccaccccccattcatcatatggattgtgcacttctactcctgtatggagtctgcagcgccctccctgccccccaaaggtgcatagtgaagtgcaaactgatggaaacagccagtttgcttcccaggggaagactgtcagcgccacttgtacagacgtgcttagaaatagctttaatacctctcctggagtgccgtgttccctacctaaaaccgacatttctgccattcctacccttcagcagttggggctcgtcaatgggattctacctcagcagggtatccacaaggagacagatctgctgaagtgtattcagacgtacctttccctatttcgctcccatggaaaggagacacatctcgactcgcagactcatcggtcaccaacacagtcccagccggcatttctcgcaacgaatgaggagaaatgcgcaagggagcagatcagggaggccacatcggaaaggaaggatctgaatatccatgtccgggacacgaaaaccgttaaggatgttcaaaaagccaagaatgtgaataaaaccgcagagaaggtccggattatcaagtatctcctcggcgaacttaaagctctggtggccgaacaggaggacagtgagatacagcgtctaatcacagagatggaggcgtgtattagtgtgttgccgaccgtatccggcaacacagatatccaggtcgagatcgctctggccatgcaacccctccgctccgagaacgcccagctccgacggcaactgcgcatattaaatcagcagcttagagaacagcagaagacacagaaaccttctggcgctgttgattgtaatcttgagctgttctctctccagagcttgaacatgtcattacaaaatcagttagaggaatccttaaagtcacaggaactgcttcaatcaaagaatgaggagttactgaaagtcatcgagaatcagaaggacgaaaacaagaaattctcatcgatcttcaaggacaaggaccagactatactagagaataagcagcagtacgatatcgaaatcacccgtattaagattgaactggaagaggccctggttaacgttaagtcttcgcagttcaaacttgagacagctgaaaaagagaatcagattttaggcatcaccttgcgccagcgggacgccgaagtgaccaggttgagggagctgaccaggacactgcagaccagcatggccaagctcttaagtgatctgagcgtcgatagcgcacgctgcaaaccaggtaataatctgacaaaatctctgcttaatattcatgataagcaactgcagcatgaccccgctcccgcacacacatcaataatgagttacctcaataagctcgaaactaattacagtttcacccactccgaacctctgagcacaatcaagaatgaggaaactattgagcctgataaaacttacgaaaatgtgttgtcatctcggggaccacagaatagtaatacccgcggtatggaagaagcatccgcacctggaataatctctgcactgagcaagcaagatagcgatgagggatccgaaaccatggccctgatcgaggatgaacacaatttagacaacaccatttacatcccctttgccagatcaactccagagaaaaaatccccactctcgaagagactgtctcctcagcctcagatcagggcagcaactacacaactggtgtccaacagcggattagctgtctcgggcaaggaaaataagctctgcaccccggtaatttgcagtagctccaccaaggaagccgaagacgcaccagaaaagctcagccgcgcatctgacatgaaggacacccagttgctaaagaaaattaaggaggcaataggaaagattcccgctgcaacaaaagagcccgaggagcagactgcatgccatggaccatcaggttgtttaagcaacagtctgcaagttaagggcaatacagtgtgcgacggttcagtgttcacttcagatctgatgagcgattggtccatcagcagcttctctacatttacctcccgcgatgagcaggactttcgcaatgggctagctgcattggatgctaacatagctagactccagaaatctttaagaactggcctgctggaaaagtag

SEQ ID NO: 30886 - DNA, 2067 bp, Artificial Sequence
  Description of Artificial Sequence: Synthetic coding sequence
atgtcagtcaacagtgagaaaagtagttcttcagaaagacctgagcctcaacaaaaggcgccacttgtcccaccgccaccacccccaccccctcccccacctccaccgctccccgatcctactcccccagagcccgaggaagaaatcctgggctctgatgacgaggagcaggaagatcccgctgattactgcaagggaggctatcatcctgtcaaaattggtgatctgtttaacggcaggtatcacgttataagaaagctcggctggggccatttctcgacagtatggttgtgctgggacatgcaggggaaaagattcgtggccatgaaagtggtcaagagtgcccagcactatacagagaccgcactcgacgaaataaagctccttaagtgcgtccgggagagcgatccctccgaccccaataaagatatggtcgtgcaactgattgatgacttcaaaatttccggaatgaacggcatccacgtgtgtatggtcttcgaagtgcttgggcaccacctgctgaagtggatcataaagtctaattatcaaggcctccctgtgagatgcgtgaaatctattattcggcaggtcctccagggacttgactatttgcactctaagtgcaaaattatacataccgacattaaacctgagaatattctgatgtgcgtggatgacgcttatgttcgcagaatggctgcggaggcaacagagtggcagaaggccggagcaccccctccttctgggtcagccgtgtcaaccgctcctcagcagaagccaatcggaaaaatctcaaagaacaagaaaaaaaaattgaagaaaaagcagaagcgacaggctgaattgttagaaaaacgactgcaggagatagaggagctggaaagggaggcagaacgtaagatcatcgaggagaacataacttctgcagctccatccaacgaccaagatggagaatactgtcctgaagtcaaactcaaaacaacaggcctggaggaagccgctgaggccgaaactgctaaagacaacggggaagcagaagaccaagaggaaaaggaggacgcagaaaaggagaacattgaaaaggacgaagatgacgttgatcaagaactagccaatattgatcccacttggatcgagagcccgaaaacaaatgggcacattgaaaatggaccatttagcctcgagcagcagttagacgacgaagatgacgatgaggaggactgccccaatcctgaagagtacaatctcgatgagccgaacgcagaaagcgactatacatactcctcttcctatgagcaattcaacggtgagcttccaaacgggcgacataaaatccctgagtctcaattccctgaattctctacatccctgttctccggttctctcgaaccagttgcatgcggcagcgtgttatccgaagggtctccgctgacggaacaggaagaaagttccccttcgcacgacagaagcaggactgtatccgcatcaagcaccggcgatcttcctaaagccaagacaagggcggctgatttattggttaatcctttggaccctcgaaatgccgataagatccgggtgaagatcgccgatctcggtaacgcatgttgggtgcataagcactttacagaggatatccaaacccggcagtaccggtcaatcgaagtgctgataggcgcagggtacagtacacccgctgacatctggagcaccgcctgtatggcctttgaactggcgacaggcgattatctcttcgagccacatagtggggaggattacagtcgcgatgaagatcatatcgctcatattatcgagctgctgggcagcattccacgacattttgccttgagcggcaagtactccagggaattttttaaccgccgtggagagctccgacacataactaaacttaagccatggtccttgtttgatgtactggtggagaaatatgggtggccccatgaggacgccgctcagtttactgacttcttgattcctatgttggaaatggtgcctgaaaagagagcatcagccggagaatgcctccggcacccctggctgaactcctag

SEQ ID NO: 30887 - DNA, 543 bp, Artificial Sequence
  Description of Artificial Sequence: Synthetic coding sequence
atgccgaggaagggcacacagcctagtacagcaagacgccgagaggaaggacctccgccaccaagtccagacggagcgtcttcagatgccgagccggaacctccgtctggacgcactgagtcacctgccactgccgcagagaccgcaagcgaggagcttgacaatagaagcctggaagaaatcctgaattccattccaccaccacctcctccagccatgacaaacgaagctggagcacccagactcatgattacacatattgttaaccagaacttcaaatcatatgccggagagaaaatcttgggcccttttcataagcgcttcagctgtatcataggacccaacggttcgggaaaatctaacgttattgattcaatgttattcgtgtttggctacagggcccagaaaattcgaagcaagaaattatcagttttgattcacaattccgatgagcataaagatatccagagctgtacggttgaggtgcattttcagaagattatcgacaaggaaggcgacgattacgaagtgatccccaactag

SEQ ID NO: 30888 - DNA, 4689 bp, Artificial Sequence
  Description of Artificial Sequence: Synthetic coding sequence
atgcccggagaggcggcacgcgctgaactgctccttccagaggcagatcgacccggtcctcgcaccgacctgagctgcgacgcagcggctgccaccacgatcttgggaggagataggagagagccctgcgccttgactccgggaccatcacatctggcccttactttcttacctagcaaaccaggagccaggcctcagccagagggagcgagttgggatgccggacccggaggagcgccttccgcctgggccgaccccggtgagggcggtccatcccctatgctcttgccagaggggctgtcaagccaggccctgtccactgaggcaccgctgcccgcaactctggaaccacgcatagtgatgggagaggaaacctgccaggctctcttaagccccagagctgcacggactgccctgcgggaccaggaaggcggtcacgcctcccctgacccacctccagagttgtgtagtcagggagatctgagcgtcccaagcccaccaccagatcctgacagtttcttcacacctccgtctacacccacaaaaacaacctacgccctgctgccggcttgcggaccacacggggacgccagggacagcgaggctgagctgcgcgacgagctcctggacagcccccctgcaagcccatcagggtcttatattaccgctgacggagactcctgggcaagttcccctagctgttccctcagcctgctggcacccgcagagggtttggattttccttcaggatgggggctttctccgcagggatctatggtagacgaacgggagttgcatccggctggaactcctgaaccaccctcaagtgagtctagcttatctgccgatagttcatcctcttggggacaagagggtcatttttttgacctggattttttagcaaatgatcccatgataccggcagccttgcttccttttcaaggatctctgattttccaagtcgaggcagtggaagtgacacccctctcccccgaggaggaggaagaagaggcagttgccgacccagacccaggtggggatcttgctggcgagggggaagaagacagcacgagcgccagcttccttcaatcactctcagacctgtctatcacggagggtatggatgaggcttttgcatttagagacgacacaagcgccgcttctagcgactctgatagcgccagctacgcagaagctgacgacgagcggctgtattccggtgagcctcatgcccaggccacacttctgcaggactcagtgcaaaaaactgaggaggagagtggaggcggagctaagggcctgcaagcccaggatgggacagtctcctgggctgtggaggccgctcctcaaacaagtgaccgtggggcttacctctcacagaggcaggagctgatctccgaggttactgaggaaggcttagcattggggcaggagagtacagcgaccgtcactcctcacactttgcaagtagcaccaggcttacaggttgaagtggccacccgggtcaccccccaagccggagaagaggagactgacagtactgccggtcaggagtccgcagcaatggccatgccacagcccagccaagaaggcatttcggaaatcttgggccaagaatcagtgaccgctgagaagttaccaactcctcaggaagaaacgtctctcaccctgtgccctgactcaccacaaaaccttaaggaggaaggtgggctcgacctcccctctggacggaaacccgtggccgctgcgaccatcgtccccaggcaggcaaaggaagaccttaccctcccccaggactctgccatgactcccccattacccctgcaggacactgacctgtcttctgcgcctaaacctgttgccgctgccactatcgtatcccagcaggccgaggagggtcttactttacctcaagacagcgtgatgactcctccacttccattacaggacacagagctgagctccgcccctaagcccgtggccgcagcaaccttagttagtcaacaggccgaggaaggcctcaccctcccacaggattctgccatgactcccccactcccactgcaggatacggatctaagcagcgctcccaagcctgtggcagctgccaccctggttagccagcaagccgaagagggcctcaccctgccacaggactccgctatgacaccccctctacccctccaggatacagacttgtctagcgctccgaaacctgtggccgctgccactctagtttcccagcaagcagaagaaggactgaccctgccccaagactctgctatgacgcctccactgccactccaggatactgatctgtcctctgctccaaagcccgtggcggcagctaccatcgtgtctcagcaagcagaggaggggctcacactgcctcaggatagtgccatgactccacctctcccactgcaggacacagatctcagttccgccccaaagccagtggccgctgccacaatcgtgtcgcagcaagcagaagagggcctgacactgccccaggacagcgccatgacccctccactcccgctgcaagatactgacctgtccagcgcgccaaagccagtagctgcagctaccccggtctcacagcaggcagaagagggtttgactctgccccaggattctgcgatgaccccccctctgccactccaggataccgatctgagttcggcccctaaacccgtggccgctgcaactcctgtgagccaacaagccgaggagggcctgactttgccgcaggactctgccatgacagcaccactgccactccaggacactgggccaaccagcggaccagaaccgctggctgtagctactccacaaaccctgcaggcagaggccggttgcgctccaggcacagagccagtggccacgatggctcaacaagaagttggcgaggccctgggccctagacccgcacccgaagagaagaacgccgcactgccaactgttcccgagccagctgcacttgatcaggttcagcaagacgacccccagcccgctgctgaagccggtactccatgggctgcccaagaagacgcggactcaacccttggaatggaagcactctcactcccagaacccgcaagcggtgcaggggaggagattgccgaagctctttctcggcctggtagagaggcttgcctggaggcccgtgcccacactggcgacggagcgaagccagactcaccccagaaggagaccctggaagtcgagaaccaacaggagggcggtctaaaacctctggcccaagagcatggacctcgatctgctctcggtggcgctcgggaagtacctgatgcgcctccagccgcatgcccggaggtgagccaggcacggctgcttagccctgcaagagaagagaggggattgtcaggcaaatccacgcccgagccgactcttcctagtgctgtagccaccgaagccagtctggactcttgccctgagtcctccgtaggtgccgtttcctctctagatagggggtgtccagatgcacccgctcccacctctgctccaacctcccagcaaccggaacctgtactaggcttaggctcggtggagcagcctcacgaggtgcccagtgtgctggggacccccttgctgcagcctccagagaacctagcgaaggggcagccttccacgcccgtggatcgccctctgggcccagacccctccgcccctggcacccttgcaggcgctgcgcttccaccactagaaccccctgccccttgcctgtgtcaggacccccaagaggattcagtagaagacgaagagccccctgggtcactgggcctgcccccaccacaggctggagtccagcccgcagcagccgcagtgtccggtaccactcagccactggggactgggcctcgcgtctccctaagcccacactccccgctcctgtcaccaaaggtagcttccatggacgccaaggatctagcccttcaaattttacccccttgtcaggtaccaccacctagcggtccccagtccccagcagggcctcaagggctgtccgctcctgagcaacaggaagacgaagactctcttgaagaggacagtccaagagccctggggtccggccagcacagcgacagccacggcgaaagcagcgccgaattggacgaacaggacatactggcccctcagacagtgcagtgtccggctcaggctcccgcaggaggttccgaagagaccattgcaaaggccaagcagagccgctctgagaaaaaggcgaggaaggccatgagtaagctgggcctgcgtcagatacaaggcgtcactaggattacaattcagaaatccaagaatatcctcttcgtgatagccaagccagacgttttcaagagccccgcttcggacacgtacgtagtcttcggtgaggctaaaatcgaggacctatcacagcaggttcacaaggctgccgctgaaaagttcaaggtgcccagcgaaccgtctgctctcgtaccagagtccgcgcctagacctagggtgcgcctcgagtgcaaggaagaggaagaggaggaggaagaagaggtcgacgaggcaggcctggagctgagggatattgaactcgtgatggcacaggctaatgtctcaagggctaaagcggtacgagccctgcgggacaaccactcagacatcgtgaacgctattatggagctgactatgtag

SEQ ID NO: 30889 - DNA, 3294 bp, Artificial Sequence
  Description of Artificial Sequence: Synthetic coding sequence
atggcagcggcagcggctgaacaacagcagttctatctgctgctgggaaacctgctctctcctgacaacgtcgtacgaaaacaagcagaggaaacatacgaaaatattcccggtcaaagcaaaatcacttttttgctgcaagccatccgcaacaccaccgccgctgaggaagctagacaaatggccgctgtactcttgcgtagacttctttcctccgcattcgacgaagtttacccagctttgccttctgacgtacagaccgccattaaaagcgaacttctgatgattatacagatggaaacgcagtcaagtatgcgcaagaaggtgtgcgatattgccgctgagctagcgagaaatttgattgacgaagacggtaacaaccagtggcctgaagggctgaaattcctgttcgatagcgtgagcagtcagaacgtggggctcagggaagcagcactgcacatcttttggaatttccctggcatctttggcaatcagcaacagcactacctagatgtgatcaagcgcatgctagtccagtgcatgcaagaccaggaacatccttcgattaggaccctctctgcaagggccaccgctgcctttatcctggccaatgagcacaacgttgccctatttaaacatttcgcagacctgctaccgggttttctacaggctgtaaacgattcgtgctatcagaatgacgactctgttttaaagtccctggtggagattgccgataccgtgccaaagtacctgcggcctcacttggaagctacattgcagctgtctctgaaactttgcggcgatacgtccctgaataacatgcagcgccagctagcactagaagtgatagtaacactgtctgagaccgctgcagccatgctgcgaaaacacactaacatcgtggcccagacgatcccccaaatgctagcgatgatggtagacctggaggaggatgaagattgggcaaacgccgacgaactggaggatgatgatttcgactcaaatgctgtagctggggagagcgccctcgaccgaatggcttgtggattgggtgggaagctcgttctacctatgattaaggaacacatcatgcaaatgctgcagaatccggactggaaataccgtcacgctgggctgatggctctcagtgctatcggcgaggggtgccaccagcagatggaaggcatactaaatgagatcgtgaactttgttttactctttctgcaggatccacacccaagagtcaggtatgcggcttgtaacgccgtgggccagatggccacagactttgcacccggattccagaagaaattccatgagaaagttatagcagcacttcttcagactatggaagaccagggcaatcagagggtccaggctcacgctgctgctgccctgattaattttaccgaggattgtcctaaatcacttctgatcccgtatctcgataacctcgtgaagcatttacactccatcatggtcctgaagctgcaggaattgattcaaaagggtacaaagctagtgttggagcaagtggtgaccagtatagccagtgtcgccgacaccgcagaggagaaatttgttccctactacgatctctttatgccatcactgaaacatatcgtcgagaacgccgtgcagaaggagctgcgccttctcaggggtaaaaccatcgagtgcatcagcctgatcgggctggctgttgggaaagagaaattcatgcaagatgcctctgatgttatgcagctgttactgaaaacccagaccgatttcaacgacatggaagacgatgaccctcagatttcctatatgatttctgcctgggcacgcatgtgcaagatcctggggaaagaatttcagcagtatctcccggtcgtgatgggccctctcatgaagacagcctcaatcaaacctgaggtggctctgctggacacccaggacatggagaacatgtcagacgacgacgggtgggagttcgtgaacctgggtgaccagcagagtttcggcattaaaactgctggcctggaggagaagagtaccgcctgtcagatgctcgtgtgttacgcaaaggaactcaaggaaggctttgttgaatataccgagcaggtagtaaagctaatggtgccactcctcaagttttacttccacgatggcgtgcgcgttgccgctgctgagtcaatgcctctcctgttggagtgcgcacgggtgcgtgggcctgagtaccttacgcaaatgtggcatttcatgtgcgatgcccttattaaggccataggtacagaaccagactcggatgtgctgtctgagatcatgcatagctttgctaaatgtattgaggtcatgggcgacggctgcctgaataatgagcatttcgaggagctcggtggcatcctgaaagccaaattagaggagcacttcaaaaaccaagaactaaggcaggtgaagcggcaggatgaggactacgatgaacaagttgaggagtcactgcaggatgaggacgataacgatgtatacattctgactaaagtgagtgacattttgcactccatattttcttcctataaggagaaagttctgccttggttcgaacaattgctgccgcttatcgttaatctgatctgtccacaccggccatggcccgaccgtcagtggggtttgtgcatattcgatgacgtaattgagcactgcagtccggcatcttttaagtatgctgagtattttttgaggcctatgctccagtatgtgtgcgacaatagccccgaagtccggcaggccgctgcgtacggacttggcgttatggcacagtatggtggcgacaactataggcctttttgtacagaagccttgccgctcctcgtgagagttatccagtcagcggactcaaagactaaagaaaatgtgaatgctacagagaattgtatttcggctgtagggaagattatgaagtttaagcctgactgcgtcaatgtggaggaagtgctccctcattggctgagctggctgcccctgcacgaggacaaggaagaggcagttcaaactttcaactatctgtgcgacctcatagagagtaaccatcctattgtactcggccctaataacactaatctgcccaaaatctttagcattatcgccgagggcgagatgcatgaggccataaaacacgaagacccctgcgcaaaacgcctggcgaatgtggtgcggcaagtccagacttccgggggtctgtggactgaatgcattgcacagctgagtcctgagcagcaagctgccattcaggagctgctgaattccgcctag

SEQ ID NO: 30890 - DNA, 1011 bp, Artificial Sequence
  Description of Artificial Sequence: Synthetic coding sequence
atgaaagcgactgcgatgacaagtgcctggctagcacagggtggcgcacatgtgactatcaacgcccgtgcggaagaggacgtcgagccggagtgcatcatggagaaggttgccaaggcatctggcgcaaactattcttttcataaggagtcggggcgatttcaggacgtcggcccacaggcacctgttgggtccgtgtaccagaaaactaatgcggtgagcgagataaaacgtgtcggcaaggatagcttctgggccaaggcagagaaggaagaagaaaaccgtcgcctagaagagaagagacgggctgaggaagcccagcggcaactcgaacaggaacggcgtgagagggaactcagagaagctgctcgccgagaacagcgttatcaggagcaaggcggagaagcatcccctcagtcccggacctgggaacagcagcaggaagtagtgtcccgaaacagaaatgagcaggagtccgccgttcacccccgtgaaatattcaaacagaaagagcgggctatgagtacaacaagcattagcagcccccagccgggaaaactaaggagtccgtttcttcagaagcaactcacacagcccgaaacgcacttcgggagagaacctgccgctgccatttcacggcctcgtgccgatcttcccgcagaggagcctgcccctagcacccccccttgtcttgtccaagctgaggaggaggccgtctatgaagaaccccctgagcaggaaactttctacgagcagccccctctggtgcaacaacagggcgctggttccgagcacatcgaccatcatatacaggggcagggcctgtctggccaaggactctgcgctagagctctctacgattatcaggcggcagacgataccgaaatctcattcgacccagaaaatctcattaccggaatcgaagtgatagatgaaggctggtggcgcggatacggccctgatggccatttcggaatgtttccagccaattacgtcgagctcatcgaatag

SEQ ID NO: 30891 - DNA, 78 bp, Artificial Sequence
  Description of Artificial Sequence: Synthetic coding sequence
atgtggatgcacgtggcaaaggtccaccctaagggcggagagatggtgggggctatcaggaacgcagcatttctatag

SEQ ID NO: 30892 - DNA, 312 bp, Artificial Sequence
  Description of Artificial Sequence: Synthetic coding sequence
atggctgaactcatccagaaaaaactgcaaggcgaggtggagaagtatcagcagttacagaaggacctgagtaaatcaatgtcaggccgacagaagctggaggctcaactcacagagaataatatagtgaaggaggagttagctcttctggatggctctaacgtagtttttaaactgttaggcccagttttggtgaagcaagagttgggtgaagcgagagccaccgtggggaagcgcttggattatattaccgccgagatattcctgcgtaccataccggaccctggcgacgttcccgatagcttcttttag

SEQ ID NO: 30893 - DNA, 4101 bp, Artificial Sequence
  Description of Artificial Sequence: Synthetic coding sequence
atggcggacacagatctgttcatggagtgtgaggaggaggaactggagccctggcagaagatctccgacgtgatcgaggactcagtcgtcgaggactacaacagcgtagataaaaccactaccgccggaaaccctttggtccagcaaggcggacagccacttatcttgactcaaaacccggctccgggactgggcactatggtgacacagcctgtcctccgtccggttcaggtcatgcagaacgccaaccacgtaacctccagtccagtggcttcgcagcccatatttatcacgactcagggctttccagtaaggaatgtcagacccgtgcagaacgccatgaaccaggtgggtatcgtgctgaacgttcagcaggggcaaaccgtgcgtcccatcacactggttccagcaccaggaacacagtttgtaaagcctactgtgggcgtgccccaggtgttcagccagatgactcccgtccgcccaggatcaacaatgccagtgagaccaacgaccaacactttcactactgtaattcctgccacactgacgatacgaagtaccgttcctcagagtcagagtcaacagacaaagtctacaccttctacatcaactacgcccacagcgactcagcctacttcacttggtcagcttgctgtccagtcccccggacaatctaaccaaacaaccaatccaaagctcgccccatcttttccatccccaccagccgtgtccatcgcatcattcgtgacagtgaaacgcccaggcgtgactggcgagaattccaacgaggtggctaagttggtaaacaccttaaataccatcccttctctcggacaaagtcccggaccagtggtggtcagtaacaactcctctgcccatggcagccagcggaccagtgggcctgagagttccatgaaagttacgtcgtccatcccagtgtttgatctgcaggatggagggcgtaagatttgtcctagatgcaatgctcaattccgtgtgactgaagccctcaggggtcatatgtgttactgctgtcctgaaatggtggagtaccagaaaaaaggtaagagtctggactcggaaccttcagttcccagcgcagccaaaccgcctagtccagagaaaactgctcctgttgcgtctacaccttcgtcaacgcccatccctgcactgtccccacctactaaggtgcctgaacctaatgaaaacgtgggcgacgcagtccaaaccaaactgatcatgcttgtagacgacttctactacggtcgcgacggcggtaaagtagctcagctgacaaactttcctaaggtggctacttcctttcggtgtccccactgcactaaacgcctaaagaataacatccgtttcatgaatcatatgaaacatcacgtggagttagaccagcaaaacggtgaggtggacggccacaccatatgtcagcattgctatcggcagtttagcaccccctttcagttacagtgtcacctggaaaacgttcacagtccatatgaatctacaactaaatgcaagatatgtgaatgggcctttgagagcgaaccactattcctccagcacatgaaagacacccataagcctggagagatgccctacgtgtgccaaccctatttcccttcctatgtcacacaagtgtgccagtataggtcctctttatattccgaggttgacgtccacttcaggatgattcacgaggacacacgtcaccttctttgtccatactgtcttaaagtctttaaaaatgggaatgccttccagcagcattatatgcgacatcagaagcgcaatgtctaccactgtaacaagtgccggcttcagttcttattcgctaaagacaagattgagcataaattgcagcaccataaaactttccgtaagccaaagcagctcgaggggctgaagcctgggaccaaagtgaccatacgggcaagtcggggacagcctagaacagtgcccgtgagcagcaatgatacacctccaagcgctctgcaagaggcagctccgctcaccagctccatggaccccctgcctgtgttcctgtatcctcccgttcagaggtctatccagaaaagagctgtcaggaagatgagtgttatgggtcgacaaacgtgcctggagtgttcgttcgagatcccagacttccccaatcattttcccacctatgtgcactgcagcctgtgtagatatagcacttgctgttcccgagcttatgctaatcacatgataaataatcacgtgcctcggaaatcacccaagtacctagccctttttaaaaattcagttagtggcattaagttagcctgcaccagctgcacattcgtcaccagcgttggcgacgctatggccaaacaccttgtgtttaacccaagccatcggagctccagcatcctacccagggggctgacctggatcgcccactccaggcacggccagaccagggaccgggtacacgaccggaatgtcaaaaatatgtatccaccgccttcctttcctaccaacaaagcagctaccgtcaaatcagccggtgccacccccgcagagcccgaagagttgctaacgccattggcccctgctttgccctctccggcttcgaccgccacacccccaccaactcccactcatcctcaggcacttgccctccccccactggccaccgagggggctgagtgtcttaatgtggatgaccaggacgagggatctcctgtgactcaggagcccgaactggccagcggtggagggggttctggcggtgtgggtaagaaggaacagttgagcgtgaaaaagcttagagttgtcttgttcgcactctgttgcaacacagagcaggcagccgaacacttccgaaatccgcagaggcgtattcgccgttggctccgcagattccaggcaagccagggagagaacctggaggggaaatatttatctttcgaagctgaggaaaaactggcagagtgggtgttaacacagagagaacaacagctgcccgtgaatgaggaaactctcttccaaaaagccaccaaaattggcaggagtctggagggcggttttaaaatctcttacgaatgggccgttcgattcatgctgcgacaccacttaacacctcacgctaggagggcagttgcccataccctgcctaaggacgtggctgagaacgccggattatttattgattttgttcagagacaaatacacaatcaagacctcccccttagtatgatcgttgccatcgacgaaattagcctgttcctggacacagaagttttgtctagcgatgatcggaaggagaacgcactgcagacggtgggcaccggggaaccctggtgtgacgtcgtactggctattcttgccgatggcactgtcttaccaacattagtattctatcgcggacagatggaccagcctgcgaacatgccagacagcatccttttagaagccaaagaatcagggtattcagacgatgagattatggagctgtggagcacgcgggtgtggcagaaacacaccgcgtgccaacggtccaaggggatgcttgtgatggactgccatagaacgcatctcagtgaagaggtgctggcaatgctttcagcatcttctacgctcccagccgtggtcccagccggatgtagtagcaagatccaaccactggacgtgtgcataaagcgcactgtcaaaaattttctccacaagaagtggaaggagcaggccagggagatggctgacacagcctgtgattcagatgtgctgctccaactggtgttggtatggctgggggaagtcctgggcgtgattggtgactgtcctgaactagttcagagatcctttctggtggccagtgttctaccagggccagacgggaatatcaactccccaacacgaaacgcggacatgcaagaggaactgatcgcttccttagaagaacaactgaagctatctggagagcatagcgaatctagcacgcctcgccctagatccagccccgaagaaacaattgaacccgaatctctgcatcaactgttcgaaggcgagtcagagactgagagtttctacgggtttgaagaagccgaccttgatctgatggaaatctag

SEQ ID NO: 30894 - DNA, 564 bp, Artificial Sequence
  Description of Artificial Sequence: Synthetic coding sequence
atggatatttcaaaggggttaccagggatgcagggaggactgcacatatggattagcgaaaacaggaagatggtcccagttcctgaaggggcttacggcaactttttcgaagagcactgttacgttattcttcatgtgcctcaatctccaaaggctactcagggggcatcttccgatttacactattgggttggtaaacaggcaggggcagaggcccaaggagcggctgaggcgtttcagcagagacttcaagacgaattaggaggtcagaccgtcctgcatagggaggcccagggccacgagagtgactgcttttgttcctactttcgccctggaattatttaccggaagggaggcttggcaagcgacctgaaacatgtggagactaatctcttcaatatacaacggcttctgcacatcaaaggcaggaagcatgtcagtgctactgaagtggagctgtcatggaatagttttaataagggcgatattttcctcctggacctggggaaaatgatgatccagtggaacgggcctaagacttctatatctgaaaaagctcggtag

SEQ ID NO: 30895 - DNA, 1329 bp, Artificial Sequence
  Description of Artificial Sequence: Synthetic coding sequence
atgccccttgagaatctggaagaagagggtttaccgaaaaaccccgatcttcgaattgcgcaactccgcttcctgctgagtctgcctgagcacagaggcgacgccgctgtgcgcgatgaactgatggctgccgttcgcgacaataacttctggaaccggataagacaggagcagactgaagattgtcctccgtccagcccttctcgaggctggcattgccaggattggccttctaggaagcctcctacctccatccggctgtgttttgctaagccaatcatcaagagacaccgaatgcctagttatatggcaccttactacgaggccctctgcaagtcccttgattggcagatcgatgtggacttgctgaacaaaatgaaaaaagcaaatgaagacgagcttaaaaggcttgacgaagagttggaggacgccgaaaaaaacctgggggaatcagaaattcgggatgcaatgatggctaaggccgaatatctgtgcagaattggggataaagaaggcgctctgacagcattccgcaaaacctacgataaaacagttgcactggggcaccgcttggacatcgtcttttacctcctccggatcgggctcttttacatggataatgatcttatcacaagaaacactgaaaaggccaagtccctgattgaagagggcggagattgggaccggagaaacaggctgaaggtttatcaaggcctgtattgtgtcgctatacgggattttaagcaggcggcagaactgtttctcgacacagtgtccacatttacaagttacgagctgatggattacaagacttttgtcacatataccgtgtatgtcagtatgatcgctctggaaagaccggatctgagggagaaggttatcaaaggcgctgagatactcgaggtgcttcactctctgcccgctgtgcgccagtatttatttagtttgtacgagtgtaggtattctgtgttctttcaatctctggctgtcgtcgagcaggagatgaaaaaggattggctttttgcccctcattatcgctattacgtccgcgaaatgcgcattcacgcctactcccagcttctggaaagctataggagccttactctgggctacatggcggaggcgttcggggttggggtcgaattcatcgaccaggagctgtcgaggttcatcgctgccggtcgactgcactgtaagatcgataaagtaaacgagatcgtggagaccaatcggcctgattccaagaattggcagtaccaggagacaatcaagaaaggggacttgctgctgaaccgcgtgcaaaaactgagcagagtgattaacatgtag

SEQ ID NO: 30896 - DNA, 333 bp, Artificial Sequence
  Description of Artificial Sequence: Synthetic coding sequence
atgctctgttggggtaacgcaagcttcggacaactgggtctcgggggaatcgatgaagaaattgtcctcgagccacggaaaagcgacttctttatcaacaagagggtccgagacgtcggttgtggcctgcggcatactgtgttcgtgctggacgacggaacagtgtacacttgcggttgtaacgatttaggccagctcggccatgagaagagccgtaaaaagccggaattccggagctgcttccctggcagaagcgccatggcaccgtcccggcttaccgctaccagcgccagtcaggtccaggcgattctgctcccccagccacccgaatag

SEQ ID NO: 30897 - DNA, 930 bp, Artificial Sequence
  Description of Artificial Sequence: Synthetic coding sequence
atggtgtgctggcagtctgtgtctgtgtggagcgtcgccggtagggtggagatgacagtctccaagttcatggccatccaaaaagccttgcagcctgattggtttcagtgtctatccgacggcgaagtgtcatgcaaggaggctacttccattaagcgggttcgcaaaagcgtcgatagatccctcctttttttggacaactgtctgaggctgcaggaggaatccgaagtgctccagaagtcagtgataatcggcgtaattgagggaggagatgtaatggaagagcgcctgcgctcagcaagggaaacggccaagcgtcccgtggggggattcctgctggatgggttccaagggaatccaacaaccctggaggcaagactcagactgctatcttctgtcactgccgagctcccagaagacaagcccagattgatctcaggtgttagccggcctgacgaggtgctggaatgcatcgagaggggggttgacctttttgaaagcttcttcccgtatcaggtgacagaacgagggtgtgctcttaccttcagttttgattaccagccaaaccctgaggagacactgttgcagcagaacggcactcaggaggagatcaaatgcatggatcagataaaaaaaattgaaaccacgggatgcaatcaagagattacttccttcgagattaatctgaaagagaaaaagtaccaggaggatttcaatcctctggtccggggttgtagttgttattgctgtaagaatcatacccgcgcatatatacatcacttgttggtgactaatgaactgctcgccggtgtattgcttatgatgcacaactttgagcactattttggcttcttccattacatacgggaggccctgaagagtgataaactggcacagctgaaggaacttatccatcgtcaggcctcctag

SEQ ID NO: 30898 - DNA, 384 bp, Artificial Sequence
  Description of Artificial Sequence: Synthetic coding sequence
atggtccttatcctgggccgaaggctcaatagagaagatcttggggttagggacagtcccgcaaccaaacgtaaggtgtttgaaatggatccaaagtccctaacagggcacgaattcttcgatttttcctctggatcatcacacgcggagaacatcctgcagatttttaatgagttcagagactcccgcctctttacagacgtgatcatctgtgtcgaagggaaggaatttccatgccatagggcagtcctttctgcctgctcctcgtatttcagggctatgttctgtaacgatcatcgggagtcacgggaaatgttggtagagattaatggcatcctcgcagaagcaatggagtgcttcctgcagtacgtgtacacgggatag

SEQ ID NO: 30899 - DNA, 1581 bp, Artificial Sequence
  Description of Artificial Sequence: Synthetic coding sequence
atggaggaaattcccgcacaggaagctgctggcagccccagagttcagtttcagtcgctggaaactcaatcggagtgtttaagcccggaaccgcagtttgttcaggacaccgacatggagcaaggtcttaccggtgggttccccatctctaagccagatgggattagtcagctagaacaggacttacaagtctttgacttggagactaaaacccgggaggtattgagggacgactgttccgatggggagaccagagaagagaacaaactgttgatccctaagcaaaagatttctgaagaggttcattcatataaggtgcgggtgggacggctcaagcacgacatcacacaggtgcctgaaactcgagaagtctataagagtgaggatcgactggaacgactgcaggaaattcttaggaagttcctgtacctagagagggaatttcgccagatcacaattagtaaggaaaccttcacaagtgagaagaataatgagtgtcatgagccagagaaaagcttctcccttgactccaccatagatgcggaccagagagtgctcagaatccaaaataccgacgacaatgataagtatgatatgtcttttaaccagaactccgcgtctgggaagcacgaacatctgaatctgactgaggattttcagtcgagcgagtgcaaggagtccctcatggatctgtctcacctgaacaagtgggagtccatccccaacaccgagaaatcttataagtgtgatgtctgcggcaaaatcttccatcaatcctccgccctcactcgacatcaacggattcacactcgggagaaaccgtataaatgcaaagagtgcgagaagtcttttagccagtcctcttcactatcccggcataagaggatccacactagagagaagccatataagtgcgaagcctcagacaagtcttgcgaggctagtgataagtcttgttctcctagttctggcatcattcaacataagaagatccatacaagggcaaagtcctacaaatgttcttcatgtgaacgagtctttagccgcagcgtccatctgacccagcaccaaaaaatccataaggaaatgccgtgtaagtgcactgtgtgcggatctgacttttgccatacgagctatttgctggagcaccagagggttcaccacgaagaaaaggcatatgagtacgatgagtacggtctggcctatatcaaacagcagggtatccatttccgcgaaaaaccatacacatgcagcgaatgtggtaaggacttccggctcaacagtcacctgatccagcaccaaaggatacacacaggggaaaaagcccacgaatgcaacgagtgcggaaaggccttctcacaaacctcgtgtctgatacagcatcacaaaatgcacagaaaggagaagtcatacgaatgcaatgagtacgagggaagctttagccactcgtctgacttgatcctgcagcaggaggtcctgactcggcagaaagcattcgattgcgatgtgtgggaaaagaatagttcccagagggcacaccttgtgcagcaccagtcgattcacaccaaagagaactcttag

SEQ ID NO: 30900 - DNA, 195 bp, Artificial Sequence
  Description of Artificial Sequence: Synthetic coding sequence
atgcccgaggaccaggtggggaaactagaggccactgagaacacaatcagcgccatggcagcagcagcagccgagcagcaacagttttacctgttgctcggaaacttgctgagtcctgacaacgtggtgcgcaaacaagccgaggaaacctatgaaaacatcccgggacagagtaagattacctttctgctctag

SEQ ID NO: 30901 - DNA, 741 bp, Artificial Sequence
  Description of Artificial Sequence: Synthetic coding sequence
atggccgagcaggagcagcgaaagattccattagttcctgagaatctgctgaagaaacgcaaggcatatcaggcactcaaggcgacccaggctaaacaggccttactcgctaaaaaggagcaaaagaagggtaaggggctccggtttaagagattagagtccttcctgcacgacagttggcgtcagaagagggataaagtgagattgcgcaggttggaagtgaagcctcacgcattggagctgcctgacaagcattcattggcgtttgtggtccgaatagagagaatcgatggagtaagccttctcgttcagcgcactatcgccagattgcgcctgaaaaagatcttctcaggagtattcgttaaggtcacaccacagaatttgaagatgctgcggatcgtggaaccttacgtgacgtgggggttccccaatctcaaatccgtccgcgagttgattctcaagagggggcaagcaaaggtgaaaaacaaaactattcccctgacagataatacggtgattgaagagcatctcggaaagtttggggtcatatgccttgaagacctaatccacgagatagccttccccggaaagcactttcaagagatctcgtggtttctctgcccattccatctctctgtagcgagacatgctaccaaaaatagagtgggctttctgaaggaaatgggtactccaggttacaggggagagaggatcaatcaactgatcagacaactcaactag

SEQ ID NO: 30902 - DNA, 1296 bp, Artificial Sequence
  Description of Artificial Sequence: Synthetic coding sequence
atggctgcaaacctatcccgcaacgggcctgccttacaggaggcatatgttcgggtggttacggagaagagtcccaccgattgggcgctgtttacttacgagggtaactccaatgacatccgggtggccggtaccggcgaggggggactggaagagatggtggaggagttgaatagtggtaaagtcatgtacgccttctgccgtgtcaaggatcccaactccggcctgccaaagttcgtgctgatcaactggaccggggaaggggtcaatgatgtcagaaaaggcgcttgcgcaagtcacgtttctacaatggccagtttccttaagggcgctcacgtgacaatcaacgcacgtgcagaggaagatgttgagccagagtgtatcatggaaaaggttgctaaggcttctggagctaattatagttttcacaaggaatccgggagattccaggatgttggcccacaggctccggtgggctccgtgtatcagaagactaatgccgtgagtgaaattaagcgagtgggtaaagacagtttttgggccaaggccgaaaaggaagaagaaaatcgcaggttagaggaaaaacgaagggcagaagaagcacagagacagttggagcaggagcgcagagagcgggagctgcgggaggcagcccgacgggaacaaaggtatcaagagcagggaggtgaggcttcgccccagtctcgaacatgggagcagcagcaggaagtggtgagcagaaacagaaacgagcaggagtccgccgtccatcctcgcgaaattttcaaacagaaagagcgagctatgtctaccacatctatatccagccctcagccaggaaagctgcggtcacccttccttcaaaagcagcttacccagccagaaactcattttggtagggagcccgctgccgctatttccaggccccgtgctgatctgcctgccgaggaaccggctccttccacaccaccttgccttgtgcaggcagaggaagaggcagtttacgaagaaccccctgagcaagaaaccttttacgagcaaccgcctttagtgcagcagcagggtgcgggttccgaacacattgaccatcacatccaaggtcaaggtctgtcaggccaggggttgtgcgcacgcgcactgtacgattatcaagccgcagatgacactgaaatttcctttgatcccgaaaatctcatcacaggtatcgaggttattgatgaagggtggtggcgcggatacggcccagacgggcacttcggaatgttcccggctaactacgttgaactgattgaatag

SEQ ID NO: 30903 - DNA, 1854 bp, Artificial Sequence
  Description of Artificial Sequence: Synthetic coding sequence
atgatcgagaagatgcagggatccaggatggatgaacagaggtgctcgtttcctccaccactgaagactgaggaggattatatcccgtatccctcagtgcatgaagtgctcggacgggagggtcctttccccctgatcctgctaccccaatttggcggttactggatcgaaggtactaaccacgaaattacatccatcccggagacggagccacttcagagccctacaactaaagtgaagctggaatgtaatccgacagcccgaatctatagaaaacactttcttggaaaggaacactttaattactattctctggacgctgcccttggccaccttgtgttctccttgaagtacgatgtaataggagatcaggaacacctgaggctgctgctacggacgaagtgcaggacatatcatgacgtcattccgatcagctgtttgactgaattccctaacgtcgtccagatggcaaagctcgtgtgcgaagacgtgaatgtcgacagattttaccctgtcctgtatcccaaggcctccagacttattgtcacctttgatgaacacgtgatctcgaataactttaagttcggcgtgatttaccagaagctgggccagacttccgaagaggagcttttctccaccaatgaagagtcacccgcatttgttgagttcctggaattcctgggtcagaaggtcaagctgcaagacttcaaaggttttaggggcggtctggacgtaacacacggacagacagggactgaatcagtatactgtaacttccgcaataaagaaattatgttccacgtgtcgactaagctgccctataccgagggagacgcccagcagttgcaaaggaagaggcatataggcaacgacattgtggcagtagtgttccaagacgagaacacaccattcgttccggacatgattgccagcaacttcctccatgcatatgtggtggtccaagccgaggggggaggtcccgacggccctctgtataaggtctcagtcactgccagagacgatgtccccttctttggacccccacttcccgaccccgcagtttttcgtaaaggtcccgagtttcaggaattcctgctaacaaagttgatcaacgctgagtatgcttgctataaagccgaaaagttcgccaagctggaggagaggacaagagccgcactactcgagacactatatgaagagctccatatccacagccagagtatgatggggctgggtggagacgaggataagatggagaatggaagcggcggagggggattcttcgaatcttttaagagggtcatccgttcccgctcgcagtccatggatgccatggggctgtctaataagaagccaaacaccgtgagcacgtctcatagtggctcatttgctccaaataaccccgatctggctaaggccgctggtatatcgctgttaatccctgggaagtcagcgtctcgtttcggcagacggggaagcgccatagggataggcacagtggaagaagttgttgtcaggggggctgccggtagtggcggttgcctccatgcactgttctctgctagatcacaggacggcggacacataggagacgtcgccccactccctccaggtcaagcgcctggcagggccggttggtcgggaggatcatccgatggaacccaacacttgctctgggggttggttcctgtgcccgaacccgtacctctgactaggggattttggccgtgtctgggtccctgggaccccggaccagtgccggctagaatccggtatcccaaggccctgcacccagccgctcgtccacctataagtcccgtgtgtatggagcggcacccatcaccactgccttag

SEQ ID NO: 30904 - DNA, 1224 bp, Artificial Sequence
  Description of Artificial Sequence: Synthetic coding sequence
atgggtaacacttcattcaacgaggttatggaagcccagctccccagccacggtggacctaaacccagcgctgaatctgacatgggtacgagaagagattacatcatggccaagtacgtggagcaccggttcgccagacgctgcacaccggagccccagcgactgtggactgcaatttgcaatagagacttgctgagtgtgttggaggccttcgccaatggccaggattttggccaacctctccctggccctgatgcccaagcaccggaggagcttgtgctgcatttggcagtaaaagtggctaaccaggcttcactgcctttggtggattttatcattcagaatgggggtcatctggacgcgaaggccgcagatggcaataccgcactgcattatgccgctctatataatcagcccgactgcctgaagctcctcctgaaggggagagcactggtagggacggtcaatgaagccggagagaccgcgcttgacattgcacggaagaaacaccataaagagtgcgaagagctcttggaacaagcccaggctgggacattcgcgttccctcttcatgtagactattcctgggtaatcagcacggagccgggatccgactccgaggaagatgaggaggagaaacggtgtttgctgaaacttcctgctcaggctcattgggcgtctgggaggctggacataagtaataaaacctacgaaacagtagcctccctgggagcagcaactccccagggcgagtcagaggactgcccacctcccttgcccgtaaaaaacagctctaggacgctggtgcaggggtgcgcgaggcatgcgagcggagatcgatccgaggtctcctccctcagcagtgaagcacctgaaactccggagtcactgggaagcccagcaagctcctccagcctgatgagccctcttgaacccggagacccaagtcaggcccctccaaactccgaggaaggcttgcgagagccccctggaacttcccgtcctagcttgacaagcggaacaaccccctccgaaatgtatcttcctgtgagattctcttctgagagcacaagaagttaccggaggggagctagatccccggaggatggcccatccgcaagacagcccttgcccagaagaaacgtcccagtgggaattaccgagggagacggttctcgtaccggctcattgccagcttcaagcgtgcaattgttgcaagactag

SEQ ID NO: 30905 - DNA, 813 bp, Artificial Sequence
  Description of Artificial Sequence: Synthetic coding sequence
atggccatggagatgcggctgcccgttgcacggaagccgctgtcagaacgccttgggcgagataccaagaaacatctcgtggtccccggtgatacgattacaactgacactggcttcatgagaggacatggtacttatatgggagaagagaagctgattgccagtgttgcaggctcagtggagcgcgtcaacaaactgatttgtgttaaagccttgaaaactcgatacattggggaagtcggggacatagtagtcgggagaattaccgaggtccagcagaagagatggaaggtggagactaactctcggctcgactcagtcctgcttctttcctccatgaatctgcctggtggggagctacggaggcggagtgctgaggatgagctggcgatgcggggtttccttcaggaaggagatctgatttccctgggccagggagtcctggtgcaagtgtcaccaagcctcgttaaaaggcagaaaactcatttccatgacctgccatgcggcgcatccgtgatattgggcaacaacggctttatttggatttatcccacacctgaacacaaggaggaagaggccggtggttttatcgccaacctggagccagtgagtctcgccgatagagaggtgatctctagattgcgcaactgtataatatccttagtgacccagcggatgatgctctacgacacctcgattctatattgctacgaagcaagtctgccccatcagatcaaggacatactgaaacctgaaattatggaagagattgtcatggaaactaggcagcgcctactcgagcaggaagggtag

SEQ ID NO: 30906 - DNA, 297 bp, Artificial Sequence
  Description of Artificial Sequence: Synthetic coding sequence
atgcctgaagatcaggtgggaaagctggaggctaccgaaaatactatttcagccatggcagcagctgcggctgagcagcaacagttttacctactactggggaatctcctgagccccgacaacgtcgtgcggaaacaggcagaagagacttacgagaacattccaggtcagtccaaaatcacctttctgctacaagcaattagaaacactaccgcagccgaggaggccagacagatggccgcagtgctcctgcgcaggctcttgagctctgccttcgatgaggtgtatcctgcttag

SEQ ID NO: 30907 - DNA, 306 bp, Artificial Sequence
  Description of Artificial Sequence: Synthetic coding sequence
atggacgaggttgaacaagaccaacacgaggcgcgtttgaaagaactgttcgattcatttgatacaacaggtaccggaagcctgggacaggaagaactgacagatttatgtcatatgctgtcactggaagaggtggctccagtgctccagcagacactgctacaagataacttgctgggcagggttcactttgatcaatttaaagaagcactgatattgatattaagtcgaacactttctaacgaggaacattttcaggagccggattgcagcctggaagctcagccgaagtacgtcagaggatag

SEQ ID NO: 30908 - DNA, 1065 bp, Artificial Sequence
  Description of Artificial Sequence: Synthetic coding sequence
atggcccactcgcctgtcgctgtacaagtgccaggtatgcaaaacaatattgccgatcctgaggagctgtttacgaaactggagaggataggaaaagggtcattcggggaggtgtttaaaggcatcgataaccgcacccagcaagtagtggccattaagatcattgatttagaagaggcagaggacgaaatagaggacattcagcaagaaatcacagtcctttctcagtgcgacagcagttacgtgaccaaatactacggttcctaccttaaaggaagcaaactgtggattataatggaatacttgggcggaggctctgccttggatctccttcgcgcaggcccttttgatgaattccagattgccacaatgttgaaggagattcttaaaggactggactacctgcatagtgaaaaaaagattcacagagatattaaagctgcaaacgttctgttaagtgagcagggcgacgttaagctggccgactttggagtcgcagggcagttaaccgatactcagataaaacgcaacaccttcgttggaacccccttttggatggcccctgaagtgatacagcagtcagcctatgattccaaaaggccaacagctaaagagttgctcaaacataaatttatcgttaagaactctaagaagactagctatctaaccgagctcatagaccggtttaaacgctggaaggccgagggccactccgatgacgagtcggacagcgagggaagcgattcggaaagcacttcaagggaaaataacactcatcctgaatggtctttcactaccgtcaggaaaaagcctgaccccaaaaaggtgcagaatggtgctgaacaggatctggtgcagacgttgagctgtctgtccatgatcatcacacctgcctttgctgagctaaaacagcaggacgagaataatgctagcagaaaccaagcgattgaggaattagagaagagcatagccgtggctgaggcagcttgccctgggattaccgataagatggtcaagaagttaattgagaaattccagaagtgctctgccgacgagtccccttag

SEQ ID NO: 30909 - DNA, 522 bp, Artificial Sequence
  Description of Artificial Sequence: Synthetic coding sequence
atgccgaggaaggggacgcagccttctacagcccgacgcagggaagaagggccaccccctccctcacctgatggggctagttcagatgccgagcctgagccccctagcgggaggacagagtcccccgctacagccgctgagaccgctagtgaggagttggacaaccggtccttggaggagatccttaactctatcccaccaccgccacccccagccatgaccaacgaggccggagctccacgccttatgatcactcacattgtaaaccagaatttcaagtcatacgctggcgaaaaaatcctcggcccttttcataaaaggttttcttgtattattgggcctaatggttctggcaagtccaacgtaatcgatagtatgctctttgtatttggataccgggcacaaaagattcggtcaaaaaaactcagcgtgcttattcacaattcagatgagcataaggacatacagtcatgtactgtggaggtacacttccaaaaaatcatcgataaagagggcgattag

SEQ ID NO: 30910 - DNA, 801 bp, Artificial Sequence
  Description of Artificial Sequence: Synthetic coding sequence
taaccccgtgcagctgctcgggtgagagctgctggagaagctctggagagacgcaggcgctggctaggcaggctgagcccctctgcacctcgtcccaggcgagccagaccctcactgcggagggcatcggcctgggtgagagatcgtgtggctgggagacccggtgcgttgcccggttttcaggcttccggtgttgccggagaagcccaaaaagcgcctggccacccagccgctcctgcccctgctgccagctgccttactgaggccgatggtcgggtgtttctgcatgccttcaggctggcgttgatccagttgcaaatatctagtatcaagagtgataacgtgacccgggcatgctccttcattagagaggcagcgacccaaggggcaaagatcgtgtccttgcccgaatgttttaatagcccctacggggcaaaatattttcctgagtatgctgagaagataccaggcgagtcaacccagaaattatccgaggtggccaaggaatgcagcatctatttgattggtggatcaatccccgaggaagatgctggtaaactttataatacctgtgcagtattcggacccgatgggacacttcttgcgaaatatcgcaaaatacacttgttcgacatagacgtacccggaaaaattaccttccaggaaagtaagactctgtcgccgggtgattcattttcaacctttgataccccttactgcagggtcggccttggaatctgctatgatatgcgctttgctgagctggctcagatatacgcgcagagaggtgaggccgtttag

SEQ ID NO: 30911 - DNA, 216 bp, Artificial Sequence
  Description of Artificial Sequence: Synthetic coding sequence
atggattcccttcccgacgagttctttgtgagacatccagctgtagaagaccaaaggaaagaagaaacggagaacaaactagaaaagtcatccggccagctgaataagcaggaaaatgacatacctaccgatcttgtgcctgtcaatctgttgctggaagtgaaaaaattgctgaatgcgatcaacacactgcctaaaggtgtggtgccacattag

SEQ ID NO: 30912 - DNA, 2130 bp, Artificial Sequence
  Description of Artificial Sequence: Synthetic coding sequence
atgtcggtagaatccgagcaattaacaggggtgccgctggatgatagcgccattactcccatgtgtgaagttaccgggggacgatcttattctgtctgcagcccgcgaatgctcaaccagtgtctcgagtccctagtgcaaaaggtgcagagtggggtggttatcaattttgagaaggccggtcctgacccttctcccgtagaggacggtcagccggacatctcccgcccattcggatcccagccctggcattcatgtcataaattgatctatgtgaggccaaaccctaaaactggcgtaccgataggacattggcctgttccagaatctttttggccagatcagaattctccgaccctgccaccgcgaacttcccacccagttgtcaagtttagttgcacagactgcgagcctatggttatcgataagttgccgttcgacaagtacgagctggagccctcccctctgacccagtttatcctagaaaggaagtccccacagacatgctggcaagtatacgtgagtaactcagccaagtattctgaacttggacacccctttgggtatctcaaagcgagtaccgcactgaactgtgtgaacctgtttgtgatgccctacaactatcctgttctgctccccctgctggatgatctattcaaagtgcataaagccaaaccaaccctgaagtggcggcagtctttcgaatcatatcttaagaccatgccaccttattacctcggaccgttgaaaaaggccgtacggatgatgggtgctcctaatctgatcgctgactctatggagtatggattgagctattctgtgatatcctacctaaaaaaacttagccagcaggccaagatcgagagcgaccgtgtgattgggtcggtggggaaaaaagtggtacaagagactggcatcaaggtgcgatcccggtctcacgggctgagtatggcctatcggaaggacttccagcagctacttcaggggattagtgaagacgtgcctcatcgcctattggatctgaatatgaaagagtatacaggcttccaggtcgcactgctgaataaggatctgaagccgcagactttcaggaacgcttatgacataccacggagaaacttgctggaccacctcactaggatgagaagtaatttgctgaaaagcacacgtcggttcttgaaaggacaggacgaggaccaggttcattctgtgcccattgctcaaatgggcaactatcaagagtatttgaagcaagtgccaagcccgctcagagagctcgaccctgaccagccacgcagactgcacacttttgggaacccctttaagctcgacaagaagggcatgatgattgacgaggcagacgagttcgtcgcgggtccccagaataagcataagcggcctggcgagccaaatatgcaggggatcccgaagcggaggagatgcatgtcccctctgctgcgcggaagacaacagaaccccgtggtgaataatcacatcggagggaaaggaccccctgccccaaccacccaggcgcaacctgacttaatcaagccattgccgctgcacaaaatttccgaaaccactaatgattccataatccacgatgtggttgagaatcacgttgcagaccagctttcaagcgacattacccccaatgcaatggacaccgagttttcagcctcgtcacccgcttctttacttgagagaccaaccaatcacatggaagccctcggccatgatcatctggggacaaacgacctcacggttggtgggttcctggaaaaccacgaagagcctagggataaagaacagtgcgcggaagagaatatacccgcttcaagcctgaataagggtaaaaagctaatgcattgcagaagccatgaggaggttaatactgaattgaaggctcagataatgaaagagatccggaagcctggaaggaaatatgagagaatttttactctgttaaagcatgttcaggggagcctccagactcggcttattttcctgcaaaatgtcataaaggaggcatctcggtttaaaaaaaggatgctgattgagcagctggagaacttcctggatgagattcatcgtcgggctaatcagattaatcatatcaattccaactag

SEQ ID NO: 30913 - DNA, 387 bp, Artificial Sequence
  Description of Artificial Sequence: Synthetic coding sequence
atggccagcagcaatactgtgcttatgcggcttgtggcttcggcatattctattgcccagaaagcagggatgatagtgagaagagtgattgcggaaggagatttgggtattgttgaaaagacatgtgccacagatctgcagacaaaggccgatcgcctggcccagatgagtatttgcagctcactagcccgaaaatttcccaagctcacaatcatcggcgaagaagatctgcctagtgaggaagttgatcaggagctgatcgaagacagccagtgggaggaaattctgaaacagccctgccctagtcagtactccgctataaaggaagaagatttggtcgtgtgggtcgacccactcgacggcacaaaagaatacactgaggggtag

SEQ ID NO: 30914 - DNA, 237 bp, Artificial Sequence
  Description of Artificial Sequence: Synthetic coding sequence
atgcgctttatgatgatgagggcagaaaattttttcatattaaggcgaaaacccgtggagggctatgatatctctttcctcattacaaactttcacacagagcagatgtataaacacaagttagtggatttcgtgatccacttcatggaggagattgacaaagagatatcagagatgaaactgtccgtgaacgccagagcacggatagtcgctgaagaattcctgaagaacttctag

SEQ ID NO: 30915 - DNA, 171 bp, Artificial Sequence
  Description of Artificial Sequence: Synthetic coding sequence
atggttatggaaaagccatcccctctactcgttggcagagagttcgtgagacagtactacacgctgctcaacaaggccccagagtacctgcatcgattctacggacggaatagcagttacgtacacgggggagtagacgcctcaggcaaaccacaggaggctgtttattag

SEQ ID NO: 30916 - DNA, 357 bp, Artificial Sequence
  Description of Artificial Sequence: Synthetic coding sequence
atgaagatttttgtaggcaatgtggatggcgcagacaccacccctgaggaactggctgctttgttcgccccttacggcaccgtcatgagctgcgcagtaatgaagcaattcgccttcgtccacatgcgggagaacgcaggggcattgcgagcaattgaagccctgcacgggcacgaactgcgacccggaagggctttggtcgtggagatgtcgaggcccaggcctctgaacacatggaaaatctttgtcggcaatgtatccgccgcatgtacatcccaggaactgcgctcgctctttgagaggagaggcagagtaattgagtgcgacgtggtgaaaggaggaatgtgcgtcggatag

SEQ ID NO: 30917 - DNA, 438 bp, Artificial Sequence
  Description of Artificial Sequence: Synthetic coding sequence
atgtcgtcgcccagggatttccgagccgagccggtgaatgactatgaaggcaatgatagtgaggccgaagacctaaattttagagaaacactccctagtagcagtcaggagaatacgcccagatccaaggtgttcgagaacaaggtgaacagcgaaaaggtgaagctatccctaagaaacttcccccacaatgactacgaagacgtgtttgaggagccttccgaaagtggctccgacccatctatgtggacagccagaggacctttccgtcgggatagatggtccagtgaggatgaggaagcggcaggcccaagtcaggccctgagtcccctcctgagtgtccagcaccatggatatagcggacccaatgagagaacaactttttggcacgggagcaatgagggcgcagtatcgcttttgttgagatattgcgcatag

SEQ ID NO: 30918 - DNA, 438 bp, Artificial Sequence
  Description of Artificial Sequence: Synthetic coding sequence
atgtggacagcacgcggaccttttaggagagatcgatggagctcagaggacgaagaggcggctggcccatcacaagctctgagcccccttctgtccgacactcgcaagatcgtgtctgaaggagagctggaccagctggcacagatacgcccattaattttcaactttcacgagcaaactgcgataaaagattgtctcaagattctggaggagaagactgcagcttatgacatcatgcaagagttcatggctctagaactgaaaaacctgccaggcgaattcaactccggcaatcagccaagcaatcgcgagaaaaaccgctatcgagatattcttcccttccagcatcacggatactccgggccaaacgagcgtactacattttggcacggatcaaacgagggcgctgtgagcctcctcctcaggtactgtgcctag

SEQ ID NO: 30919 - DNA, 444 bp, Artificial Sequence
  Description of Artificial Sequence: Synthetic coding sequence
atgtggaagtttcctgggggattatctgagccagaggaggatattggagacacagccgtgcgggaggtgtttgaagagacggggattaagtcggaattcagaagtgtgctaagtatccggcaacagcacaccaatcctggtgccttcggtaaaagtgacatgtacattatatgccgactgaagccctattccttcacgatcaatttctgtcaggaggaatgtctcagatgtgagtggatggacttgaatgacttagccaagactgagaacactactccaatcaccagccgggtggcgagactgctgctttatgggtatagggagggcttcgataagatcgacctgaccgttgaagagctgcctgctgtttataccggcctcttctataagctttaccataaagaactgcccgaaaattacaagactatgaagggaattgactag

SEQ ID NO: 30920 - DNA, 300 bp, Artificial Sequence
  Description of Artificial Sequence: Synthetic coding sequence
atggacgagtcagctctgcttgacttgcttgaatgcccagtctgcctcgagaggcttgatgcgagcgccaaagtgctgccgtgccagcacacattttgtaagaggtgcctgctcgggatcgtgggttcaaggaacgagctgaggtgccccgaatgtagaactcttgtaggcagcggcgttgaagagctgccgtcaaacatactcctggttcggctattagatggcattaaacagcggccatggaaaccaggcccaggtgggggatcaggtaccaactgtactaatgcactcaggtcttag

SEQ ID NO: 30921 - DNA, 3675 bp, Artificial Sequence
  Description of Artificial Sequence: Synthetic coding sequence
atggccctgcgaccaggggctgggagcggtggtggcggtgcagccggagccggagctggtagcgccggaggcggtggctttatgtttccagttgctgggggtattagaccaccccaagctgggctaatgccgatgcagcagcaagggtttccgatggtaagtgtgatgcagcccaatatgcaagggatcatgggcatgaactattcctctcaaatgagtcagggcccaattgcgatgcaggccggaatccccatgggtccgatgccagccgctggcatgccttatctgggccaggcgcctttcctcggaatgagaccacccggaccccaatatactccggacatgcagaaacagttcgctgaggaacagcagaagaggtttgagcagcagcaaaaactcctcgaagaagaacggaagcggaggcagtttgaggagcagaagcagaaactgcgccttttgtcgtccgtaaaacctaagacgggggagaagtccagagacgacgcattggaagccattaaaggcaacctggacgggttctctcgcgacgccaagatgcaccccaccccggcatcacacccaaaaaaacccggtgtcggggtgtttcctagtcaggatcctgcccagcctcggatgccaccatggatttataatgaaagcctggtgccggatgcctataagaaaatcttggagaccaccatgactccaacggggattgacacagcaaagctttatcccattctcatgtccagcggcctgccgagggagacattgggccagatttgggctctcgccaaccgcacaacccccggaaaactaaccaaagaggagctatatactgtccttgccatgattgccgttacccagcgcggtgtgccagcaatgtcaccggacgccctgaatcagttccccgcagccccaatcccaaccctgtccgggttcagcatgaccctgcctaccccagtgagccagccaactgttatcccgtccggccctgccggtagtatgcctctctcgctcggtcagcccgtgatgggaatcaacctggtgggaccagtaggtggggctgctgcacaggcctcttcggggttcatacccacctatcccgctaaccaagtcgtaaaaccagaagaggatgatttccaagactttcaggatgccagtaagtctgggagcctcgacgatagcttcagcgactttcaggagcttccagcctccagcaagactagcaactcacaacatggaaactctgcccctagtctcttaatgcccctgccaggtactaaagcgctgccatcaatggataagtacgcagtgttcaagggcattgcagcagacaaatccagcgaaaacaccgtgccaccaggagatcctggcgacaagtactctgcttttagggagttggaacagacagccgaaaataagccactgggcgagtcattcgctgagtttagaagtgccggaaccgacgatggtttcactgatttcaagactgcagactccgtaagccccctggagcctcctaccaaggataagacatttccaccgagtttcccttctgggacaattcaacagaaacaacagacacaggtgaagaaccccctgaatctggcagacctggatatgtttagcagcgtgaattgcagttcagagaagccactctccttttctgccgtgttttccacaagcaagtcggtgagcactccgcagagcacaggctcagctgccacaatgacagcactggccgctaccaagactagctcgctcgccgacgactttggcgagttcagtctgtttggcgagtacagtgggttggccccagtgggtgaacaggatgattttgcggactttatggccttttcaaacagcagcatctcatctgagcaaaaaccagatgataagtacgatgctctgaaagaagaggcctctcctgtgccattgaccagcaacgttggttctacagttaaaggcggacagaactctacagccgcttccacgaagtacgacgtatttcgacagctgtccctcgaaggaagtggactcggagttgaagatctcaaagacaataccccaagtggcaaatctgatgatgactttgccgacttccactcctcaaaattttcatcgattaacagtgacaaaagtctgggagaaaaggccgtggcctttcggcatactaaggaggactctgcctcagtgaagtcactcgacctgccctccatcggcggaagctccgtgggtaaagaagatagcgaagatgccctatctgtccaatttgatatgaagttggctgacgtcggcggtgacctgaaacatgtgatgtccgactccagcttggacttgcccacagtaagtggccagcacccccctgcagctgacatcgaagacctcaaatacgccgctttcggatcctacagctctaacttcgccgtttcaactctgactagctatgactggagcgaccgcgatgatgcaactcagggcagaaaactgtccccttttgtgttgtcagctggaagcggcagcccttctgcaacctcgatcttacaaaagaaggaaacatcctttggctcctctgagaatatcacgatgacctctctgagcaaagtgacgacgtttgtgagtgaagatgccctgccggagactaccttccccgctttagcatcttttaaagatacgattccccagacaagtgaacagaaggagtacgaaaatagagattataaggacttcaccaaacaagaccttcccacagccgaaaggtcccaggaggccacctgcccttctccagccagcagcggcgctagtcaggagactcctaacgagtgtagtgacgattttggcgaattccaatccgagaagcccaaaatcagcaaatttgacttcctggttgctacctctcaatcgaagatgaagagctcggaagaaatgataaagagcgagttggccacattcgacttgagtgttcaagggtcgcataaacggtcgcttagcttaggagacaaagaaatctctcggtcctctcccagtcccgctctggaacaacccttccgggaccgatccaacaccctcaacgagaaacccgcactgcccgttatacgcgataaatataaagatcttacaggcgaggtagaggaaaatgagcgttatgcttacgaatggcagagatgcctggggtcagccctgaacgtcattaaaaaggctaacgacacccttaatggcatttcttctagtagtgtgtgcactgaggttattcaaagcgcacaggggatggagtacctgctgggcgtggttgaggtgtacagggtcactaagagagtcgagcttggcatcaaagctacggcagtttgttctgagaaattgcagcaactgctgaaggatatcgacaaagtatggaataacttaatcggcttcatgagtctggccacccttacccctgacgagaattctctggatttcagtagttgtatgctccgcccaggtattaaaaatgcccaggagctggcctgcggtgtttgccttctgaacgtggatagtcgcagtcgggctttcaattctgaaaccgacagcttcaagctggcatatggcggacaccaataccacgcatcctgtgcaaacttctggataaactgcgtggaacctaagccgccaggcctggtcctgccagacttattgtag

SEQ ID NO: 30922 - DNA, 354 bp, Artificial Sequence
  Description of Artificial Sequence: Synthetic coding sequence
atggtccaacgtctcacttaccgccgtcggctgtcttataacactgcgtccaacaaaactcggcttagcagaacacccggaaatcggattgtgtatctgtacacgaagaaagtgggcaaggcgcctaagtcagcgtgtggagtatgtcctggaagactgagaggagtgcgggcagtgaggcctaaggtgctgatgaggctcagcaaaacgaaaaagcatgtttctcgagcctatggcggaagcatgtgtgccaagtgtgtccgggacaggattaaaagggctttcctcatcgaggaacagaaaattgtagtgaaggtgctgaaggcccaggcccagtctcagaaggccaagtag

SEQ ID NO: 30923 - DNA, 621 bp, Artificial Sequence
  Description of Artificial Sequence: Synthetic coding sequence
atgtcctcacccagagacttccgcgcagagccggttaatgattacgaaggcaacgacagtgaagccgaggatttgaattttcgggagactcttccaagttcctcccaggaaaataccccccgaagcaaagtgtttgagaacaaagtgaatagtgagaaggttaagctttccctgcgtaacttcccacacaatgactatgaggatgtgtttgaggaaccttctgagagcgggagcgatcctagtatgtggacagccaggggccctttcaggagagaccgctggagtagtgaggacgaagaggccgctgggccttcccaggccttgtctcccctcctatcagacacgagaaagattgtgagcgagggggagctggaccagctcgcccagatacgaccactgatattcaatttccacgagcagacggctattaaggactgtctgaagatcctggaggagaagactgctgcttacgacattatgcaggaattcatgttcaacataatggatatcgtagcccagatgagagaacagagatcaggaatggtccaaacaaaagaacagtatcacttttgctacgatatagtgttggaggtcctgcgaaaattgttgaccctcgattag

SEQ ID NO: 30924 - DNA, 582 bp, Artificial Sequence
  Description of Artificial Sequence: Synthetic coding sequence
atggaggagacaataaaagaccctcctacatccgccgttctcctggaccactgtcatttctctcaggtgattttcaattcagtggaaaaattttacatccccggtggggatgttacctgtcattataccttcacccagcacttcataccacggcgaaaggattggattgggatctttcgagtaggctggaagaccacccgagagtactacacattcatgtgggtgacactccccattgatctaaataacaaaagtgccaagcaacaggaggtgcaattcaaggcctactacttaccaaaggacgacgagtactaccagttttgctacgtggatgaagatggcgtggtccgcggagcgtctattccatttcagttccgcccagaaaacgaagaggacattctggtggttactacccagggagaagtggaagagatcgagcagcacaataaagagctgtgtaaagagaaccaagaactgaaggacagttgtatctccctgcagaagcagaattctgacatgcaggctgagcttcaaaagaaacaggaggaattggaaacactgcagtctattaacaaaaaatag

SEQ ID NO: 30925 - DNA, 156 bp, Artificial Sequence
  Description of Artificial Sequence: Synthetic coding sequence
atggactttttttctagtcatctgttggcagattccagtagccctgccacaaacagctcgcacactgatgcacacgagatcctggtaagtgattttcttgtgtccgacgagaacctccagaaaatggaaaatgtcttggatttatggagcagctag

SEQ ID NO: 30926 - DNA, 513 bp, Artificial Sequence
  Description of Artificial Sequence: Synthetic coding sequence
atgagttccaacgaatgctttaaatgcggcaggagtggccactgggctcgcgagtgtcccacaggcggtgggagaggaaggggtatgagatcgcgcggaaggggctttcaattcgttagttccagccttccagacatatgctatagatgtggagagtccggtcacttggcgaaggattgtgacctgcaagaggatgcttgttataattgtgggaggggcggacacatcgccaaagattgcaaggaacccaagagggagcgcgaacagtgctgttacaactgcggcaagcccggtcacttagctcgcgattgcgatcatgcagatgaacaaaagtgttattcctgcggggagtttgggcacatccagaaagattgtaccaaggtgaaatgttatcgctgcggcgaaacagggcatgtcgccattaactgctccaaaacctccgaggtgaactgctacaggtgcggagaatcaggtcacctggcacgggagtgtactatcgaagcaacagcatag

SEQ ID NO: 30927 - DNA, 399 bp, Artificial Sequence
  Description of Artificial Sequence: Synthetic coding sequence
atgaaccaagaggacttggaccctgattccaccaccgatgtgggggacgttacaaacacagaggaagagcttatcagagagtgtgaggaaatgtggaaggatatggaagaatgtcaaaacaagctaagtctcatcggtacggaaaccctaaccgatagtaacgctcagctgtcccttctcatcatgcaagtcaaatgtctcaccgcagagctatcccagtggcaaaagaagactcccgaaacaatcccattgactgaggatgtactgattaccttgggaaaagaggaatttcagaaactgagacaagatttggagatggtgctctcaaccaaggaatccaagaacgaaaagctgaaggaggacttagagagagaacagaggtggctcgacgagcagtag

SEQ ID NO: 30928 - DNA, 1095 bp, Artificial Sequence
  Description of Artificial Sequence: Synthetic coding sequence
atggtcaaattgtttattgggaatttgccgagagaggcaacagaacaggagatccgatctctgttcgagcaatatggaaaggtattagagtgcgacataatcaaaaattatggttttgtgcacattgaagataaaactgcggcagaagacgcaatcaggaacttacaccactacaagctgcatggcgtgaatatcaatgtggaagccagtaagaacaagagtaagacctccaccaagctgcatgtaggtaatatttccccaacctgcacaaataaggagctgagggcaaagttcgaggagtatggaccagtgattgaatgcgatatcgtgaaagactacgcctttgttcacatggagagagcagaggacgctgttgaagctatacggggattagacaacactgagtttcaagggaagcgaatgcacgtacaattatccacaagtagattgaggaccgccccagggatgggcgatcagtccggctgttatcgctgtgggaaagaaggacactggtctaaagagtgcccgatcgataggagcgggagggtggcagacctcactgaacaatacaacgaacagtacggcgctgtacgtacgccatacaccatgtcttacggagattctctgtattataacaatgcctacggtgctttagacgcctattacaagcggtgtagagcggctcggtcttacgaggccgtggccgctgccgcagctagcgtgtataattacgcagaacagacactcagccagctgccgcaggtccagaatactgcaatggctagtcacctgacttctacgtcccttgacccttatgacaggcacctactccccacatcaggggctgccgctacagctgctgctgccgcagctgccgctgcggctgtcaccgcagccagcactagttactacggcagggacaggtcacctctgcgcagagccactgccccagtcccaaccgtaggggaaggctatggatatggacatgaatccgagctgagtcaggcctccgccgcagcccgaaattcattatacgatatggccagatacgagagggagcaatacgccgacagggcaaggtacagtgcattctag

SEQ ID NO: 30929 - DNA, 420 bp, Artificial Sequence
  Description of Artificial Sequence: Synthetic coding sequence
atggcgacaggagacctcaagagatccctgaggaacctggagcaggtacttagactgctcaactacccagaagaagtagactgcgtcggcctgataaaaggcgacccagcagcaagcctgcccatcatatcgtactcatttacttcatattccccgtatgtaacggaactcattatggagagtaacgttgagctgattgccaagaatgaccttagatttatagacgcagtctacaagcttttgcgggaccagttcaattacaaacccatactgactaaaaaacagttcattcagtgcggattcgcagaatggaaaatccagattgtttgtgatatacttaactgtgtcatgaagaagcataaagaactgtcaagcctgcagaaaatcccttcccagcagcgtaagaagatctcaagttag

SEQ ID NO: 30930 - DNA, 450 bp, Artificial Sequence
  Description of Artificial Sequence: Synthetic coding sequence
atggccaacattgccgtacagcggataaaacgcgagttcaaagaggtgctgaagtccgaagaggttcgcttcatcacaaagatttggcacccgaatatctcttctgtaaccggtgcgatttgtttggatattctgaaggaccaatgggcagctgcgatgaccctcagaacagtacttctgtctctgcaggctctgctggccgcagccgagccagatgaccctcaggatgcagtggtcgcgaaccagtataaacaaaaccctgagatgtttaagcagactgcaagactctgggcacatgtgtacgccggagctccagtaagttctccagagtatacaaaaaaaatagagaacctgtgcgccatgggtttcgaccgcaacgcagtgatcgttgcgttatcaagcaaatcctgggacgtggagacggccacggaattgctgctgtctaactag

SEQ ID NO: 30931 - DNA, 597 bp, Artificial Sequence
  Description of Artificial Sequence: Synthetic coding sequence
atggtcatggaaaagccaagtcccctgctggtcggtcgggaatttgttcgccaatactacacattgctcaacaaggcgcctgaatatcttcacagattctatgggagaaactcgtcctacgtccatggcggagtggatgcgtcaggaaagcctcaagaagcagtatatgggcagaacgacatacaccataaggtcctgagtctgaatttttcagagtgtcatactaagatccgccatgtagatgcacacgccaccttatcggacggagtggtcgtccaggtgatggggctactctcaaattctggccagcctgagagaaagttcatgcagaccttcgttttagcaccagagggatcagtacccaacaaattttatgtccataacgatatgtttagatacgaggatgaagtattcggggatagcgagccggaattggacgaggagtcggaagacgaggtagaggaagagcaagaggagagacagcctagtccggaacccgtccaggagaacgcaaactcaggctactacgaagcccaccccgtgacgaatgggatcgaggaacccttggaggagtcctcacacgaaccagagccttag

SEQ ID NO: 30932 - DNA, 150 bp, Artificial Sequence
  Description of Artificial Sequence: Synthetic coding sequence
atgatgcttggcaccgagggaggagaaggatttgtggtcaaggtcagagggcttccttggtcttgttccgcagatgaggtacagcggttctttagcgactgcaaaatccaaaatggagcacagggcatccggtttatctatactcgttag

SEQ ID NO: 30933 - DNA, 1266 bp, Artificial Sequence
  Description of Artificial Sequence: Synthetic coding sequence
atgatggaggacaacaaacagctcgccctgcgcatagatggagccgttcagtccgccagccaagaagtgaccaatctgcgagcagaactcactgccaccaatcggaggcttgcagaactttcaggaggcggagggccagggcctgggccaggcgcagccgcaagcgccagtgctgccggtgacagcgctgccacaaacatggagaatccccagctgggcgctcaagtgctactgcgcgaggaggtgagtagactgcaagaggaggtccacctgctacggcagatgaaggagatgctggctaaagatctggaggagtcccaaggcggaaagagtagcgaggtgttatccgcaacagagctgagagtgcagctcgcccagaaggagcaggagctagcgcgtgcaaaggaggcgctacaagcgatgaaggctgataggaaacgactgaagggtgaaaagacagatctggtatcacaaatgcagcaattgtacgctaccttggaatctcgggaggaacagcttagagatttcatcagaaactacgagcagcacaggaaggagtcagaggatgctgtgaaagctctggccaaggagaaagacctcctagaaagagaaaagtgggagctcaggaggcaggcaaaggaggccaccgatcacgccaccgccctgagatcccaacttgacctcaaagataaccggatgaaagagcttgaggccgagctcgccatggctaagcagtccctggcgacattaactaaggatgttcccaaacggcatagcctggctatgccaggcgaaacggtattaaatggaaaccaggagtgggtggtgcaagccgacctgcctctgactgctgctattaggcaaagtcagcaaacactttatcatagccaccctccgcaccctgcagaccgacaggctgttcgtgtctctccctgtcactctcggcagccgtctgtgatcagtgatgcatccgctgctgagggggaccggagctctacaccaagtgatattaactctccacgccatcggacccactcgttgtgtaacggagactccccaggacccgttcaaaagaatctgcataaccctatagtgcagagcctagaggaccttgaggatcaaaaacgtaaaaagaaaaaagaaaaaatgggcttcggctctatatccagggtattcgctcggggaaagcagagaaaaagtctggaccccggactgtttgacggaacagccccagactattacattgaggaagacgctgactggtag

SEQ ID NO: 30934 - DNA, 1173 bp, Artificial Sequence
  Description of Artificial Sequence: Synthetic coding sequence
atggcaacaggcgacctgaaacggtcattgcgcaatttagaacaggtcttaagactcctgaattatcctgaagaagttgactgcgtgggactcataaagggcgatcccgctgcctcgcttcccataattagttattctttcacgtcttactctccctatgtgactgaactgattatggagagcaatgttgagctaatagccaaaaacgacttgagattcattgatgccgtctacaaactgctccgagaccagttcaactacaagcccattctcactaagaagcagttcatccagtgcgggttcgcagaatggaagatccaaattgtgtgcgacattctcaactgtgtgatgaagaagcacaaggaactttcttctctgcagaaaatccctagtcaacagagaaaaaaaattagttctgggaagtctgaaccgccacttgggaacgagaaaatctcggcagaggccgtgggcgtcgacattagtggtcgattcatgaccagtgggaaaaaaaaggctgtcgttatccgacacttatataatgaagataacgtggatatcagcgaagacaccttaagcccaattacagatgtgaatgaagccgtggacgtttctgaccttaacgctaccgagatcaaaatgcctgaagtgaaggtcccagaaatcaaggccgagcagcaagatgtgaacgtcaatccagaaattactgccctacagacaatgctagccgaatgccaggagaacttaaagaagctgaccagcattgaaaaacgactagactgcctcgagcagaaaatgaaaggcaaggtaatggttgatgagaacacctggactaatctgttatcccgagttactctcctggagactgagatgctactctccaagaaaaacgatgaattcatcgaatttaacgaagtctctgaggactacgcttcgtgttccgacatggacttgcttaatccccacaggaagagcgaggtggagaggcctgcttccattccactatcgtccggctattctactgcttccagcgattcaactccaagggcctctaccgttaattactgcggactgaacgagatctctgaggagactaccatccagaaaatggagaggatgaaaaagatgttcgaggaaacagccgaactcctgaagtgtcctaaccactatctgtag

SEQ ID NO: 30935 - DNA, 390 bp, Artificial Sequence
  Description of Artificial Sequence: Synthetic coding sequence
atgaagcgcggtagactgcctagttccagcgaagatagcgacgacaacggctcactttcgacgacctggtcccagaactcacgatcccagcacagaagatcttcgtgttctcggcatgaagatcgcaagccaagcgaagtgttcagaactgatctgataaccgcaatgaaacttcacgattcttaccagctgaaccccgatgagtactatgttctcgcagacccttggcggcaggagtgggaaaagggagtgcaggtgcctgtctcccctggcaccattccccaacccgtcgcgagagtcgtgtctgaggaaaagagcctgatgttcattagacccaagaagtatatagtctcttccggctcagagccccctgagctcggatatgtgtag

SEQ ID NO: 30936 - DNA, 489 bp, Artificial Sequence
  Description of Artificial Sequence: Synthetic coding sequence
atggactttttcagctcccacctcctcgcggatagcagctcacctgcgacgaactctagtcacaccgacgcacatgagatcctagtgagtgattttctcgtaagtgatgagaacctacagaagatggagaatgtgctcgacctctggtcctccggcctaaaaacaaatatcatctctgaactctcgaagtggcggctgaacttcatcgactggcaccgcatggagatgagaaaagagaaagaaaagcacgccgcacacttaaagcagctgtgcaatcagatcaatgaactcaaggagctgcagaaaaccttcgagatatccattgggaggaaggatgaggtcatttcttcattgtcacatgcaattggtaagcaaaaggagaagatagagctcatgcgcaccttctttcattggcgaattggacatgtccgggctagacaggacgtgtatgaaggaaagttggcagatcaatattatcaaaggacgtag

SEQ ID NO: 30937 - DNA, 411 bp, Artificial Sequence
  Description of Artificial Sequence: Synthetic coding sequence
atgattgtgaacgattacgaggggaacgatagtgaagctgaagacttaaacttcagagagactctgccgtcttccagccaggagaatacgccacgtagcaaagtgtttgaaaacaaggtgaactctgaaaaagttaagctaagtcttcgcaactttccgcacaacgactacgaagatgtgtttgaagaaccctcggagagcggatctgacccctccatgtggacagcaagaggtcctttcaggcgcgaccgttggtcatcagaggacgaagaagcagctggaccctctcaggccctttccccactgctgtccgttcagcaccatggatattctggaccaaatgagaggacaaccttttggcacggatctaatgagggagcagtgtccctgcttctgcgatactgcgcctag

SEQ ID NO: 30938 - DNA, 321 bp, Artificial Sequence
  Description of Artificial Sequence: Synthetic coding sequence
atggcctcccagctccaggtgttcagccccccaagcgtctcctcatcagctttctgctccgcaaagaagctcaagatcgaaccatctggctgggatgtctctgggcagtcaagtaatgacaaatattacactcattctaagactcttccagctacgcagggacaagctaacagttctcaccaggtggccaatttcaacattcccgcatacgaccagggcttgctgctgcctgcgcctgctgttgagcacatcgtggtaacagctgcggatagtagcgggtcagccgcaacttctacgttccaatcaagccaaaccctttag

SEQ ID NO: 30939 - DNA, 411 bp, Artificial Sequence
  Description of Artificial Sequence: Synthetic coding sequence
atgaaacgcggaagactcccatctagcagcgaagatagcgacgacaacggatcactcagtacaacatggtcgcagaactcccggtctcagcaccggcgttcctcttgttcgcggcacgaagatagaaagccctctgaggtttttcggacagacttgataacggcgatgaagcttcatgattcttaccaactgaaccctgacgagtactatgtgctagccgacccttggaggcaagaatgggagaaaggtgtgcaggttccagtgtcccccggaacaataccacagcctgtggcccgagttgtgagtgaggagaagagcctgatgtttatacggccaaagaagtatatagtatccagtgggtcggagcctccagagcttgggtacgtagatattcggactctagcggattag

SEQ ID NO: 30940 - DNA, 396 bp, Artificial Sequence
  Description of Artificial Sequence: Synthetic coding sequence
atggaggacggcactcccaagcacattatccaaatgacagggttcaaaatggaagagaaggaagcacttgtgaagctactcctcaaacttgactgtaccttcattaaatcagaaaagtacaaaaattgtacacacctgattgcagagagactatgtaagagcgagaagtttctagcagcctgtgcggcaggcaaatggatccttacaaaggactacataatccatagcgccaagagtggacgttggctcgacgagacgacttacgagtggggatataagatcgagaaagatagtcggtacagcccccagatgcagtctgctccaaagcgctggcgggaagagcttaaacgtaccggcgctcctggagctttccaccggtggaaagtagttctttag

SEQ ID NO: 30941 - DNA, 1668 bp, Artificial Sequence
  Description of Artificial Sequence: Synthetic coding sequence
atgcgcctgattggaatgcctaaggagaagtatgaccccccagacccccgtcgcatttacactattatgagtgcagaggaagttgccaatggaaaaaaatctcactgggcagaactggaaatcagtggcagggtgagatcgctgagtacgagcctgtggtctctcacacacttaaccgcgctgcaccttaacgataattacctgtctaggataccaccagatatcgctaaactgcataatttggtatatctggacctgtcatccaacaagcttcgaagccttcccgcagagttggggaatatggtttcactgagagagttactgttaaacaataacctcctcagagtcctgccatacgagctgggacggctgttccagttgcaaactctggggctcaagggcaacccactgtcacaggacatcctgaacttatatcaggacccagatggcacccgaaaattactgaatttcatgctagataatctcgccgtccatcctgaacaacttcctcctcgaccgtggatcacgctaaaggagcgggaccagatcttgcccagcgcaagctttactgtcatgtgctacaacgtgctttgcgacaaatacgctacccgccagctgtacggatactgtccctcttgggccctgaattgggaatacagaaaaaagggtatcatggaagaaatcgtgaattgtgacgcagacattatatccttgcaggaggtcgaaaccgagcagtacttcaccctctttctcccagctctgaaagaacgaggatacgatggcttctttagcccaaaatcacgcgctaagatcatgtcggagcaagaaagaaaacacgtggacggatgcgctatcttctttaaaactgaaaagtttacactcgttcagaagcatacggttgagtttaatcaggtcgcgatggctaacagcgatggatctgaagccatgctgaatcgggtgatgaccaaggacaacataggtgtggcggtggtcctcgaggtgcacaaagagctcttcggagctggcatgaagccaatccacgccgctgataagcagctgctgatagtggcaaacgcccatatgcattgggacccagagtacagcgacgttaaactcatccaaacgatgatgtttgtttcagaggtgaaaaatatcctcgaaaaggcaagcagtagacccggatcccctaccgccgacccaaattccattccgttggtcctctgcgctgatcttaattctctgcctgacagtggagtagtcgaatacttgagtaacgggggagtggcagacaatcacaaggattttaaagaacttcggtacaatgagtgcttaatgaactttagttgtaacggcaaaaatggctcaagcgaggggaggatcacacatgggtttcaactgaagtctgcatatgagaacaacctcatgccctacacaaactatacttttgatttcaagggagtaatcgattatatattctactcaaagactcatatgaatgtgctcggtgtgctggggcctttggatccccagtggctcgtggagaataatattacaggttgcccacatccgcatatcccgtcagaccacttttccctcttgactcaattggagctccaccctcctttgctccccttggttaatggagtccacctgccgaataggaggtag

SEQ ID NO: 30942 - DNA, 1635 bp, Artificial Sequence
  Description of Artificial Sequence: Synthetic coding sequence
atgaataccagcatcccttaccagcagaacccttataacccacgcggatcgagtaacgtgattcagtgttaccgctgtggtgatacctgtaaaggagaggtggtccgggtgcacaataaccacttccatattcgttgctttacatgtcaggtgtgtggctgtgggctggctcagagcgggttcttcttcaagaatcaagaatacatttgcacccaagactatcagcagctgtatgggacgcgctgtgatagctgcagagatttcattacaggtgaggtcataagcgccttaggcagaacttatcatccaaagtgtttcgtctgttctttgtgcagaaagccttttcccatcggggataaagtgacgttttccggtaaggagtgtgtctgtcagacctgctctcagagtatggctagttccaagccaattaagataagaggcccaagccactgcgccggttgtaaagaagagattaagcatggacaaagtctgttggcattagacaagcaatggcatgtgagttgcttcaagtgtcagacatgctcagtgattttaaccggcgagtacatcagcaaagacggggttccttattgtgaaagtgactatcatgcacaatttggaatcaaatgcgaaacatgtgatcgatatatcagcggtagagtactggaggcaggcggtaaacattatcatcccacatgcgccaggtgcgtgaggtgtcatcagatgttcacagaaggggaggagatgtacttgacaggttccgaagtatggcaccctatctgtaaacaggctgctagagccgaaaaaaaattaaaacaccggaggacctccgaaacatcaatctccccgcctggctccagcatcgggtctccaaatcgcgtcatctgcgatatttatgagaatttagatttaagacagaggagggcctcgagtccagggtatatcgactctccaacttactctcgccagggaatgagccccactttttcccgctccccccaccactactatcgaagcggtgacctttctactgctactaagagcaaaacttccgaggacatctctcagactagtaagtattcccccatctattcccctgacccctactacgcaagcgaaagcgagtactggacttaccatggtagccctaaggtgccacgcgctagaaggttttcttccggcggagaggaagatgattttgaccgatccatgcataaacttcaaagcggcatcgggcgattgatcctaaaagaagagatgaaagcccgatcgtctagctatgcagatccttggactcctcctaggagttctaccagtagtagagaggctttgcacacggctgggtatgaaatgtctctcaatgggtcccctcgatcccactacctggcagactccgaccccctgatcagtaagagcgcttcactccccgcttatcgtagaaatgggcttcacaggactccgtcagctgatcttttccattatgattcgatgaatgcggttaactggggtatgagagagtacaaaatatatccctatgagctcctgctggtgaccacccgagggcgtaacaggctgcctaaggatgtggatcggactaggctcgaagggaacttttggaaatccggctgcctctag

SEQ ID NO: 30943 - DNA, 393 bp, Artificial Sequence
  Description of Artificial Sequence: Synthetic coding sequence
atggggcgtctggatggaaaggtgattatactaactgctgccgcacagggaatcggtcaggctgctgcactggcatttgcaagagaaggggcaaaagttatcgctacagacatcaatgaaagcaaactacaagaactggagaagtatcctggcatccaaaccagggtgctcgacgtgactaaaaaaaaacaaattgaccagtttgctaatgaggtcgagcggctggacgtactgttcaatgtggcgggatttgttcaccacggcaccgtgctggattgcgaagagaaagattgggatttttcgatgaacctgaacgtgaggtctatgtatcttatgattaaagctttcctcccgaagatgttggcacagaaatccggaaatattattaattag

SEQ ID NO: 30944 - DNA, 1119 bp, Artificial Sequence
  Description of Artificial Sequence: Synthetic coding sequence
atgcagggcccagccggaaacgcttccagagggcttccgggtggtcccccaagcaccgtcgcttccggggctgggagatgcgagtctggtgccctcatgcactcgtttgggatctttcttcaagggctgctgggcgtagtcgctttcagcaccctgatgctgaagagattccgcgaacctaagcacgagagacggccatggcggatctggttcctcgacacctcgaagcaagctatcggcatgctgtttatccacttcgccaacgtgtacctggccgacctcaccgaagaggacccttgctcgctctatctgatcaattttctacttgacgcaacagtaggtatgctgctgatatatgtcggcgtcagagccgtgagcgttctggttgaatggcaacagtgggaatcattacggtttggggaatacggcgacccgcttcagtgcggagcatgggttggtcagtgcgctctgtacattgtgattatgatcttcgagaagagcgtggtctttattgtcctgctcatcctgcaatggaaaaaagtggcacttctgaatcccatcgaaaaccctgatttgaagcttgccatcgtaatgctaattgttccgtttttcgtgaacgccctcatgttctgggttgtcgacaatttcttaatgcgtaagggcaagaccaaagctaagctggaagagcgcggagctaatcaggacagcagaaatggctcaaaggtgcgctaccgcagagcggcatctcatgaagagtccgagtctgaaattctgattagtgcggatgatgagatggaggaatcagacgtggaggaggacctgcgacggttgactcccctcaagcctgttaaaaagaagaagcacaggttcggcctgcccgctggcgctcaggaggccccaatcaagaagaagcggccaccagtgaaggacgaggatcttaaaggggcaagaggtaaccttactaagaaccaggaaataaaatctaaaacctatcaggtgatgcgcgaatgtgagcaagccggaagtgctgctccctctgttttctcgcgcaccagaactggaactgagactgtgttcgaaaagccaaaggcagggcctacaaaaagcgtgttcggttag

SEQ ID NO: 30945 - DNA, 507 bp, Artificial Sequence
  Description of Artificial Sequence: Synthetic coding sequence
atgatgcttgggacagaaggaggcgaggggttcgtggtgaaagtgagaggactcccttggagttgcagcgcagatgaggttcaaagatttttttctgactgtaagatccagaacggggcacagggaattaggttcatctacacgagggaaggaaggccttccggagaggccttcgtggaactggagagcgaagatgaggttaagctagctctcaaaaaggacagggagacaatgggtcacaggtatgttgaggtgtttaagtccaataatgtggagatggattgggttctgaagcatacagggcctaatagtcccgacactgccaacgacgggttcgtgaggctgcgcggacttccatttggatgcagcaaagaggaaatagtgcagtttttttctgggcttgaaattgtccctaacggcatcaccctcccagtcgatttccaggggagatccacgggggaagcctttgtgcagtttgcgagccaagaaatcgcggagaaggcatag

SEQ ID NO: 30946 - DNA, 9 bp, Artificial Sequence
  Description of Artificial Sequence: Synthetic coding sequence
atggcctag

SEQ ID NO: 30947 - DNA, 1131 bp, Artificial Sequence
  Description of Artificial Sequence: Synthetic coding sequence
atgacaactgtcgtggtccacgtggactccaaagctgagctcaccaccttgctcgaacaatgggaaaaagaacacggcagtgggcaagatatggttcccatcctaacgaggatgagtcaattgattgagaaggagactgaagagtataggaaaggtgacccagacccttttgatgataggcacccaggcagagccgaccctgagtgcatgttgggtcatttgctgcgcattctcttcaagaacgatgacttcatgaatgccctggtgaacgcatacgtgatgacatcaagagagcctccactgaacaccgctgcctgccgccttcttctcgatattatgcccggtcttgaaaccgccgttgtctttcaggaaaaggaaggcatcgtggagaatctattcaagtgggcacgggaggccgaccagcctctccggacctacagcacaggcctgctgggcggagccatggaaaatcaggatatagctgccaactaccgagacgaaaatagccaactcgtcgccattgtcttacgacggctgcgcgaactgcagctgcaggaagttgccttacgccaggaaaataagcgcccaagtcctagaaaattgagcagcgagcctctactcccccttgacgaggaggccgttgatatggactacggagacatggcggtggacgtcgttgatggcgaccaggaggaagcgagcggggatatggaaatcagcttccaccttgacagcggacacaaaactagcagccgcgtgaattccactaccaaacctgaagacggtggactgaagaagaataagtcagctaagcagggagatagagagaatttcaggaaagcaaagcaaaagcttggcttcagttccagtgaccccgaccgaatgttcgtggagctttctaactcctcatggagcgagatgtcaccttgggtgattggtaccaattatacgctctaccccatgactccagctattgaacaaagactcattttgcagtacctgaccccactgggagaataccaggaactactacctatattcatgcagttaggatcacgcgagctaatgatgttttacattgatcttaagcagaccaacgacgtgctgctgacattcgaagctctcaagtag

SEQ ID NO: 30948 - DNA, 504 bp, Artificial Sequence
  Description of Artificial Sequence: Synthetic coding sequence
atgagcagcaacgagtgcttcaagtgcgggagaagcgggcactgggctcgagagtgtcccaccggaggaggacgaggaagaggcatgcggtctcggggaagagggggatttacaagtgacagagatatatgctatcggtgtggcgagtccggtcacctggcaaaagactgtgacttgcaagaggacgcttgttataactgcgggagaggcggacacatcgctaaggattgtaaggaacctaaaagggagcgtgaacaatgctgctataactgtggcaagcctggccacctggccagggattgcgatcacgctgatgaacaaaaatgttattcttgtggcgaatttggccacatccagaaggattgcactaaggtgaaatgttaccggtgcggcgagactggccatgtggccatcaattgtagcaaaacctcggaggtgaactgctatcggtgcggcgagtccggccatttggccagggaatgcactatcgaagccaccgcttag

SEQ ID NO: 30949 - DNA, 999 bp, Artificial Sequence
  Description of Artificial Sequence: Synthetic coding sequence
atgtccgaggccggtgaagaacaaccaatggaaacaaccggagccacagagaatgggcacgaggccgtgcctgagggagagagtcccgctggcgcaggaacaggtgccgctgcgggtgctggcggagctactgccgctcctccaagtgggaatcagaacggggcagaaggagaccaaatcaacgcgagtaaaaacgaggaagacgcgggaaagatgtttgtcgggggactctcctgggacacgtccaagaaggatctcaaggattactttacaaagttcggcgaggtggtggattgtaccatcaagatggatcccaacacaggcagatcccgcggtttcgggttcattttgtttaaggatgccgctagcgttgaaaaagtcttggaccagaaggagcatcgccttgacgggagagtcattgatcccaaaaaggccatggcgatgaaaaaggatccggttaaaaagatttttgtgggcggtttgaaccccgaggctactgaggagaagatccgtgaatattttggggagttcggtgagattgaggcaattgagctgccaatggaccccaaattgaataagaggcgaggctttgttttcatcactttcaaggaagaagagcccgtgaaaaaggttctggaaaagaagtttcatactgtatcgggatccaagtgtgagattaaggtggcccagccgaaagaagtgtaccagcaacagcagtatggcagcgggggaagaggcaaccgcaatagagggaaccggggaagcggcggaggcggaggcggaggcggacagagtcagagttggaaccaaggttacggaaattattggaatcaggggtacggatatcagcagggctatggcccaggctatggtggatacgactactccccgtacggctattatggctatgggccaggttacgattactctcaaggcagtacaaattacggaaaatctcagcggaggggcggtcatcagaacaattacaaaccgtattag

SEQ ID NO: 30950 - DNA, 615 bp, Artificial Sequence
  Description of Artificial Sequence: Synthetic coding sequence
atgtctgatctgaggattacagaggcgttcctgtacatggactacctatgctttcgcgcattgtgctgtaagggcccaccccctgctagacctgaatacgatctcgtgtgtattgggctgacaggctccggcaaaaccagtcttctttccaaactgtgttcggagtctccagacaacgtcgtctcaacaaccggcttttccattaaagccgtaccctttcagaacgccatactgaacgtaaaggaacttggtggtgccgataacattcgtaagtactggagccggtactaccagggctcccaaggtgtcatatttgtgttagattcggctagctctgaggatgacctcgaagcagccaggaatgagttgcacagtgcccttcagcaccctcaactgtgcacactgcccttcttaatactggctaaccaccaggataagccagccgcacggtccgtgcaagaaattaagaagtactttgagctggaacccttggcacgaggtaaacgttggattctgcagccttgcagcctcgatgacatggacgcactgaaagactcctttagccaattaatcaatctccttgaggagaaggaccacgaggccgtgaggatgtag

SEQ ID NO: 30951 - DNA, 6314 bp, Artificial Sequence
  Description of Artificial Sequence: Synthetic coding sequence
atggaaagtcaggagtttatcgtgctctatacccaccagaagatgaaaaagtctaaggtgtggcaggacggcattctgaaaatcacccatcttggtaataaagccattctctatgacgacaagggagcatgcctcgaatcgttgttcttgaagtgtctagaggtcaaaccaggggatgatctggagtcagaccggtacctcattacggtggaagaagttaaggtggcaggggctattggcatcgtgaaacagaacgtcaataaggaagcacccgagctgaactccagaacattcatcagttccggcagatcactcggctgccaaccaagtggtttaaagagaaaatttaccgggttccaggggccaaggcaggtgccgaagaaaatggtcattatggaaagcggggagagcgccgcaagtcatgaagccaaaaagaccggtcctactattttttcgcctttttgttctatgcctcctctgtttcctactgtcgggaaaaaggacgtgaacaacatactcgctgatcctgaaaatattgttacttataagaatagagagcggaacgccatggacttctcctccgttttctctccttcatttcaaataaaccccgaggtgttgtgtgaagaaaactacttctgctctccagttaactccggaaataagttgtcagattcactgttaaccaatgagccagtgaagcgggactcattggccagccactattcaggcgtctcccaaaacatacggtcaaaagcacagattctggcactgctgaagagtgagtcctcttcaagctgcgaggaactgaattcagaaatgactgaacattttccacagaaacagcctcaagggtcacttaagatcgcgactaagccaaaatacctcattcagcaggaggagtgcgcagaaatgaagtccactgaaaacttgtattaccaacaccagtccgagaataccatgcggaacaaatctcgctgggccatgtatctgtcctcacagtcatcacccatacattcctccaccgtggacgggaatgacactgaaagaaaacctaaagcgcaggaggacgatgttaactctaatctgaaggacctgtccctgcagaagataattcagtttgtagaaacgtacgccgaagagcggaagaaatataacgtggatcagtccgtggggaataacgacccatcgtggaaccaggaggttaaactggaaataccctcatttaatgagagttcatccctgcaggttacatgctcaagtgctgagaatgacgggatcctgtctgaatcagatattcaggaggataacaagatcccattcaaccagaatgataagggctgcatcaaggggtcagtgttaatcaaggagaacgcgcaggaagtgaatacatgtggcactctggaaaaagaatatgaacaatctgagagtagcttaccagaactgaaacacttgcagattgaaagcagtaataacagcaggataagcgatgacattactgacatgattagcgaatctaagatggacaacgagagcttgaacagcatacacgagtctttgagcaacgtcacgcagccgtttcttgaggtcactttcaatctgaataactttgagacatcagacacagaagaggagtcccaagagtcaaacaagatctcccaggattccgagtcatgggtgaaggatatcttggtcaacgatggaaatagctgtttccaaaaacgaagcgaaaacacgaattgtgaggaaatcgagggagaacacctcccattcctgacctcagttagcgacaaaccaacggtcacctttcctgtcaaggagactttaccgagtcagttctgcgataagacgtacgtggggtttgatatgggcatttgcaaaaccgaaaacaccggcaaagaaattgaagagtactcagatacactctctaatttcgagtcctttaaatggactgatgccgtgtacggcgataacaaggaggacgctaataagcccatacaggaggtaaggattaactacgactttgccctgccaccaaacaagtcaaaaggcataaatatgaatctgcatatcccgcacatacagaatcagatcgcagaaaattcaaaccttttctctgaagacgcgcagccgcagccttttatcctgggaagcgacctggataaaaacgatgaacacgttctaccttccacatcttcatcagataactctgtgcagctattgaacaccaaccagaatcactatgaatgtattgctctggataaatccaacacccacatctcaaacagcctcttctatcccctgggcaagaagcatctgatttccaaggacacggaagcacacatctctgaacccgaagatctcggcaagataagatccccacctcccgaccacgtggaggtcgagaccgcaagggagggcaaacagtactggaaccccagaaattcaagcgagttgtccggcctcgtcaacacaatctcaatacttaaaagcctctgcgagcatagcacagcactggatagcctggagattcttaaaaaaaaaaacactgtcttccagcaaggcacccaacagacatatgagccggacagtcctcctgaagtgcggaaacccttcatcacagtggtcagcccgaaaagcccccacctgcataaagattctcagcaaattctgaaggaggacgaggtagagctgtcagaaccactgcagtctgttcaattcagctcttctggtagtaaagaggagacagccttccaggccgttatccccaaacagatagaaagaaaaacatgtgacccgaaacccgtggagtttcaggggcaccaggtcaaagggtccgcaacctcaggtgtgatggtgcggggacacagctcccagctgggatgttcacaattccctgacagtaccgagtacgagaacttcatgacagaaacccccgaattgcctagcacttgtatgcaaatcgacttcctacaggtaacctctcctgaagagaacatcagcacactgtctccagtcagcaccttctcgctgaattcacgcgacgaggacttcatggtcgagttcagcgaaacttctctgaaggccaggactcttcctgatgacctgcatttccttaatttggaagggatgaagaagagcagaagcctcgagaacgagaacctccagcgcctcagcctgctgagccgcacccaagtccccctcataactctgcctcggaccgacggacctcctgatctagactcacactcctatatgatcaattctaacacctacgagtcttccggatcacctatgttgaacctgtgcgagaaatctgcagtgctgtcattcagcatcgaaccagaagatcaaaatgaaactttcttttcagaggaaagccgcgaagtgaatcccggagatgtgagcctgaataatatttctactcagtccaaatggttgaagtatcagaatacatcgcagtgcaacgttgccacaccaaatagggtagataaacggatcactgacggatttttcgctgaggccgtttcaggcatgcacttcagagacactagcgagaggcagtctgatgccgtgaatgagtcatcgctggatagtgtacatctccagatgataaagggtatgctttaccagcagaggcaagacttttcatcccaggatagcgtgagtcgtaagaaagtgctctcgttaaacctaaaacaaacttctaaaacagaggaaatcaagaatgtcctggggggaagcacctgctataactattccgtgaaagaccttcaggaaatttctggcagtgagctgtgcttcccttctgggcagaagatcaagagtgcttacctgccgcaaagacagatacacattcctgcggttttccagtcgccagcacattataagcagacattcacttcatgcctgatcgaacatctgaacattcttctgtttggcctagcccagaatctgcagaaagctctgagtaaggtggacatctcattctatacctctctcaaaggtgagaaactgaaaaatgcggagaacaatgttcccagttgccatcattcacagcctgccaagctggtcatggtcaaaaaggaagggccaaacaaaggcaggttgttttacacatgtgacggcccaaaagctgataggtgtaagtttttcaaatggcttgaagacgttacgcctggatactccactcaggagggggctagacctggcatggtcctgtctgacataaaaagcattggactgtatctgcgctctcagaagattcccctctatgaggagtgccagctgcttgtgcgcaagggattcgattttcagcggaagcagtacggcaagttgaaaaaatttacgacagtcaatcctgaattttataacgagcccaaaaccaagttgtatttaaaactgtccaggaaagagcgcagttctgcatactctaagaacgatctctgggtggtcagcaagaccctcgacttcgagttagacacttttattgcatgtagtgcattctttggtccatcaagtattaacgagattgaaatactgccacttaaaggatacttccctagtaactggccaactaatatggtcgtccatgccctcctagtgtgtaacgcctcaactgagttaaccaccctcaagaatatccaggactatttcaatcccgctacactccccctgacgcagtatttgcttacgacatccagccctaccatcgttagtaataagagggtgtcgaagaggaagtttattccgcctgcctttaccaacgtatccaccaaattcgagctcctttccctcggcgctaccttgaaactggcatctgagctgatacaagtccataagctgaacaaggaccaagccaccgcactcattcaaatcgcacaaatgatggcctcacacgaatccattgaggaagtaaaggaactgcagacccatacatttccgattacaataatacacggcgtgtttggggctggcaagtcctacctgctggcagttgtgatactcttcttcgtccaactattcgaaaaatctgaagctccaacaatcggaaatgctcggccatggaaactccttattagctcctccactaatgtcgctgtggacagggtgttacttggcttattgtcactcggtttcgaaaactttatccgtgtgggatctgtcagaaagattgctaagcccatcctgccttactcccttcatgcaggatccgagaatgaaagtgaacagttgaaagagctacacgctctgatgaaagaagacctgacaccaacagagcgggtgtacgtcagaaagtcaatagagcagcacaaattaggaacaaatcggactctcctgaagcaggtgcgggtcgtaggtgtgacttgtgcagcttgtccattcccttgcatgaacgatctgaaattccctgttgtggtgcttgacgagtgttcccagatcaccgagccagcaagtctgctccctatagccaggttcgaatgcgagaagctgatcctcgtcggtgatcccaagcagctgcctcctactattcaagggtccgacgcagcccatgaaaacggccttgaacagaccctgttcgataggctctgtctgatgggccataaacctattcttctgagaacacagtaccgctgccatcccgcaatttccgccatagcaaatgacctcttttacaaaggcgctttgatgaatggcgtcactgagattgagcggtctccgctgctggagtggttgcccaccttatgcttctataatgtaaaagggttagaacagatagagagagataactcattccataacgttgccgaagccacattcaccctaaagttgattcagagtttaatcgcttccgggatagccggatccatgatcggcgtgataaccttatacaagtcccagatgtataagctgtgccatttgctgtcagcagtggacttccaccatcctgatataaaaactgtgcaggtgtcgacagtggacgcttttcagggggctgaaaaggagattatcattctatcctgtgttagaactaggcaggtgggttttatagacagcgaaaagaggatgaatgtggcactaactaggggcaaacgccatctgctgatcgtggggaatcttgcctgtctcagaaagaatcagctttggggcagagtgattcagcactgtgaaggtcgggaggacgggctgcaacacgccaaccagtacgagccccagttaaaccacttactcaaggattatttcgaaaaacaggtagaggaaaaacagaaaaagaagagtgaaaaggaaaagagcaaagataagtcccactccta

SEQ ID NO: 30952 - DNA, 567 bp, Artificial Sequence
  Description of Artificial Sequence: Synthetic coding sequence
atggccgctaccgctagggaggatggggcatcgggccaggagagaggtcagagaggttgtgagcactacgataggggctgtctgctaaaagcaccttgctgtgacaaactgtacacatgtaggctgtgccacgacaacaacgaggatcaccagctcgatcggtttaaggtcaaggaagtgcagtgtatcaattgcgaaaagatccagcacgcacagcagacatgcgaagagtgcagcacgctgttcggcgagtactattgtgacatatgccacctgtttgacaaggacaagaagcagtatcactgcgaaaactgtgggatttgcaggatcggcccaaaggaggatttctttcactgtctcaagtgtaatctctgcctcgccatgaatctgcagggacgtcacaagtgcattgaaaacgtctcaaggcagaattgccccatctgtctagaagatatccacacatcacgggtggtagcccatgtgctgccttgcggacacctgttacatcgcacgtgttatgaggagatgctgaaagaatacgaccaagttctcgagacggcaggatag

SEQ ID NO: 30953 - DNA, 339 bp, Artificial Sequence
  Description of Artificial Sequence: Synthetic coding sequence
atggcaacaggcgatctaaagagatcactgcggaatctggagcaagtgttgagacttcttaattatcccgaagaggtcgattgcgtcggcctcataaagggcgaccctgcagcttcgcttcccattatctcttattcatttacaagctactctccatatgtgacggaattaatcatggagtccaatgtcgaacttattgccaaaaacgacctgaggttcatcgacgccgtgtacaaactgcttagagaccagttcaattacaagccaattctcactaagaaacagtttattcagtgcgggtttgctgaatggaagatccagatcgtgtgtgatatctag

SEQ ID NO: 30954 - DNA, 363 bp, Artificial Sequence
  Description of Artificial Sequence: Synthetic coding sequence
atgtggaaggtcgtgaatctgcctacagacctcttcaattcggtcatgaatgtgggccgattcaccgaagaaatcgagtggctgaagttcctagccttggcatgctctgccttgggggtgaccattacaaagaccctaaagattgtgtgcgaggtgttgtcctgtgatcacaacggtggactgccaaggattccgttttccacattccagttcctgtacacgtatatcgcggaagtcgacggcgagatttgcgcatcccacgtgtctagaatgcttaattacatcgaacaggaggtaatcggacctgatggattgataacggtgaacgacttcacccagaatccgagggtttggctagagtag

SEQ ID NO: 30955 - DNA, 2490 bp, Artificial Sequence
  Description of Artificial Sequence: Synthetic coding sequence
atggcgaaatacaataccggcggaaatcctaccgaggatgtctctgtaaactcacggcctttccgcgtgacagggcctaactctagctccggcatccaagccaggaaaaacttgttcaataaccaggggaacgcttcccctccggctggcccttccaacgtcccaaagttcggcagcccgaagcctcccgtcgccgtcaagccgtcttctgaagagaagcccgacaaagagcccaagccgcctttcctgaagcccactggagctggccagaggtttggaacgcccgcatcactgacaacaagggatccagaggccaaagttggcttcctgaaaccagtggggcctaaaccgatcaatttgccaaaagaagacagcaagcctactttcccatggcctccaggcaacaaaccgtctctgcattcagtgaaccaggaccatgatctgaagcctttaggccctaaatctgggcctactccaccgacctctgaaaacgagcagaagcaggcttttcccaagctgaccggagttaaaggaaagttcatgtccgcctcacaggacctggaacccaaaccgctgtttcccaaaccagcatttggacagaagcccccattatccacagaaaacagtcatgaagacgaatcccctatgaagaatgtgtcctcaagtaagggaagccctgcaccactgggggtgagaagcaagagtggtccattgaagcccgcacgtgaggactccgagaataaggaccacgcgggtgagatcagttccctgccctttccgggagtagtgttgaaacctgcagcaagtaggggcggtcctggcctctcgaagaatggagaggaaaaaaaggaggatcgcaaaatcgacgctgctaagaacaccttccagtctaagatcaaccaggaggaactggcctctggaacgccacccgctaggttccctaaggcaccttccaagctgacggtcggaggcccatgggggcagagtcaggaaaaagagaagggcgataagaactcagcaacccctaagcagaagcccttaccacctctgttcacactgggccctccaccgcctaaacctaatcgcccaccaaacgtggacctgactaagttccataagacttcctctggcaacagtacctcaaagggacagacatcttattcaaccacctcgctaccacctcctcccccttcgcaccctgctagccagcctcccctaccggctagccacccatcccagccgcctgttccatctctgcctccacggaacatcaaaccgccttttgacctgaagtcccctgttaacgaagacaatcaggacggggtgactcacagcgatggtgccggtaacttggatgaggagcaggactctgagggggagacctacgaggacattgaggcttctaaggagcgggaaaagaaacgcgagaaagaggaaaaaaaacgtttggagttggaaaagaaagagcagaaggagaaggaaaagaaagaacaggagattaagaaaaagtttaagctgacaggacccatccaagtgatacatctcgccaaagcctgctgtgacgtgaagggagggaagaatgaattatcttttaagcaaggcgaacagatcgagatcatacggatcacagataatcccgaaggcaagtggcttgggaggaccgccaggggctcctatggttatattaagaccaccgccgtggagatcgattatgactcattgaagttgaagaaagacagtcttggagctccaagtcgccctatcgaggatgatcaggaggtgtatgacgacgtggcagagcaggacgatatttcgtcccatagccagtccggctctggaggaattttccctccaccgccagacgacgatatatacgacggcattgaggaagaggatgccgacgacgggagtaccctccaggttcaagagaaatcaaatacatggagttggggaatcctgaagatgctgaagggaaaggacgatcggaagaaaagtatccgggaaaagccaaaagtgtctgactcggataacaatgaaggatcttcatttcctgctccacccaagcagttggatatgggcgacgaggtgtacgatgacgtagatacgtcggatttccccgtgtcttctgccgagatgtcccagggcactaacgtggggaaagcaaaaacagaagagaaagatctcaagaagctgaagaaacaggagaaagaagaaaaggactttcgtaagaagtttaagtacgacggcgagattcgagtcctgtactcaactaaagtcacaacgtcaatcacaagcaaaaagtgggggacaagggacctccaggttaagccaggagagtcactagaggttattcagacgactgacgatacgaaagttttgtgccgtaacgaggagggaaagtacggttatgtcctgagatcttatcttgctgacaatgatggggagatttacgacgacattgctgacggatgtatctatgataacgactag

SEQ ID NO: 30956 - DNA, 795 bp, Artificial Sequence
  Description of Artificial Sequence: Synthetic coding sequence
atgcccgactccgcacctgccatggctgacaaaatggacatgtcattggacgacatcattaagcttaacaggtcccagcggggaggaaggggaggcggacgcggaaggggcagggcaggtagtcagggtggcaggggcggaggcgctcaggccgcagcaagggttaacaggggcggtggccctatccgcaatcggcctgctatagcccgaggcgcagctgggggaggcggaaggaacaggccagccccttattcccggccaaaacagcttcccgacaaatggcaacacgacctctttgacagcggctttggcggtggagcaggcgtcgagaccgggggaaagctcttggtttcgaatcttgattttggggtgtcagacgccgacatccaggaactgttcgctgagtttggcacactgaagaaggccgctgttcattatgatcggtctggacggagcctgggcacagccgacgtgcacttcgagaggaaggctgatgcactcaaggccatgaagcagtataacggggtgccgctcgatggcagacccatgaatattcagctcgttaccagccagatcgacgcgcaaagaagacctgctcagagcgttaatcggggaggcatgacccgcaatcgcggtgccggaggcttcggtggaggcggaggaactcgtcgtggcacccgagggggagccagaggaagaggcagaggagctggtcgcaactccaaacagcaattgtctgcggaggagctcgacgcccaacttgacgcgtataatgcacggatggacacctcttag

SEQ ID NO: 30957 - DNA, 312 bp, Artificial Sequence
  Description of Artificial Sequence: Synthetic coding sequence
atggccaagcatggcgcagacgagccatcaagcagatcaggcagccccgatcgcgaaggcagagcgagtgaagacaggagtctccttcaccagcgcctcgccgtgcgcgaactgatcgacaccgaggtttcgtacctgcacatgctgcagctgtgcgcgagcgatattaggtcccggctgcaacaactgccacagggggatttggacgtgttattctcaaacatcgacgatatcatcaaggtcaatagcaggttcctccacgacctgcaggaaactgcctctaaagaagaggaacaggtccagttggtgtag

SEQ ID NO: 30958 - DNA, 639 bp, Artificial Sequence
  Description of Artificial Sequence: Synthetic coding sequence
atgatgctaggcaccgaaggcggagagggatttgtcgtcaaagtcagaggcctaccatggtcatgttcagccgacgaggttcagcggtttttctccgactgtaaaatccagaacggtgcgcagggtattcgcttcatctacacgcgcgagggccgaccttccggcgaagcatttgtagagctagagagcgaggatgaggtgaaacttgcgctcaaaaaggaccgcgagacaatgggccatagatatgtggaagtgttcaaatccaacaacgtggaaatggactgggtgcttaaacacaccggcccaaattcaccggacactgctaacgatggctttgtccgactccggggactgccattcgggtgctccaaggaggagattgtgcagtttttttctggcctggaaatagtccctaacggtattacattaccagtggacttccagggaagatctacgggagaggccttcgtccagttcgcctctcaggagattgcagagaaggcccttaagaagcataaagagcgaataggacaccgctatattgaaattttcaaatcatccagagctgaggttcggacccattacgaccccccacggaagctgatggctatgcaacgtcctggcccatacgacaggtag

SEQ ID NO: 30959 - DNA, 1020 bp, Artificial Sequence
  Description of Artificial Sequence: Synthetic coding sequence
atgtggacagcacggggaccattccggagagaccggtggtcctccgaggacgaggaggccgctggcccttcccaagccctttcccctttactatccgatacaagaaaaattgtgtccgagggagagcttgaccagctggcacaaattaggcctctcatctttaactttcacgaacaaaccgcaataaaggactgtcttaaaatactcgaggaaaaaaccgccgcttacgacattatgcaggaatttatggcactcgaattgaaaaacctgccaggagagtttaattccgggaaccagccttctaacagagagaaaaatcggtaccgggatattctcccttatgacagtacccgtgtgcctctggggaaaagcaaagattacattaacgcttcttacatacgaatcgtgaactgtggagaggagtatttttatatcgccacccagggacccctcctgtcaactattgacgacttttggcagatggttttggaaaataattctaatgtgatcgccatgatcactcgagaaatcgaaggcggaattatcaagtgttaccactattggcctatttctctaaagaagcctctcgagctgaagcactttagagtgttcctcgagaactaccagattctgcagtacttcattatccgcatgtttcaagttgtagaaaaatctaccgggacatcacactccgtaaagcagctgcagtttactaagtggcctgaccacggcacccctgcctctgcagatagcttcatcaaatacattaggtatgcaagaaagagccaccttacaggaccaatggtcgtccattgcagcgccggaattggacggaccggggtattcctgtgcgtggacgtggtgttctgcgcgatcgtaaagaattgtagcttcaacattatggatatcgtggcccaaatgcgcgaacagcgtagcggcatggttcaaactaaagaacagtaccatttttgttatgatatcgtgctggaagtattgagaaaactgttgactttggattag

SEQ ID NO: 30960 - DNA, 3213 bp, Artificial Sequence
  Description of Artificial Sequence: Synthetic coding sequence
atggcaggggcactccgacggggacgcgcactagggagtcgacccagcggtcctactgtgagctcacgacgtagtccccagtgcccagtggctcaggaggggctgggagcacgcagccgaccacgcgtggctcctcggtccttggctcgctgcggcccatctagccgactgatgggctggaagccttccgaagctagaggtcagagccagagctttcaggctagcggacttcagcctagatctctcaaagctgctcgacgggctacgggcagacctgatcggagtcgggcagctcgcccaaccatggacccatccgctcatcgctctcgcgctgcacctccaaatatggatcccgatcctcaggccggagtccaggtgggtatgcgggtggtgcgtggagttgactggaaatggggccagcaggacggcggagaaggtggcgttgggaccgtggtcgagctcggccgacatggcagccctagcactccggacaggaccgtcgtggtgcagtgggaccaaggaacccgtacaaattaccgggctggctaccagggcgctcatgacctgctgctgtacgacaacgcacagattggcgtgagacaccctaacatcatctgcgactgctgcaagaaacacggtctaagaggcatgaggtggaagtgccgagtctgcttggattatgatctgtgcacccaatgttatatgcacaataagcatgagctggcccatgctttcgaccggtacgagacggcacactcccggcctgtgactttatcacctaggcagggcctgcccaggataccactgagaggtatcttccagggggcaaaggtggtccgagggccagactgggaatggggcagccaggatggtggggaagggaaaccaggacgcgtggtcgacatccgcggatgggatgtggagacaggacggtctgtggcttcggtgacttgggccgatggtaccaccaacgtctacagagtggggcacaagggcaaagtcgacttgaaatgtgtgggcgaagccgctggtggcttttactataaagaccacctgcctagactgggcaagcctgctgagctgcagcgtagggtcagcgcagactctcagccgtttcaacatggagacaaggtgaaatgtttattggacactgatgtgctccgagaaatgcaggaagggcatggtgggtggaatcctagaatggctgagttcattgggcagacgggtaccgtacacagaattactgataggggcgatgtccgggtgcagtttaaccacgagactcgctggacatttcatcccggtgctctgacaaagcatcactcgttctgggtaggcgacgtcgtgcgggtgatcggcgacctcgacaccgtgaaacggctgcaggcagggcatggtgagtggaccgacgatatggcacccgctttaggacgcgtgggcaaggtcgtgaaggtgtttggggacggcaatctccgcgtcgcagtcgcgggtcagcgctggacattcagccctagctgcctagtagcctatcggccagaagaggacgcaaatctggacgtggccgagagggcgcgtgaaaacaaatccagtctctccgtcgccctggacaagttaagagcccaaaaaagcgaccctgagcaccctgggcgactggtggtggaagtggcgctgggtaatgctgcaagagccctggatctgctgaggcgtcggcctgagcaggtcgataccaaaaaccagggacggactgctctacaggtggcagcctatttaggtcaggtcgaacttattagactgctcctccaggcgagagcaggcgtggatctgccggacgatgaaggaaataccgctttacactacgccgcactgggtaatcagcccgaggctacacgagtcctgctgagcgccggatgtcgagccgacgctatcaatagcactcagtcaactgccctccacgtggcagtacagcgtggattccttgaagttgtgcgtgccttgtgcgagcgcggatgtgatgttaaccttcccgacgctcactcggacaccccccttcacagcgccatctccgctggcacaggagcaagtgggatcgtagaagtgttaactgaagtcccaaatatcgacgttacagccacgaactcccagggattcacacttctgcaccatgctagcctgaagggccacgcgctggccgtcagaaagatcctggcccgagctcgccagctggtcgatgcgaaaaaggaggatggttttaccgcactgcatcttgccgcactgaataatcacagagaggtagctcagatcctgattcgtgaagggaggtgcgacgttaacgtgagaaaccggaagctgcagagccctcttcacctggctgttcagcaggcccacgttggcctggtaccactgctggtggatgccggttgcagtgtcaacgcagaagatgaggagggtgataccgccctgcacgtggcccttcagcgccatcagctgctaccactggtggctgacggagctgggggagacccgggacctttacagctactcagccgtctacaggcgtccgggctgcctggctccgctgaactcacagtaggtgccgcagttgcttgctttttggccctagaaggcgctgatgtgagttacacaaatcacagggggaggtcacccctggatttagctgcggaaggtcgcgtcctgaaggcgcttcaggggtgcgctcagagatttagggagagacaggccggaggcggagccgctcctggacctaggcagacgctcggtactcccaacacggtgacgaacttacatgtaggagctgcccctggtcctgaggcagcagagtgccttgtctgttctgagctcgccctgctcgtcctattttctccatgtcagcacaggacagtctgtgaggaatgtgctcgacgcatgaagaagtgtatcagatgccaagtggtagtgtccaaaaaattgaggccagatgggagcgaggtggcttctgcagcgcctgcccctggccctccacgccagctcgtcgaggagctgcagagccgctaccgccagatggaggaacgtattacatgccctatttgtattgactctcacatccgcctcgtgtttcagtgtggtcatggtgcatgcgcgccatgcggttcagcactgagcgcctgcccgatctgtcgacagccaatcagagaccggattcagattttcgtttag

SEQ ID NO: 30961 - DNA, 957 bp, Artificial Sequence
  Description of Artificial Sequence: Synthetic coding sequence
atgtgcagaactgcccttggggttaccactctccaggacctgggcgtgtgctggcgcaaagagcacgatccagccgagatgctgcgcgtcgggagagctgagcttggcggatggaagcctagctgggaagccattgttaaggaagtcgctgccgctactggacacactgtcgtgctggtggaccagaccgaggatatactggccaagtctaaaaaaggtatcgaagagagcctccgcaaggtggctaagaaaaaattcgccgagaatctgaaggcgggagacgaatttgtggagaagacgctgagtacaattgctacttctaccgacgctgctagtgttgtccactctaccgacttggtggtggaagctattgtggagaacctgaaggttaagaacgagcttttcaaacggctggacaaatttgctgccgagcacacaatatttgctagcaacacaagtagcctgcagattacgtctatagccaacgcgactacgaggcaggatcgcttcgcaggcttgcatttctttaacccagttcccgtgatgaagctggtggaggtgattaaaacccctatgacgagccagaagacgttcgaaagtttggtggacttctccaaggcattagggaagcatccagttagctgtaaggacaccccaggctttatcgtcaaccgcctgttagtgccctacttgatggaggccattaggctttatgagcggggagacgccagcaaagaagacatagacacggccatgaagctgggggctgggtaccctatggggccatttgagcttctggattacgtcgggctcgacactactaagttcattgtcgacggatggcacgaaatggacgccgaaaaccccctgcaccaaccttcccccagtctgaacaaactggttgctgagaataagttcggaaagaagactggagaaggtttttacaagtataagtag

SEQ ID NO: 30962 - DNA, 1044 bp, Artificial Sequence
  Description of Artificial Sequence: Synthetic coding sequence
atgaaactgacctcagaaaagctgcccaagaatcctttttatgcctcagtgagccaatacgcagcaaaaaatcagaaattcttccagtggaagaaggaaaagaccgattacactcacgcgaatttggtggataaggccttgcagctccttaaggagcgcatccttaaaggcgacaccctcgcatacttcctgagagggcagctgtactttgaggaaggatggtatgaagaggccctggaacaatttgaagagatcaaggaaaaagaccatcaggctacataccaattgggcgttatgtactatgatggcctgggaacaaccctcgatgctgagaaaggtgtggactacatgaagaagattctagacagtccttgcccgaaggcaagacacctcaaattcgcggcagcctataacctcggtagagcatattatgagggtaaaggagtcaagaggagcaacgaagaggccgaacggctctggctgattgccgctgataacgggaacccgaaggcttcagtgaaagctcaatccatgctgggcctctattatagcacgaaggagcccaaagaactcgagaaggccttttactggcacagcgaggcctgcggaaatgggaacctggagtctcagggagccctcgggctgatgtatctgtacggccaaggaatacggcaggatacagaggcagccctgcagtgcttgcgcgaagctgctgagaggggaaatgtgtatgcacagggcaatctagtggaatattattataagatgaaatttttcaccaagtgtgtagcatttagcaagcgaattgcggactacgatgaagtgcatgatatcccaatgatcgcccaagtaacagactgtttgccagaatttatcggaaggggcatggccatggctagcttttaccatgctcggtgtttgcagctgggtctgggcatcaccagggacgaaaccacagccaaacactactatagtaaggcttgccgcctgaacccggctcttgccgacgagttacattcgttgctgattagacagagaatttag

SEQ ID NO: 30963 - DNA, 108 bp, Artificial Sequence
  Description of Artificial Sequence: Synthetic coding sequence
atgccccaaaccttctctggcggtcgcggatttgagttggatagtggaagcgacgacatggacccgggaagaccacgcccacctcgagaccctgatgaactccactag

SEQ ID NO: 30964 - DNA, 1179 bp, Artificial Sequence
  Description of Artificial Sequence: Synthetic coding sequence
atggggacaacctgcctgcatctgggaacgctagagcaatccctggtgttcgagaacaaggtgaatagtgagaaggttaagctctcactgcgcaactttccccataacgactatgaggacgtcttcgaggaacctagcgagtccggcagcgatccctcaatgtggactgccagaggaccctttcggagggaccgctggtcaagcgaagacgaggaggcggcaggcccatcccaagctctcagccctctactgtccgacactcgaaaaatagtctctgagggtgagctcgaccagttagctcagatccgcccacttatctttaattttcacgaacagacagcaataaaggactgcttaaagatcttggaagagaagaccgccgcatacgacattatgcaggagttcatggcactggagctgaagaatctcccaggagagttcaactcaggcaaccaaccgtcaaaccgggaaaagaatagatatcgtgacatactgccctatgactccacaagggtccctctgggcaaaagcaaggattacatcaatgccagttacataagaattgtgaactgcggggaagaatatttctatatcgccacccagggtccccttctatcaacgattgatgatttttggcagatggtcctggagaacaacagtaatgttatcgccatgatcacaagggagatcgaaggaggaataattaaatgttaccactactggcctatatctctgaagaaacccctagaactcaagcacttccgcgtgtttctcgagaactaccagattctgcaatatttcatcattaggatgttccaggtggtggagaaatccaccggcacgagccactctgtgaagcagttacagttcaccaaatggccggatcatggtactcctgcatcagcagattcctttatcaagtacatccgatatgcacgcaagtcgcacttgaccggaccgatggtcgtccactgctcagccggaataggccgtactggcgtctttctgtgtgtggacgtggtgttttgcgcaatcgtcaagaattgctccttcaacataatggacatagttgcacagatgcgcgagcagcggtcgggaatggtccagacgaaggaacagtatcatttctgttacgacattgtgctggaggtactccggaaactgctgaccctcgattag

SEQ ID NO: 30965 - DNA, 2052 bp, Artificial Sequence
  Description of Artificial Sequence: Synthetic coding sequence
atgaacaccagtattccttaccagcagaacccgtataaccccaggggatcatccaatgtcatccagtgttacaggtgcggcgatacgtgcaagggagaggtcgtgagggtgcacaacaaccactttcacatccgctgcttcacttgtcaggtgtgtggctgcggcctcgcccagtccggcttctttttcaagaatcaagaatacatttgtactcaagattaccagcaactttacgggaccaggtgcgactcttgtcgagacttcataacgggtgaggtgattagcgctcttgggaggacatatcatcctaagtgttttgtttgttcgctgtgtaggaaaccctttcccataggagacaaggtgaccttttctggcaaagagtgtgtgtgtcagacatgtagccaaagcatggcatccagtaaaccgataaaaattcgcggtccaagtcactgcgctggctgcaaggaagaaatcaagcatggacaaagcctcctggcactggacaaacagtggcatgtgagctgttttaagtgccagacttgttcagtgatcctaacaggagagtatatcagcaaggacggagtgccctactgcgagtctgattaccacgctcagttcgggataaaatgtgaaacctgtgaccgctatatctccggacgggtgttggaggctggcggtaaacactaccaccccacctgtgctaggtgcgtgcgatgtcatcagatgtttaccgaaggggaggagatgtatcttaccggatccgaggtgtggcatcccatctgtaaacaagcggctagagctgagaaaaagctcaagcataggcggactagcgaaacttccatctctcctcctgggagttccatcggctcgcctaatcgagtcatatgtgcaaaggtggacaatgagattctaaattataaggacttggccgctctgcctaaggtaaagtcaatctacgaggtacagaggccagacctgatctcatacgaaccccatagccggtatatgtccgatgaaatgctggaacggtgcggatacggagaatctcttggcaccttaagcccttactcccaggacatttacgaaaacctggacctgcgccaacgaagggccagctcccctggctatatcgattcccctacctattctcgccaagggatgagcccaaccttcagccgatctcctcatcattattatagaagcggccctgaatccggccgaagctccccttatcattcacagttggacgtacggtcctctacaccaacatcttaccaggcacccaaacatttccatatccccgcaggggattccaacatctaccgcaaacccccaatctacaagcgccatggagatttaagcactgcaaccaaatctaaaactagcgaggacatttcacagaccagcaagtatagtccaatctattcccccgacccctactacgcatcggaatccgagtattggacgtatcacggtagtcccaaagttcccagggctcggaggttcagctcaggaggcgaggaagatgactttgatagatcaatgcataagcttcagtctggaattggtaggctgatcctgaaagaggagatgaaggcgagatcatctagctacgcagacccctggacccctccccgaagcagcacttcatcacgcgaggccctgcatacagccggatacgaaatgtctctgaatggcagcccgcgaagccactacctcgctgatagcgaccccctgatcagcaagagcgcgtccttgcccgcatataggaggaatgggcttcacaggactcctagtgccgatttgtttcattacgactcaatgaatgcagtgaattgggggatgcgagaatacaagatctacccttacgaactgctcttggtgacaactcggggtagaaaccgacttcccaaagacgtcgaccgcacacgtttggagcgtcatttgtcccaggaagagttttatcaggtctttgggatgactatcagtgaattcgacaggctggctctctggaaacggaatgagctcaaaaagcaggcccgtctgttctag

SEQ ID NO: 30966 - DNA, 99 bp, Artificial Sequence
  Description of Artificial Sequence: Synthetic coding sequence
atggattttttcagcagccaccttttggccgactcttctagccccgctaccaacagcagccacaccgacgcacatgaaattctggttagcgatttttag

SEQ ID NO: 30967 - DNA, 858 bp, Artificial Sequence
  Description of Artificial Sequence: Synthetic coding sequence
atgtcggaagccggtgaggagcaaccaatggaaacgaccggggcaacagaaaacggccatgaggcagttcctgagggcgaaagccctgccggagctggtacaggcgcagccgcaggtgcaggaggagctaccgccgcacccccttcgggaaatcagaatggcgctgagggagatcagataaatgcctcaaagaacgaggaggacgccggaaaaatgttcgtggggggattgagttgggatacctcaaagaaagatctgaaagactattttacaaagttcggtgaggttgtggattgtaccatcaagatggatcctaatacggggagatccagggggttcggatttatcctgttcaaggacgccgcaagcgtggaaaaggtcctggatcaaaaggaacacagactggatgggcgagtcatcgaccctaaaaaggccatggccatgaagaaggacccagtgaagaagatttttgtcggaggactgaatccagaggctaccgaggagaagatacgggagtactttggggagttcggcgagatcgaagcgatagagctccccatggatccgaagctgaataagcggcgaggatttgtgtttataacctttaaagaagaggagcccgtaaagaaagtgctggagaagaagttccatacggtctctggctcaaagtgcgagattaaggtcgcccagcccaaggaggtctaccagcagcagcagtacggctccggcggacggggaaatcggaataggggaaatagggggtccgggggaggtgggggtggaggaggccagggttcgactaattacggcaaatcccagcggagaggtggacaccagaacaactataaaccttattag

SEQ ID NO: 30968 - DNA, 354 bp, Artificial Sequence
  Description of Artificial Sequence: Synthetic coding sequence
atggtgcaacgcctcacttacagaaggcgcttatcatataataccgcatccaataaaacaaggctctcacgcactccagggaacaggattgtctacctttacaccaaaaaagttggcaaggcccctaaaagcgcatgcggagtatgcccaggcaggctcagaggcgttcgtgccgtcagacctaaggtgctgatgaggctttctaaaaccaaaaaacatgtctcgcgagcttacggaggctcaatgtgcgctaagtgtgtacgagaccgtatcaagcgagccttcctgatcgaggagcaaaaaatcgtggtgaaggtcctgaaagcgcaagctcagagccaaaaggctaagtag

SEQ ID NO: 30969 - DNA, 7613 bp, Artificial Sequence
  Description of Artificial Sequence: Synthetic coding sequence
atggaagacttccggggtattgcagaagagtccttcccaagttttctgacaaacagcctgtttggaaactctgggatcctggagaatgtaactctgagttctaatttgggcctccccgttgcggtttccacccttgccagagataggtccagcaccgacaacagatatcccgatattcaagctagttatctggtagaagggagattcagcgtgccgtcaggaagttctcctgggagtcagtcggatgcagagccccgtgagagacttcagctttcctttcaggatgacgactcaatatcaaggaagaaaagctacgtcgaatcgcagcgactgtctaatgcattgagcaagcaatccgccctgcaaatggagacagccggacccgaggaagaaccagccggtgctacagaaagcctgcaaggccaggacctgtttaacagggctagccctctggaacaggctcaggacagcccaatcgatttccacttgcagagctggatgaacaataaagagcctaagattgtggtcctcgacgccggtaaacattttgaggataaaactctgaagtccgatttaagtcacacgagcctgctggagaacgaaaaacttatcctgcccactagtctggaagacagctcagacgacgacattgacgatgagatgttttatgatgatcatttggaggcctatttcgagcagctggcgatccccggtatgatatacgaagacctcgagggccctgagcccccagagaaagggttcaagctacctaccaatggactgagacaggcaaacgagaacggaagccttaattgcaaatttcagtccgagaacaatagctcactgatctccctcgacagtcattccagcgagacaacacacaaggagagcgaagaatcccaggttatctgtctgcctgggacatccaactctatcggtactggggattcacgccgttacaccgacggcatgcttcctttctcctccggcacctggggtaccgaaaaggagatcgagaatctcaaaggcatcgtgccagacctaaacagcgagtgtgcgagcaaggacgtgctggtcaagactcttagagcgatcgacgtgaagctcaactcagataatttccacgacgctaacgccaacaggggtgggttcgacttgaccgatcccgtcaaacagggggcagagtgcccgcaccagaacaaaaccgtcctgcatatggacggatgcttggataccgaaactcccacagtgtccatccaggagaatgttgacgtcgcctcactgaaacccatatcggacagtgggattaactttaccgatgctatatggagccccacctgcgagaggaggacatgcgaatgccacgaatctatagagaaaaataaagacaaaactgatctccctcagtctgtggtttatcaaaatgaagaaggaagatgggttacagacctagcgtattacaccagttttaacagcaagcagaacttgaatgtgtccctgagtgacgaaatgaacgaggactttcggagtggctccgaagccttcgacttgatcgcccaagacgaggaggaattcaacaaggagcaccagtttatacaggaggagaacatcgacgcccacaatacttcagtggcattaggcgatacgtcctggggggctactattaattactccctcctgagaaagtcccggtcaacttctgacttggacaaagacgacgcctcttatctgcgactgtcattgggagagttttttgcacagaggtcagaagccctgggatgtctgggcggtggcaataatgtgaagcggccttctttcggatactttattaggagcccggagaaacgcgagccaatagcattgattcgaaaaagcgatgtgtcgcggggaaaccttgaaaaggagatggcccatctgaaccacgacctgtacagcggagacttgaacgagcagagccaggcccagctgtccgaaggaagcatcactttgcaggttgaggctgtagagtccacctcacaagtagacgaaaatgacgtgaccctcactgctgataaaggcaagaccgaggacacattcttcatgtccaacaagccccaaagatacaaggataagctgcccgattccggcgacagcatgttaagaatctccactatcgcctccgctatagccgaggcgagtgtcaatacagacccctcacagctcgccgcaatgatcaaggcactgtcaaataagacaagagacaagactttccaggaggatgagaagcagaaagactatagtcatgtccgccatttcctgccgaatgatctggagaagtctaacgggtccaacgccttggatatggaaaagtaccttaagaagacagaagtgtctaggtatgagtcagcccttgagaattttagccgagcaagcatgtcggatacatgggacctgagcctgcccaaggagcaaacaacacaagatatacaccctgtcgatctcagtgctactagcgtttccgtgcgagccccagaggagaacactgctgccatcgtctacgtcgagaacggcgaatctgaaaaccaggaaagctttagaactatcaacagttcaaactcagttactaatagggaaaacaactcagccgtcgtcgacgttaaaacatgcagtatcgataataagttgcaggacgttggcaatgatgagaaagccacctcgataagcaccccctcggatagctacagctctgtgcgtaaccccagaattaccagtctttgcctgctgaaggattgtgaggagattcgggacaaccgagagaaccagagacagaatgagtgcgtgtccgagatctccaactcagaaaaacatgtgacctttgagaatcacagaatagtcagccctaagaattctgacttgaaaaatacaagcccggagcacgggggacggggatccgaggatgagcaggaaagttttcgcccttctaccagccctttgtctcatagttctccttcagagattagcggcacctccagctcagggtgcgcgcttgagagcttcggaagtgccgcacagcagcagcaacccccttgcgagcaggagctcagtccacttgtttgcagtccagccggtgtgagtcgcttaacctatgtgtcagagcctgagagtagctacccaaccactgccaccgacgacgcactcgaggataggaaatccgatatcacctcggaactctccacgacgatcatacaaggatccccggctgccctcgaggagcgcgcaatggagaagctgagggagaaggtgcccttccaaaatcgtggcaaagggacattaagctccataattcagaataactctgatactcgtaaagctactgagactacttcgcttagctcaaagcccgaatacgtgaagccagattttaggtggtctaaagacccctccagcaagtcaggaaatctactcgagacttcggaggtcggctggacgagcaaccctgaagaactagatccgatcagactggccctgttagggaagagcggcctgagctgccaggtcggaagcgccacatctcatcctgtgtcatgtcaggaacccatcgacgaagaccagcgaatctctccaaaagacaaatcaacagccggacgcgaatttagtggccaggtatcccatcagacaacttccgaaaaccagtgtacaccgatcccttcttccaccgtgcactcctccgtcgccgacatgcagaatatgcctgctgccgtgcacgccctcctgacccagccctcactctcggcggcaccgttcgcccagcggtatttggggacacttcctagcactggctcaaccaccctacctcagtgtcatgccggtaacgctaccgtgtgtggcttctcgggaggtctgccatacccagcagtcgctggggaacctgtccaaaattccgtagcagttgggatctgtttgggaagcaatatcgggagtggctggatgggcacaagtagcctgtgtaatccctactccaacacgctgaatcaaaacctgctttccactactaagccctttcctgtgcccagcgtcggcacgaattgcgggattgaaccctgggattccggggttacaagcggcctcggctcagtgcgagtccccgaggaactcaaacttcctcacgcttgctgtgtgggaatcgcttcacagactctactatctgtactgaatcccactgataggtggctccaggtgtcaattggtgttctcagcatttccgtgaacggcgagaaggtagacctgagtacataccggtgtctagtcttcaagaacaaagcgataattcgacctcacgcaaccgaagaaattaaggtgcttttcattccctccagcccaggagtgtttaggtgcacgttctcagttgcttcttggccctgctcaacagatgctgaaacaatagttcaggccgaggcgctcgctagtacagtcaccctaactgccatcgcagaatctcccgtgatcgaggtagaaaccgaaaagaaagacgttctcgattttggtgatctgacctatggcggatggaaagctcttccactgaaactaattaaccggacccacgctaccgttcccatccggctgatcattaacgcaaatgcagtggcatggcgctgctttacattctccaaagagagtgtgcgagcgccagtggaggtcgcaccctgcgccgatgtggtcaccagactggctggaccaagcgtggtcaatcacatgatgccagcatcctatgatggccaagatccagaattcctcatgatctgggtcttgtttcacagtcctaagaaacagatctcaagcagtgatatcctggattcggcggaagaattctccgccaaggtggacattgaagtcgacagtcctaaccccacacccgtcctaaggagcgttagcctgagggccagagctggcattgcccgtatccatgcaccacgtgatctgcagacaatgcatttcctggcaaaggttgcttcaagcagaaagcagcatcttcccctcaagaacgcaggcaacattgaagtttacctggacatcaaggtaccagagcagggctcacatttcagcgttgatcccaaaaacctgctactcaaaccgggtgaggagcatgaggtgattgtatcatttacccctaaggaccctgaagcatgcgaggaacggatactaaagattttcgtccaaccgtttggacctcagtacgaagtcgtattgaagggcgaagttatctcatcgggctcgaaacccctttctcctggtccctgtcttgacatccccagtatcctttccaataaacaatttctggcttggggaggtgtgcctctaggtagaacacaattacagaagttggccttaaggaacaattccgcctcgaccacccagcacctgcgactgttgatccgtggccaggaccaagactgcttccaactacaaaacaccttcggttcagagcagcgactgacctccaactgtgagattcggattcatcccaaggaagatatctttatcagtgtcctgtttgctccaacgagacttagctgcatgctcgcccgactggaaatcaaacagctgggaaaccgcagtcagcctggaattaaattcacgatccccctctccggatacgggggtacaagcaacctgattctggagggcgtcaagaagttgtccgattcttacatggtgaccgtcaacggcctagtcccgggtaaggagtcaaagattgtattttctgtcaggaataccggatcgagagccgcattcgtaaaagcagtgggtttcaaggatagccagaagaaagttctgctcgaccccaaggtccttcggattttccctgataaattcgtgctgaaggaaaggacgcaagaaaacgtgaccctaatttataatccgagtgaccggggaataaataataagactgccaccgaactgagtacagtctacctattcggaggcgacgaaatctcacggcagcagtaccggagagcgttactgcacaaaccagaaatgatcaaacaaatcttaccagagcacagcgttctgcagaacatcaacttcgtcgaagcgttccaggacgaactgctggttaccgaggtgtatgacctcccccaaagaccaaacgacgttcaactgttttacgggtccatgtgtaagattatcctcagcgtgattggcgaattcagagactgcatctccagcagagagttccttcagccaagcagtaaggcctccctggaaagcacaagcgatctgggagcttctggcaaacacggcggtaatgtgtccctggacgtgcttccagtgaagggcccacagggaagtccactgctatcacgagccgcacgacctccattggaccagctggcaagcgaggagccatggacagtacttcctgagcatctgatacttgtcgctccaagtccgtgcgatatggcgaagactggtcggttccagatcgtcaataactcagtccgcctcctcagatttgagctctgctggccagcacactgcctgaccgtgacaccacaacatgggtgcgtggcaccagagtccaagctgcagatcctggtgagtccaaattcgtccctttcgactaagcagtctatgttcccgtggagtggcctcatctacatccactgtgacgacgggcagaaaaagattgtgaaagtgcaaataagagaagacttgacccaagtggagttactaacaaggttgacttctaagccattcgggatattgagcccggtatccgaaccatctgtctcccacctggtgaaacctatgacgaagccaccatccaccaaggtggaaatacggaataagtctatcacattccccactaccgagcccggtgagaccagcgagtcttgcctggagctagagaatcatggaacaaccgacgtgaagtggcatctgtcatctctggcgccaccctatgttaaaggcgtggacgagagcggcgatgtgtttcgtgctacttacgccgcattcaggtgttctccaatttcgggactactggaaagccatggtattcaaaaagttagcatcacattccttcctcggggacgcggtgactacgcgcagttttgggatgtggagtgtcaccctctcaaagagccacacatgaagcacacgctgaggtttcagttgtctgggcaaagcattgaagccgaaaacgagccagagaacgcctgtctttctaccgactcactcatcaaaatagaccacttggtgaaacctaggagacaggctgtcagtgaagcctcagccagaatccctgaacagttagacgtcactgcacgcggtgtttatgctccagaggacgtgtacaggttcagacccacgtcagtcggtgagtctcgaactctgaaggtgaacctgcggaacaatagctttatcactcactctctgaagtttttgtctccacgcgagcctttttatgtcaaacattctaaatatagtctcagggcacagcactacatcaacatgcccgttcagttcaaacccaaatccgctggaaaattcgaggcccttctcgttatccaaacggacgaaggcaagtcaatcgccattcgcctgattggggaagccctgggtaagaacta

SEQ ID NO: 30970 - DNA, 90 bp, Artificial Sequence
  Description of Artificial Sequence: Synthetic coding sequence
atgctatgttgggggaacgcgagctttggacaactcggcttgggcggaatcgatgaggagatcgtattggaaccccgaaagtctgactag

SEQ ID NO: 30971 - DNA, 66 bp, Artificial Sequence
  Description of Artificial Sequence: Synthetic coding sequence
atggcgaaatacaatactggcggaaaccccaccgaggatgtctccgtcaactctaggcccttttag

SEQ ID NO: 30972 - DNA, 261 bp, Artificial Sequence
  Description of Artificial Sequence: Synthetic coding sequence
atggaggcagatattataacgaacctccggtgtcgtctcaaggaggctgaagaggaacgcctgaaagctgcccagtatggattacagttagttgagagccagaacgaactgcagaaccaactagacaaatgccggaatgaaatgatgactatgacggaatcctacgaacaagagaagtacacccttcagagggaagtggagcttaaatccaggatgctggagagtttaagctgcgagtgtgaggctattaagcagcaatag

SEQ ID NO: 30973 - DNA, 1983 bp, Artificial Sequence
  Description of Artificial Sequence: Synthetic coding sequence
atggtgacaagcctgaacgaagataatgagagtgtgactgtcgaatggatagaaaacggggacacaaaggggaaggagatagacctggaatcaattttctcgttgaaccccgacttagtacccgacgaagagattgaaccttcaccggagaccccaccaccgccagcatccagcgctaaggtgaacaaaattgtgaaaaaccgcaggacggtagcctccattaagaacgacccaccctcaagggataatcgggttgtgggatcagccagggccaggcccagccagttcccagagcaaagcagctcagcccagcaaaatgctcggaggaaaagtaactgcgtgaaagaggtagagaaactccaggaaaagagagagaaaagaagactccagcagcaggaactgcgagagaagcgagcacaagacgttgatgccacaaatccaaattacgaaatcatgtgcatgatccgggatttccgagggtcactcgattaccggcctctcactaccgcggacccaatcgacgaacataggatttgcgtttgtgtcaggaaacgccctcttaacaagaaggagactcaaatgaaggatctggacgtgatcacaattcctagtaaggacgtggtgatggtccatgagcccaaacaaaaggtggatctgaccaggtatctcgaaaatcaaacatttcgattcgattatgctttcgatgattctgctccaaacgagatggtgtaccgtttcacggctcgccctctagttgaaactatatttgagaggggcatggccacatgctttgcttatggtcagacgggttcagggaagacccacacaatgggcggtgatttctccggaaagaatcaagattgctccaaagggatttacgccctcgcagctagggatgtatttctgatgctgaaaaagcccaattacaagaagcttgaactacaggtgtatgccacattctttgagatttattcaggcaaagtcttcgacctgttaaacaggaaaaccaaattgcgcgttctggaagacggcaaacagcaggtccaggtggtgggtcttcaggaaagggaagtgaagtgcgtggaggacgtgctgaagctcattgacatcggtaattcgtgtcggacttctgggcaaacgagtgccaatgctcattcaagtaggtcccacgcggtgtttcagatcattctgaggaggaaaggcaagctgcacggaaagttcagcctgattgatctcgccggtaacgagcgtggggctgataccagctctgcggatagacagacgcggctggaaggagccgaaatcaacaagtccctgctggctcttaaggaatgtatcagagctctgggcaggaacaagccccacactccttttcgggcttcaaagctgacgcaggttttgcgcgatagctttattggtgagaacagccgcacctgcatgatagcgacaatttcaccagggatggctagttgtgaaaataccctgaatactctaaggtacgccaacagagtgaaggagctgaccgtcgatccaaccgccgctggcgatgtacgccctattatgcaccatcctcccaatcaaatagacgacctcgaaacacagtggggggtggggtcctcccctcagcgagacgatctgaaactgctctgtgaacaaaatgaagaagaggtgagtccgcaactttttactttccatgaggctgtctcacagatggtggagatggaggaacaggtggtggaggatcaccgcgctgtgttccaggagagcattcgatggttggaggacgagaaagctttgttagaaatgacggaggaagttgactacgatgtcgactcttatgccacgcagctcgaagccatcttggagcagaaaattgacatccttactgagctgagagacaaagtgaagtccttcagggccgcactgcaggaagaggagcaagcatcaaagcagatcaatcccaagcgaccccgagccctgtag

SEQ ID NO: 30974 - DNA, 207 bp, Artificial Sequence
  Description of Artificial Sequence: Synthetic coding sequence
atgtcctctcctagggacttcagggcagagcccgttaatgactacgagggaaatgatagtgaagccgaagatctgaattttagggaaacactgccctccagctctcaggaaaacacacctaggtcgaaagtctttgagaataaggttaatagcgagaaagtgaagctgtcccttagaaattttcctcacaatgattatgaggactag

SEQ ID NO: 30975 - DNA, 294 bp, Artificial Sequence
  Description of Artificial Sequence: Synthetic coding sequence
atgaacgggagggcagatttccgcgaacctaacgctgaggttccccgaccgattccccatatcggacctgattacatcccgaccgaagaagagagaagggtcttcgcagagtgcaatgacgagtcattttggtttcggagtgtgcctctggccgctacctccatgctgatcacacagggactgatctccaagggtattctgtcgtcccatcctaaatacggttcaattcccaagctcatactggcttgtatcatggggtatttcgctggtaagctctcatatgtcaaaacatag

SEQ ID NO: 30976 - DNA, 309 bp, Artificial Sequence
  Description of Artificial Sequence: Synthetic coding sequence
atggttatggagaagccctccccactgctcgtggggagggagtttgtgagacaatactatactctcttgaataaagccccagaatacctgcatcggttttacggcaggaattcatcctatgtgcacggaggcgtagatgccagtggcaagcctcaagaggccgtatatggccagaatgacatacatcataaagtgctgagcctgaattttagtgagtgccatacaaagataaggcatgtggatgcgcacgcaaccctgagcgacggcgttgtggtgcaggtcatgggcttgttgagtaattctggctag

SEQ ID NO: 30977 - DNA, 597 bp, Artificial Sequence
  Description of Artificial Sequence: Synthetic coding sequence
atggggactacctgcttgcacctggggaccttagaacagagcctcgtgtttgagaataaggtgaattctgagaaagtgaaactgtcactacgaaacttcccgcacaatgactatgaagacgtttttgaggagcccagcgagagtggcagcgacccttcaatgtggacggcccgaggcccattccgacgcgaccggtggtcatctgaagacgaggaggccgctggcccatcccaagccctatcacccctgttatctgacaccagaaagatagtaagcgagggagagttagatcagcttgcccagatccggccactcatctttaacttccacgagcagaccgccatcaaagattgtctgaaaatccttgaggaaaaaacggcggcttatgacataatgcaggagtttatggcactcgagcttaagaacctgcccggagagttcaacagcgggaaccagcctagtaaccgagaaaagaataggtatagagatatcctacccttccagcaccacggatactcaggacccaacgaacggaccactttctggcacgggtctaatgagggagccgtctctctgttgctgcgttactgtgcctag

SEQ ID NO: 30978 - DNA, 384 bp, Artificial Sequence
  Description of Artificial Sequence: Synthetic coding sequence
atgcggcctctggatatagtcgaacttgccgaacccgaagaagtggaagtgcttgagcccgaggaggactttgaacaattccttttgcctgtgattaacgaaatgcgcgaggacatagcctcactgactagagaacatggaagggcttacctcaggaatcggtcgaaattgtgggagatggacaatatgcttatccaaataaaaacacaggtcgaggcgtctgaggagagcgccttaaaccatctgcagaaccccggagacgctgccgagggccgagccgcaaaacgatgcgagaaagcggaagagaaggccaaggaaatcgccaaaatggctgaaatgctagtggagctggtgaggcgtatagaaaagtctgagtcatcctag

SEQ ID NO: 30979 - DNA, 426 bp, Artificial Sequence
  Description of Artificial Sequence: Synthetic coding sequence
atggtcatggaaaagccctcccccttgttagttgggagggagtttgtccggcaatactacacgctactcaacaaggctcctgagtatttacacaggttctatggtcgaaatagctcttacgtgcacggcggagttgatgccagcggcaaacctcaggaggcagtttatggacagaatgatattcaccataaggtgctctccctgaacttctctgagtgccacacgaaaattcgccacgtcgatgcacatgcgactctgtctgatggggtggtcgtccaggtcatgggcctgttgtccaacagcggccagcccgagcgcaagttcatgcagacctttgtgttggcgccagaaggctctgtacctaacaagttttatgtgcacaacgatatgtttaggtatgaggacgaagtctttggggactcctag

SEQ ID NO: 30980 - DNA, 135 bp, Artificial Sequence
  Description of Artificial Sequence: Synthetic coding sequence
atgctgctgcttgattgcaatccagaagtcgatgggctcaaacaccttctcgagaccggcgcatccgtcaatgcaccacctgatccatgcaaacagtcccccgtccatctggctgcgggatcagggctggcctag

SEQ ID NO: 30981 - DNA, 399 bp, Artificial Sequence
  Description of Artificial Sequence: Synthetic coding sequence
atgaagaggggtcgcctgccgtcctcaagcgaggattccgatgacaacggatctctgagcacgacctggagtcaaaatagccgatctcagcacaggagatccagctgctctcggcacgaggacagaaaaccctccgaggtcttccgcacggatttaatcactgccatgaaacttcacgacagctatcagctcaaccccgacgagtattatgtcctcgctgacccatggcgacaagagtgggaaaagggggtccaggtccccgtctctccaggaacaatccctcagcccgtggccagagtggtatccgaagagaagtccctgatgttcattcgcccaaagaagtatatagtatccagtgggtctgaacccccagagctgggctacgttgatattcgctag

SEQ ID NO: 30982 - DNA, 972 bp, Artificial Sequence
  Description of Artificial Sequence: Synthetic coding sequence
atgcgcactgctgatcgcgaagctcgtccaggactcccctcacttcttctgctcctcttggcaggagcgggtctgtccgccgctagtcctcccgctgctcctcgattcaatgtgtctctcgacagcgtaccagaattacgttggctccccgtgctaagacactacgatctcgatctggtcagagctgcaatggcccaagtcatcggtgacagggtccccaagtgggtgcatgtgttaattggaaaggtggtcctggagctagagcggtttctcccacaacccttcaccggcgagatcagggggatgtgcgattttatgaacctaagccttgccgattgtctcctagtgaacctcgcctatgaaagctcagttttctgcaccagcatagttgctcaggactctcggggtcacatctaccacggcagaaatctggactatccttttggtaatgtccttagaaagctcacagtggatgtacaattccttaaaaacggccagattgcattcaccggcacaaccttcatcgggtatgtaggcttgtggacaggacagagcccacataagttcacggtgtcaggcgatgaacgggataagggttggtggtgggagaacgcgattgccgctctgtttcgcagacatatacccgtttcttggcttatacgggcaaccctctcagagagcgagaatttcgaggccgctgtgggcaagttggctaagactcccttgatagctgatgtttattacattgtcggaggcacctcaccccgtgagggggtcgtcatcactagaaatcgggacggccctgcagatatctggccattggaccctcttaatggcgcttggttccgtgtcgagacgaactacgatcactggaaaccggcacctaaggaagacgacagacggacgtctgccatcaaagctttgaatgccaccggacaggccaatttgtcactcgaagcactgtttcaatag

SEQ ID NO: 30983 - DNA, 312 bp, Artificial Sequence
  Description of Artificial Sequence: Synthetic coding sequence
atggcccagacagataaacctacatgcatcccacctgagctcccaaagatgcttaaagaatttgcgaaggcagcaattagagcgcagcctcaggatctaatccagtggggcgctgattacttcgaggcactgagccgcggagagaccccacccgtgcgggagagaagcgaacgagttgcattatgcaattgggccgaattgacccctgaactcctgaaaatcctgcatagtcaggttgccggaaggctgatcatccgcgcagaagagctggcgcagatgtggaaggtggttaatctccctactgatctgtag

SEQ ID NO: 30984 - DNA, 540 bp, Artificial Sequence
  Description of Artificial Sequence: Synthetic coding sequence
atggaggatggaacacctaagcacattatccagatgacaggtttcaagatggaggagaaggaggccctggtaaagcttctgctgaagctggactgcactttcatcaaaagtgaaaagtacaagaattgtacacatctgattgctgagcggctgtgcaaaagcgagaaatttcttgcggcatgcgccgcaggaaagtggattctgactaaagactatattatccactcggccaaatcaggtagatggctcgacgagacgacatatgaatggggttacaagattgagaaggactcgaggtactcgccgcagatgcagagcgctcctaagcgctggagagaggagctgaaacggactggcgctcctggcgcatttcatcgctggaaagtggttttgctcgttcggacagataagagatcagacagcttgatacgcaaaaagtttcggatgatgaaaattccaaaaccaattctgtttggactcaatattgcaatgaagaagcaaacgaaaatctcagggaagatgcaggactttttaaagtag

SEQ ID NO: 30985 - DNA, 453 bp, Artificial Sequence
  Description of Artificial Sequence: Synthetic coding sequence
atggaggcagatattataacgaatcttaggtgccggctaaaggaagccgaagaagagaggcttaaggccgctcaatacggcctacaactcgtagaatcacagaatgagctccaaaatcaattggacaagtgcagaaatgagatgatgaccatgaccgagagttatgagcaggaaaagtatacactacagcgagaggtggaactcaagtctagaatgctggaatctctgagctgcgaatgtgaggccattaagcagcagcagaagatgcatctcgagaagctagaagaacagctctctcgaagccatggacaggaagtgaacgaactaaaaaccaagatcgagaagctcaaagtggagctggacgaggcacgcctgagcgaaaaacagctgaaacatcaggtcgatcatcagaaggagcttctttcatgtaagtctgaggaactacgagtctag

SEQ ID NO: 30986 - DNA, 738 bp, Artificial Sequence
  Description of Artificial Sequence: Synthetic coding sequence
atgaacggacgggcagattttagggagccaaacgctgaggtcccaagaccaatccctcatattggcccagactatattccgacagaggaggagaggagggttttcgcagagtgcaatgatgagtctttctggtttcgatccgtgcctctggctgctacttcaatgttgatcacccagggcctcatctccaagggaatccttagcagtcatcctaagtatggcagcattcccaagctgatactggcgtgtattatggggtactttgcaggcaagttgagctacgtgaagacttgccaggagaaatttaaaaagcttgaaaacagcccacttggggaggcactcaggtcagggcaggccaggcgaagctcccctcctgggcactactatcagaagtctaagtatgactcttctgtgtccggacagtcgtccttcgtaacttcgcctgccgcagacaatatcgaaatgctcccacactacgagccaattcccttctcaagctctatgaacgaaagcgcacctaccggcatcaccgaccacattgtgcaaggccctgacccaaatcttgaagagagtcctaagaggaagaacattacatatgaggagcttagaaataaaaatagggagtcgtatgaggttagcctcactcagaaaactgatccatctgtgaggccaatgcatgaaagagtgcccaaaaaagaagtcaaagtgaataaatatggcgacacttgggacgagtag

SEQ ID NO: 30987 - DNA, 180 bp, Artificial Sequence
  Description of Artificial Sequence: Synthetic coding sequence
atggtcatggagaaaccgtcgccgctgctggtggggagggagttcgtgaggcaatattacaccctgctgaacaaggctccggaatacctgcataggttttacggcaggaactcttcgtatgtgcacgggggagtggacgcgtctggaaaaccccaggaggcagtctatggtcagaattag

SEQ ID NO: 30988 - DNA, 597 bp, Artificial Sequence
  Description of Artificial Sequence: Synthetic coding sequence
atgggtacgacttgtctgcacttgggaactctagaacagtctttagtgttcgagaacaaggttaatagcgagaaggtgaagctgtcactccggaactttccccacaatgattacgaggacgtgtttgaggagccctcggaatcggggagtgatccgtctatgtggaccgccaggggtccatttcgcagagacaggtggagtagtgaggacgaggaggctgctgggccaagccaggctttgtcccctctcctgtcggacactcgcaagatcgtgtctgagggagaattggatcagctggcacagatcagacctctgatctttaatttccacgagcagacagctataaaggattgtctgaagattctcgaagagaagactgccgcttacgacataatgcaggagtttatggccctggagttgaagaaccttcccggagagttcaactccgggaatcagccatcgaatagagagaagaacagataccgggatatattacccttccagcatcacgggtactcaggcccaaatgaaagaaccacattttggcacggctctaatgaaggtgctgtgagcctcctgcttagatactgcgcgtag

SEQ ID NO: 30989 - DNA, 465 bp, Artificial Sequence
  Description of Artificial Sequence: Synthetic coding sequence
atggcatccgcttctgccaggggtaaccaagacaaagacgcccatttcccccctccgtccaaacagtctctgctcttttgcccaaagagcaaattgcatattcaccgagcggagatcagcaaaatcatgcgggagtgtcaggaggagtccttttggaagagagccctccccttcagtctggtgtcaatgctcgtgacccagggcctcgtctatcaaggttacctggccgcaaattccagatttggatccctgccgaaagtagctcttgccggtcttctcggcttcggcctcgggaaggttagctacattggcgtttgtcagtcaaagtttcatttcttcgaggaccagctgcgcggagcgggatttggtcctcagcacaatcggcactgtctgctcacatgcgaagaatgcaagatcaaacacggactttccgaaaaaggggacagtcagccttctgccagctag

SEQ ID NO: 30990 - DNA, 2520 bp, Artificial Sequence
  Description of Artificial Sequence: Synthetic coding sequence
atgagcgtggtgggaatcgatcttggttttctaaactgttacattgccgtagcacggagcgggggtatcgagactatcgccaatgaatactcagatagatgcacgcccgcatgcatatctctgggtagtcgcacaagggccatcggcaacgcggctaaatcccagatcgttactaacgtcagaaacacaattcatgggtttaagaagttgcatggtcgaagcttcgatgatcctatagtgcagacggaaaggattcggctgccgtacgagcttcagaaaatgccgaatggctcggctggtgtcaaggtacgttatctcgaggaagagcggcctttcgcaatcgaacaggtgacagggatgctcctcgctaagctcaaggagacttccgagaacgctctcaagaaacccgtcgccgactgtgtcatcagtattccaagtttctttacagatgccgagcgcagaagcgttatggctgcagcacaggtcgccggactcaactgcctgagactgatgaacgaaactacggcagtggctctggcctatgggatttacaaacaggatcttcctcccctggacgagaaaccacgcaacgtggtattcatcgacatggggcactctgcgtatcaggtgctggtgtgcgcattcaacaagggaaaactgaaggtgctggccaccacatttgatccttacctgggcggaaggaatttcgatgaggccctggtggactacttctgtgacgaatttaaaaccaagtataagataaatgtgaaagagaactctcgcgctctactgagattgtatcaggagtgcgagaagctcaagaaattgatgagtgcgaatgccagcgatctcccccttaacatcgaatgctttatgaacgacctggacgtgtcttccaaaatgaatagggcgcagtttgagcagttatgcgccagtttgctggctagagtagaaccacccttaaaggctgtgatggaacaggctaatctacagcgtgaggatattagctcaatagaaattgttggcggagcgactcgcatacctgccgtgaaagaacagataactaaattctttctgaaggatataagtacaacgctcaacgcagatgaggccgttgcacgaggttgcgcgctgcagtgtgcgatacttagtccagcttttaaagtacgagagttcagtatcactgatctggtgccctattccatcacccttcgctggaaaacatctttcgaagacggctctggggagtgtgaggtcttttgcaaaaatcaccccgcaccgtttagtaaagtaatcacttttcataaaaaagagcctttcgaattggaggccttctatactaacctccacgaggtcccttatcccgatgcccgaatcggctccttcactatacaaaatgtttttccccagtccgacggcgactccagcaaagttaaggtgaaggtgagagtgaacatccacggaattttttccgtggcgagcgcctccgtgatcgaaaagcagaacctggaaggtgaccactctgatgctcccatggaaaccgagacctccttcaaaaatgagaataaggataatatggacaagatgcaggtagaccaggaggaaggccaccagaaatgccacgcggaacacactccggaagaagaaatagatcatactggcgctaagaccaagtccgcagttagtgacaagcaggatcggttaaatcaaaccctcaagaaaggcaaggtgaagtccatcgacctacccatccagtcgtctttgtgtagacagctgggccaagacctgctgaactcatatatagaaaacgaaggcaaaatgattatgcaggacaagctggagaaggagcggaacgacgccaagaatgccgtggaggaatatgtgtacgattttagagaccggctgggtacagtctatgagaaattcattacccctgaggaccttagtaagctttccgccgtgctggaggatactgagaactggctttatgaagatggggaggaccagcccaagcaggtgtatgtcgataagctccaagagctgaagaaatacggccagccaattcagatgaaatatatggagcatgaggagcggcctaaagctctcaatgatctgggcaagaagatccagctggtgatgaaagtgatcgaggcgtatcgaaataaagacgaaagatacgatcatctggatcccaccgagatggaaaaggtcgagaaatgtatcagcgatgcaatgtcttggctgaattcaaagatgaatgcccagaacaaactaagtctaactcaagatcctgtagtgaaagtgagtgaaatagttgcaaagagtaaggagttagataacttctgtaatccaatcatctataaacctaagcctaaggccgaagtgcctgaagataagccaaaggccaactcggagcataacggccctatggacggccaatcagggactgagacgaaaagtgattctaccaaagattctagccagcacacaaagtcttcaggtgagatggaggtggattag

SEQ ID NO: 30991 - DNA, 54 bp, Artificial Sequence
  Description of Artificial Sequence: Synthetic coding sequence
atggacgaaggcatggagatttccagcgaggggaactcattgatcaaagcctag

SEQ ID NO: 30992 - DNA, 2394 bp, Artificial Sequence
  Description of Artificial Sequence: Synthetic coding sequence
atgggcgtaagtcgactgatggacctgttggcggactcgcgggaggtcatcaggaacgacggcgttctcttgctgcaggctctgactcgtagtaacggggcaatacagaagattgtggcatttgaaaatgcctttgaaaggctacttgacattatttctgaagagggcaatagcgacggaggcatcgtggtagaggactgtttgattttgctccagaacctgctaaaaaataacaactctaatcaaaacttcttcaaggagggctcgtatattcagcgcatgaagccttggtttgaggttggggatgagaattcaggatggagcgcacaaaaggttacaaacctccacctcatgctacagctggtgagagttctagtgtctccaacaaatccgcctggcgctacgtcgtcatgccagaaagcaatgtttcaatgtgggttgttgcagcagctgtgtactattttgatggcaacgggagttcccgctgacatcctgacagagactattaatacagtttctgaggtgatcagaggttgccaggtcaaccaggattacttcgcatcggtgaatgctccgtcaaaccctccacggcctgcgatcgttgtgctcttgatgtcaatggttaacgagcggcagccattcgtcttacgatgtgcagtgttgtattgctttcagtgctttctgtacaaaaaccagaaaggacaaggggaaatcgtgagcaccctgctcccatccacaatcgacgctactggaaatagcgttagcgccggtcagttactgtgcggcggactgttcagcactgatagtctaagtaattggtgcgctgccgtggccctggctcacgccctacaagagaacgcaacccagaaagaacagctgctgcgggttcagttagcaacctccatcggaaaccccccagtgtcattacttcagcagtgcactaacattctgagccaaggctcaaagatccagactagagtaggacttctaatgctcttgtgtacttggctgtccaattgccctatcgccgtcacacacttcctccacaattcggcgaatgtgccattcctgaccggtcagatcgccgagaacctgggcgaagaagagcaattggtgcaagggctgtgcgcattactactcgggatcagcatctattttaacgataatagtctggaaagttatatgaaggaaaaactgaagcagttgattgagaagcgcatcgggaaggagaatttcatcgagaaactgggtttcatttctaagcacgagctgtattcaagggctagtcagaaaccccagcctaacttcccctctccagagtatatgatctttgaccatgaatttacaaagttggtaaaagaactggaaggcgtaatcactaaagcgatttacaaatcatctgaagaggataaaaaggaagaagaggttaaaaaaaccctagagcagcatgacaacatagtcacacactacaagaatatgattcgagagcaggacctacagctagaggaactgaggcagcaagtgtcaacactgaagtgtcagaatgaacagctgcagactgccgtgacccagcaagtctcccagattcaacagcacaaagatcagtataatctcctcaaaattcagctgggtaaggataaccaacaccagggcagttatagtgaaggggctcagatgaatggtatccagcctgaagaaattggacgactgcgcgaagaaattgaagagctaaagcgaaatcaagaactgctccagtctcagttgaccgaaaaagattccatgatagaaaacatgaaaagttcccagacctcaggcacaaatgaacagtcctcggccatcgttagcgcaagagacagtgagcaggtggcagagctgaagcaagagctcgctacactgaaaagccaactgaactcgcaatctgtggagataacaaagctgcaaacagagaaacaggaactgctacagaaaacggaagctttcgccaagagtgtcgaagtccaaggtgagaccgagaccattattgcaactaagaccaccgacgtcgagggacggctgtccgccctcctccaggagacaaaggagcttaagaatgagattaaggcgctgagtgaagagcggaccgcgataaaagagcagctggacagctcaaacagcacaattgctatccttcaaacagagaaggataagctagagcttgaaattacagactcgaaaaaggagcaggacgatttgctggtgctgctcgcagaccaagaccagaagattctgagcttgaagaataaacttaaagatcttgggcaccccgtggaagaagaagacgagctggaatcgggggatcaagaagacgaggatgacgaaagcgaggatcccggaaaagacctggaccacatctag

SEQ ID NO: 30993 - DNA, 441 bp, Artificial Sequence
  Description of Artificial Sequence: Synthetic coding sequence
tgaaggcatctgagggctacacctaacactaggggaagtgcaagactcctgtgcgccgagatgcctaaaaaagctggagcaaccacgaaaggcaagtcacaatcaaaggaacctgagcgccctttgccaccccttggacccgtcgcagtcgaccctaaggggtgtgttaccattgcgatacatgcaaaacccggttccaagcagaatgccgtaacagatctcacagccgaggccgtcaacgtggcgatcgcagcaccaccaagcgagggcgaggccaacgccgaactgtgcaggtatctctcaaaagttttggagttacggaagtcggatgtggtgctggacaagaagcttagagacctgttaaagatcgtgccttgtaaactggcaacccgcactcagattctggggctgcttgtggagtgcagcttttctaggctttag

SEQ ID NO: 30994 - DNA, 243 bp, Artificial Sequence
  Description of Artificial Sequence: Synthetic coding sequence
atgaacggtcgagctgacttccgggagccaaacgccgaggtgccgagacccattccacacattggacctgattatattccaactgaggaggaacggagggtatttgccgaatgtaacgacgaaagcttctggttccgctctgtgccactcgctgccacttctatgttaattacccagggcctgatcagcaaaggcatcctgtctagccatcccaagtacggctctatccccaaactgatctag

SEQ ID NO: 30995 - DNA, 360 bp, Artificial Sequence
  Description of Artificial Sequence: Synthetic coding sequence
atgaaaaggggtcggttacctagctcaagtgaggattcggacgataacggctcgctatcaaccacttggtcgcagaactcccgtagccagcataggagatcatcctgttcacgacacgaagaccgtaaaccatccgaagtgtttagaaccgatttgatcaccgccatgaaactccacgactcctatcagctgaaccccgatgagtattacgttctagccgacccttggaggcaagagtgggagaaaggcgtacaggttcccgtcagccccggtacaatccctcagcctgtggcaagggtggtgtcagaggaaaagagccttatgtttatccggccaaagaagtacatcgtcagttcctag

SEQ ID NO: 30996 - DNA, 69 bp, Artificial Sequence
  Description of Artificial Sequence: Synthetic coding sequence
atggccaagtataacacagggggaaaccctactgaggacgtgtctgtgaactctagaccatttagatag

SEQ ID NO: 30997 - DNA, 1059 bp, Artificial Sequence
  Description of Artificial Sequence: Synthetic coding sequence
atggcagccgcagtgcggcaagatttagcccagcttatgaacagctctggaagtcacaaagatttggcgggtaagtaccgtcagatccttgaaaaagcaattcagctatctggtgccgaacagctagaggctttgaaggcgtttgtagaggctatggtaaacgaaaacgtctctctcgtgatttcaagacagctgctgactgatttttgcacacaccttcccaacttgccagactccacagccaaagagatctaccactttacactagagaaaatccagccacgcgtgattagcttcgaggagcaggtggcctctattaggcagcacctggcaagtatttacgaaaaggaagaagactggcggaatgcagctcaggtcctggtggggatccccctggaaacaggccagaaacagtacaacgtcgattacaagctagagacttacctaaagatcgcgcgattatatcttgaagacgacgacccagttcaagccgaggcttatattaatcgcgcttcattgcttcaaaatgagagcactaacgaacagctgcaaatccactacaaggtgtgttacgctcgcgtcctggactataggcgcaagttcattgaggcagcccagcgctacaacgaactgtcatataaaaccatagtgcacgaatccgagaggctggaagcactaaagcacgctcttcactgtactatccttgcgagtgctggtcagcagagaagccggatgctagccaccctgttcaaggacgagcgctgtcagcagctggccgcttacgggattctggagaagatgtacctggatagaatcattcgaggcaaccagctccaggaattcgcagcaatgcttatgcctcatcaaaaagcaaccaccgcagatggcagttctatccttgacagggccgtgattgaacacaacctgttgtcagccagcaagctgtataacaatatcacattcgaggaactgggggcactgctcgaaattcccgctgcgaaacacgagaaaccatgccagcgagggatcagtcgcagcaaccattttgtgagtaaatag

SEQ ID NO: 30998 - DNA, 378 bp, Artificial Sequence
  Description of Artificial Sequence: Synthetic coding sequence
atggtgatggagaaaccttcaccactacttgtggggagggaatttgtgcgacagtactacacactgctgaataaggctcctgagtacctgcacagattctacggacgaaattcctcctacgtacacgggggagtggatgcctccggcaagccacaggaggccgtgtacggccagaatgatatccaccacaaagtgctgtctttgaatttttccgagtgtcatacaaagatccggcatgtggatgcacacgcaaccctctctgacggagtggtggtgcaggtgatgggattgctgtccaatagcggtcaacccgagcggaaattcatgcaaacctttgtactggcgcctgaaggttccgttccgaataaattctactag

SEQ ID NO: 30999 - DNA, 657 bp, Artificial Sequence
  Description of Artificial Sequence: Synthetic coding sequence
atgaatggacgagctgacttccgcgagccaaacgccgaggttcctcggcctatccctcctgttcctcttgcagcgaccagcatgctcataactcagggcttaatctctaaaggcatcctgtcatcccaccccaaatacggttccataccaaaactgatactggcttgcatcatggggtattttgccggtaagttgtcctatgtcaaaacctgtcaggaaaagttcaaaaagctggagaatagccctctgggagaagctctaaggtccggacaagctcgcagaagttcgccaccagggcattattatcaaaaatccaagtatgactcttctgtgtctggtcaatcatcttttgttactagtccagctgccgataacattgagatgcttccccattatgagcccattccattcagcagcagcatgaatgagtccgccccaaccggcatcacggatcacatcgttcaaggtccagatcccaatctcgaggaatccccaaagaggaagaatattacctatgaggagctcaggaataaaaatcgagagtcatacgaagtttcgcttacacagaaaaccgacccaagcgtgaggcccatgcatgagcgggtgccaaaaaaggaggtcaaggtgaataagtacggggacacttgggacgagtag

SEQ ID NO: 31000 - DNA, 243 bp, Artificial Sequence
  Description of Artificial Sequence: Synthetic coding sequence
atgaatgggagggccgattttagggaacccaatgccgaggtgcctcgaccaataccacacatcggaccagattacattccaacagaggaggaaagaagggtctttgctgaatgtaatgatgagtccttctggtttcggtctgtgcctctggcagcaacgagcatgctgatcacacaaggcctgataagcaaggggatcctgtctagccacccaaagtacgggagcatccctaagctgatctag

SEQ ID NO: 31001 - DNA, 654 bp, Artificial Sequence
  Description of Artificial Sequence: Synthetic coding sequence
atgatagtaaacgattatgaggggaatgattccgaggctgaagatctgaacttccgggaaaccctgcctagcagcagccaggagaacactccaaggtcaaaagttttcgagaataaggtgaacagtgagaaagtgaaacttagcctgcggaatttccctcacaacgattatgaggatgtatttgaggaaccttccgagtccggctctgaccccagcatgtggaccgcgcgtggacctttcaggcgagataggtggagtagtgaggatgaggaggctgctggcccaagccaggctctcagcccactgctgtctgacacacggaaaattgtttcagaaggagagctagatcagcttgcccagatcaggcctctgatctttaattttcacgagcagacagccattaaagattgcctgaaaatcctagaggagaagaccgcagcatatgacatcatgcaggaatttatggccctggagttgaagaatttgcccggagagttcaattcaggaaaccagccctccaatcgggagaaaaatcgataccgggatatattgccattccagcaccacggctacagtggtcccaatgagcgtacaacattttggcatggctccaatgagggcgctgtgagtttattgctccgctactgcgcctag

SEQ ID NO: 31002 - DNA, 351 bp, Artificial Sequence
  Description of Artificial Sequence: Synthetic coding sequence
atgggacggctagatggaaaggtgattatcctgactgcagcagcccaggggatcggtcaggcagctgcccttgcatttgcccgtgaaggcgctaaggtgatagctacagacattaacgagagcaagctgcaggagctggagaagtaccccggtatccagacccgggtgttagatgtgacgaaaaaaaaacaaattgaccagttcgcaaatgaagtggagcgcctggacgttctgtttaatgtggcaggattcgttcaccacgggaccgtgctggactgtgaggagaaggactgggatttttctatgaacttaaatgtgcgctccatgtatttgatgattaaggccttctag

SEQ ID NO: 31003 - DNA, 504 bp, Artificial Sequence
  Description of Artificial Sequence: Synthetic coding sequence
atgaaagcaatcaagaaatctctgacagaggaggagtacctgtatctggatttttcacatcaaaccgagggctgcatatttccactccacacctccgttacactatttcttctgagttattgcgactgcaaaatctttaagatctgcctggtggtgaccaaggaagtttctcgggattcaagtctgctccgtgatgacttaatccaggacgttgaaattcagattatttcccggcaggaattaccccctatcgtccaaaattgttgcttacctgctgtagtggaaaggtctgataacttttgtcgagctgggctggcagtggtactccggcatattatccagaagtcttacgaagcagaccctttgaaaaaagagctcttagagctgctgggcttcaagaaaacctgtctgaaggcctgcgccgaggtgtcgcaatggacaaggctgtgcgagctgaccatccccttggccatcgagaactttctgagagagagttctgattag

SEQ ID NO: 31004 - DNA, 933 bp, Artificial Sequence
  Description of Artificial Sequence: Synthetic coding sequence
atgagccagcaactgaagaaacgcgctaagactagacatcagaaggggttggggggtagagccccttctggggctaaaccccgacagggaaagagttcccaggacctccaagccgagatagagcctgtgtcagctgtctgggccctgtgtgatggttacgtctgttacgagccgggacctcaggcccttgggggagatgacttctctgattgttacattgaatgcgtgattagaggtgaatttagccagccgattctggaagaagactccctgtttgagtctcttgaatacctcaagaaggggtcagagcagcagctttcccagaaggtctttgaagcctctagcttggaatgcagcttagagtatatgaagaaaggggtgaaaaaagagctgccacagaagatcgtgggcgaaaactctttggaatactcagagtatatgaccggtaaaaagcttccacctggtggaattccaggcattgacctaagcgatcccaaacaattggcggaattcgcacgaaagaaaccgcctattaacaaagaatacgacagcctgagcgctattgcttgcccccagagcggatgtactcgtaaacttcgcaaccgggctgctttaaggaaacacctgctgatacacggacccagagaccacgtctgtgccgagtgcggaaaggctttcgtggagagctcgaagctgaagaggcactttctggtgcacactggggaaaagccttttcgatgtactttcgaaggatgcggcaagagattttctctggacttcaacctgcgaactcacgtgcgtatccatacaggagaaaaacgctttgtgtgcccattccagggttgtaaccggaggttcatacaatcgaacaatttaaaagcccacattttaactcatgctaatacaaataagaacgagcaagagggcaaatag

SEQ ID NO: 31005 - DNA, 237 bp, Artificial Sequence
  Description of Artificial Sequence: Synthetic coding sequence
atggtcatggaaaaaccttcacccttattagtcggacgcgagttcgtgcggcagtactacacattgctaaacaaggctccggaatacctccataggttttatggcaggaatagcagctatgttcacggcggagtggacgccagcggtaagccacaggaggccgtctacggtcagaacgatatacaccacaaagtactaagtctgaacttctcagagtgtcacactaagatacgttag

SEQ ID NO: 31006 - DNA, 681 bp, Artificial Sequence
  Description of Artificial Sequence: Synthetic coding sequence
atgtcgagcccccgagatttccgcgctgaaccggtgaacgattatgaaggtaacgacagtgaggccgaggacttgaatttcagagaaactctgccaagctccagccaggaaaacacacctcggagcaaggtgtttgaaaataaagttaattccgagaaggtaaagctctctcttcggaattttccgcataatgactacgaggatgtcttcgaagaaccttcagaaagtggaagtgatccatctatgtggactgctcggggaccctttagacgagacagatggagcagcgaagacgaagaagccgcaggcccaagtcaggctctctcccctttgctgtcagacacgagaaaaattgtttctgaaggggaactggaccaactcgcgcaaattcggcctctgattttcaactttcatgaacaaactgcaattaaggactgcttaaaaatactggaagaaaagaccgccgcttacgacatcatgcaggagttcatggctctggagttgaaaaacctgccaggagaattcaactcaggcaaccagccttcaaatcgcgagaagaaccggtatcgcgatatcctgccattccagcatcacggatattctggaccaaacgagaggacgacattttggcacggttctaacgagggtgctgtgagcttgctcctgagatattgcgcctag

SEQ ID NO: 31007 - DNA, 1020 bp, Artificial Sequence
  Description of Artificial Sequence: Synthetic coding sequence
atgtggactgctcggggtccttttcggagagaccgatggagcagtgaggacgaagaggccgctgggccatcccaagccctgagcccactgctgtccgatacccggaaaatagttagcgagggcgagttagaccagctggcccaaataagaccgctcatcttcaattttcatgagcagacggcaatcaaggactgtctaaaaatactggaggagaaaactgccgcatacgatataatgcaggaattcatggctctggagctgaaaaacctgccaggggagttcaactcgggaaaccaaccctcaaacagggagaagaatcgataccgcgatatcttaccttatgactcaacaagggtgcccctcggcaaaagtaaagactatataaatgccagttacataagaatcgtcaactgtggcgaagaatacttctacattgcaacccagggcccactcctctccacaatagacgatttttggcagatggtgctggagaacaattcaaatgttatcgcgatgatcacccgggagatcgaagggggaataataaagtgttatcactattggccaatttccctcaagaagccactcgagctgaagcatttccgtgttttccttgagaactaccagattctgcaatacttcataatccgaatgttccaggtggtggaaaagtccaccggcacatcgcactctgtgaagcagctgcaattcactaagtggccggaccacggcaccccagcaagtgccgattccttcataaaatatataaggtatgccaggaagagtcacctgactggaccgatggtagtccattgttccgcaggaatcggacgaactggcgttttcctgtgcgtagacgtggtgttctgcgcaatagttaagaactgttcattcaatatcatggatattgtggcccaaatgcgggagcagcggtcgggcatggtccagactaaagaacaatatcatttctgttatgacattgtgctggaggtgctcagaaaactcctgaccctggactag

SEQ ID NO: 31008 - DNA, 1179 bp, Artificial Sequence
  Description of Artificial Sequence: Synthetic coding sequence
atggggactacctgtcttcatctcgggaccctggagcagtctctggtgttcgagaataaggtcaatagtgagaaggtgaaactgagtctacggaacttcccacacaacgattacgaagatgtgttcgaagagccgtcggagtctggctccgacccatcaatgtggacagcaaggggacctttccggcgtgacagatggtcttccgaggacgaagaagccgctggtccatctcaggcactctctccgctcctgtccgatacacgtaagattgttagcgaaggagaactagatcaactggcccagataaggccgctgatcttcaattttcacgagcagacggcaattaaagactgcctaaaaatcctggaagagaagacagcagcgtatgacattatgcaagagtttatggcactcgagctgaagaatctaccgggagagtttaactcaggaaaccaaccatcaaacagagaaaagaatagatacagggatatacttccgtacgattcgaccagagttccactgggtaaaagtaaagactatattaatgcctcttacattcggattgtcaattgtggagaggagtatttttacatcgccacacagggcccactgctgagcactatcgacgacttctggcaaatggttctggaaaacaatagcaatgtgatcgctatgattaccagagaaatcgagggcggaatcattaagtgctaccattactggcctatctctttaaaaaaaccactggaacttaagcacttcagagtgttcttagaaaattaccagattctccagtattttattatcagaatgttccaggttgtcgagaaaagcactggcacgtctcactcagttaagcagctccagtttaccaaatggcctgatcacgggacccccgcaagtgcggactcatttatcaagtatatccgctacgcccgtaagtcccacctgactgggccaatggtagtgcattgttctgccggaatcggccgaactggtgtgtttctttgcgtcgatgtggtattttgcgcgattgttaaaaactgttctttcaatatcatggatattgtggcacagatgagggagcaaaggtctggaatggtccagaccaaggaacagtatcatttctgttacgacattgtgcttgaggtgttgcgcaagctcctgaccctcgactag

SEQ ID NO: 31009 - DNA, 654 bp, Artificial Sequence
  Description of Artificial Sequence: Synthetic coding sequence
atgatcgtcaacgattacgaggggaatgatagcgaggccgaggacctgaacttccgagagacgctgccgtcttcttctcaggaaaacacaccacgctccaaggtgttcgagaacaaagtgaacagtgaaaaggtgaagctgtccctgagaaattttcctcataacgattacgaggacgtgttcgaagagccctctgaatccggaagtgaccctagcatgtggactgcaagagggccatttagacgcgacagatggtcctctgaggacgaagaggctgcaggcccatcgcaggctctctctcccctcctgtctgatacccgtaagatcgtgtccgagggagaacttgaccagcttgcccagattagaccccttatctttaatttccatgagcagacagctataaaggattgccttaagatacttgaggagaagaccgccgcatacgacatcatgcaggagtttatggccctcgagttgaaaaatttaccgggtgagttcaacagcgggaaccagccaagcaaccgcgagaagaatagatacagagatatcctaccttttcagcaccacggatactccggaccaaacgaacgcaccactttttggcacggatccaatgagggggctgtctctttactactccgctactgcgcctag

SEQ ID NO: 31010 - DNA, 438 bp, Artificial Sequence
  Description of Artificial Sequence: Synthetic coding sequence
atgtggacagccagaggcccattccgaagggaccggtggtcatccgaagatgaggaagccgcaggaccaagccaggccctgagtccattactatcagatacccgtaagatcgtctcagaaggtgagctggatcaactggcacaaatccggcctcttatcttcaattttcacgaacaaaccgcgattaaagactgcctgaaaattttggaagagaagacagcagcctacgacataatgcaagaatttatggcgctcgagctgaagaatttgcccggagaattcaattccggaaatcagccctctaaccgggagaagaaccgctacagggacattcttccattccagcatcatggctatagcggacccaacgaaagaacgacattttggcacgggagtaatgagggcgctgtgtcgttgcttctgcggtactgcgcctag

SEQ ID NO: 31011 - DNA, 207 bp, Artificial Sequence
  Description of Artificial Sequence: Synthetic coding sequence
atgagctccccccgagattttagggcagagccagtgaatgattacgagggcaatgattcagaggctgaggacttaaactttagagagacgctccctagcagcagccaggaaaatactcctcgttccaaagtctttgaaaataaagtgaactctgagaaggtcaagctctctcttcgaaattttcctcacaatgactacgaagactag

SEQ ID NO: 31012 - DNA, 525 bp, Artificial Sequence
  Description of Artificial Sequence: Synthetic coding sequence
atggcaaagtataatactggcggtaatcctacagaagacgttagtgtaaattccagaccgttccgcgtcacgggacccaattcaagcagcggaatacaggctagaaaaaatctattcaataaccagggcaatgccagcccccctgccggtccttctaatgtgcccaagttcggtagccctaagccccctgtggctgtcaagcccagctcagaagagaagccggacaaagagcccaagccccctttcctcaagcctactggcgctggccagcgctttgggactcctgcgtctttgaccacaagggatcccgaggcgaaggtggggtttctgaaacccgtgggtcctaagcccatcaatctgccgaaagaggattcaaaaccaacattcccgtggcccccaggaaacaaacctagtctgcacagcgtcaatcaagaccacgatctgaagcctcttggcccaaagtccggaccaacaccacccacatctgagaatgagcagaagcaggcatttcccaagctgacctag

SEQ ID NO: 31013 - DNA, 405 bp, Artificial Sequence
  Description of Artificial Sequence: Synthetic coding sequence
atgtctgatgatgctggagatacgcttgcaaccggagacaaagcggaagtaacggaaatgcctaactctgatagtctaccagaggacgctgaggtgcactgtgactcggctgctgtgtcacatgagcccactcccgctgacccaaggggcgagggtcacgaaaacgccgcagtgcaaggagctggggctgctgccataggtccaccagtgcagcctcaggatgccaatgcgttagagcccccacttaatggggacgtgactgaagatacattagccgagtgcattgatagtgtatctctggaggcggaaccccgttccgagataccactgcaggagcagaattatctggcagtggacagccctccttctggaggaggctgggcaggctggggctcctggggctag

SEQ ID NO: 31014 - DNA, 432 bp, Artificial Sequence
  Description of Artificial Sequence: Synthetic coding sequence
atgaaacgaggtcggctgccctcaagtagcgaagattcagatgataatggatcgttgtccaccacatggtctcagaatagcaggtcacagcaccggaggagctcctgttctcgacatgaggacagaaagcccagcgaggttttccgcacggatctgatcaccgcgatgaagcttcatgacagctatcaattaaacccagacgaatactacgtgctcgctgacccctggcgacaggagtgggagaagggagtgcaggtccctgtctcaccaggtactattccacaaccagtcgcacgcgtcgtaagcgaagagaagtctcttatgttcattcgcccaaagaaatacatcgtcagcagtggatcagagccacctgagctcggttatgttgatatccgcactctggctgatagtgtgtgccgctatgatttgtag

SEQ ID NO: 31015 - DNA, 1200 bp, Artificial Sequence
  Description of Artificial Sequence: Synthetic coding sequence
atggactttttcagttctcatttgctagctgatagcagttctccagcaacaaatagtagccacaccgacgcccatgagattctcgtctcagacttcttagtcagcgatgaaaatctgcagaagatggaaaacgtccttgatctttggtcttctggtctgaaaaccaacattatctcagagctctcaaaatggagattaaactttattgactggcacagaatggagatgcggaaagaaaaggagaaacacgctgcacatttgaagcagctgtgcaaccaaattaatgaactaaaggaattacagaaaaccttcgagatttcgatcggcagaaaagacgaggtgatcagttccctctcccatgccatagggaaacagaaggaaaagatcgagctaatgaggacctttttccactggcggataggccacgttcgtgccagacaagacgtgtacgagggtaagttggcagatcagtactaccagcgaactttacttaaaaaagtctggaaagtgtggagatcagtggtgcagaagcaatggaaagatgtggtagaaagagcttgccaggccagggctgaggaggtttgcatacagatcagtaacgattacgaagccaaggttgccatgctgtccggagccctggaaaacgcaaaagctgagatccagcgtatgcagcacgaaaaggagcatttcgaggacagtatgaaaaaggcctttatgaggggcgtgtgcgcactgaatctagaagcaatgacaattttccaaaatcgcaatgatgctgggattgacagcactaacaacaagaaggaggagtacggccctggagtacagggaaaagaacacagtgcacatctagatccctccgccccacctatgccactccccgtgacttctccactgctgccctctcctcccgctgcagtaggcggagcgtcggcgaccgctgttccgtcagccgcttctatgacctctacccgcgctgcctcagcctccagcgtgcacgtgcccgttagcgcacttggtgccggtagcgccgctaccgcagccagcgaggaaatgcagactataccacaggctacagccgctaagtatccgaggaccatccatcccgaaagtagcacaagcgcatccagaagccttggcacccgatccgcccatacccagtcactcactagcgtccatagcattaaggtagtggattag

SEQ ID NO: 31016 - DNA, 240 bp, Artificial Sequence
  Description of Artificial Sequence: Synthetic coding sequence
atggatgagtccgctctgctagacctgctggagtgtcctgtgtgcctcgaaagactcgacgcctccgccaaagtcttaccatgccagcatactttctgtaaacgctgcttactcggcatcgtcggctctcgaaacgaactgcggtgtcccgagtgcagaacgctagtgggcagtggcgtcgaggagctgccctcaaacatcttgctggtgaggctcctggatggaataaaacagcgctag

SEQ ID NO: 31017 - DNA, 621 bp, Artificial Sequence
  Description of Artificial Sequence: Synthetic coding sequence
atgtcctccccaagggattttagagccgaacctgtaaatgattacgagggtaacgattccgaggcggaagatttaaacttcagggagacgctgccttcttcctcccaagagaacacgcctcgttctaaggtgtttgagaataaggtgaattccgaaaaggtgaagctaagtctgcgcaattttccgcacaatgactatgaagacgtgttcgaagaacctagcgagagtggctccgatccgtccatgtggaccgctcgtgggcctttcagacgggatcgatggtcgtccgaggacgaggaagctgctggtccatcccaggcgctctcaccactgctgtcggatactaggaagatcgtcagcgagggcgagcttgaccagcttgcccaaattcgtcccttaatctttaacttccacgagcagactgctataaaggactgtctgaaaattctggaggagaagactgccgcatacgacattatgcaagaattcatgtttaatatcatggatattgtcgctcagatgcgggagcagagatctggaatggtacagacgaaggaacagtatcacttttgttacgatatcgtccttgaggtcttacgtaaattactgactctagactag

SEQ ID NO: 31018 - DNA, 501 bp, Artificial Sequence
  Description of Artificial Sequence: Synthetic coding sequence
atgaaggccattaaaaaatcactaaccgaggaagagtatttatacctggattttagccatcaaacagagggctgcatcttccccctgcatacatccgtgacactctttctgctgagttactgtgactgcaagatcttcaagatctgcctcgttgtgacaaaagaggtttcgcgcgatagcagcctgcttcgggatgatttgattcaggatgtggagattcagataatttctagacaggagctgcctccaatcgtgcaaaactgttgtttacctgccgtcgttgagagatccgacaatttttgtcgcgctgggttagctgtggttcttcgccacataatccagaaaagctatgaggccgaccctctcaaaaaggagctcttagaactcctcggattcaaaaaaacttgtctaaaagcctgcgccgaggtgtctcagtggacccggttgtgcgaactcaccattcccctcgctattgagaattttttgagggagtcctcttag

SEQ ID NO: 31019 - DNA, 363 bp, Artificial Sequence
  Description of Artificial Sequence: Synthetic coding sequence
atgtggaaggtcgttaacctgcctactgatttgttcaacagtgtgatgaatgtcgggaggttcacagaagaaattgaatggcttaaatttctggcactggcttgcagtgccttaggcgtcactatcacaaagactttgaagattgtttgtgaggtgctcagctgcgatcacaatggtggcctgccacggatccctttctcgactttccagttcctttacacatatattgccgaggtcgacggggagatctgcgcctcgcacgtatctaggatgttgaactacatcgagcaggaggttattggtcccgacggactgattaccgtcaacgattttacccagaacccaagggtttggctcgaatag

SEQ ID NO: 31020 - DNA, 351 bp, Artificial Sequence
  Description of Artificial Sequence: Synthetic coding sequence
atggttatggaaaagccttcccccctactcgtaggacgggagtttgtgcgccagtactatactttacttaacaaagctccagagtatttacaccggttctatggacgtaattccagttatgtgcatggcggtgtggacgcctccgggaagcctcaagaggccgtctacggccagaacgatatacatcacaaagtcctgagcctgaacttctccgagtgccatactaaaatccgccacgtggacgcacatgcgaccctctccgacggtgtcgtagttcaggttatgggacttctttcgaacagtggccagcccgaaaggaaattcatgcagacattcgtgctagcaccatag

SEQ ID NO: 31021 - DNA, 480 bp, Artificial Sequence
  Description of Artificial Sequence: Synthetic coding sequence
atgtcggaccatcggtacggcgacggcggaagcacgttccagtccacaacgggtcattgcgtgcacatgcgagggctaccataccgcgcaacggaaaatgatatatacaatttcttctctcctctcaaccccgtgagggttcacatagaaatcggtccagacggcagggtaacgggggaagccgacgtcgaatttgctacccacgaggatgctgtggctgccatgtctaaagataaagccaacatgcagcatcgatacgtagagttattcttaaacagcactgcgggtgcgtctgggggagcctacggctctcagatgctgggtggaatgggcttaagtaaccaatcatcctatggtgggcctgcatctcagcagttatccggaggctatggaggcggttacggcggacagagtagcatgtctggatacgaccaagtcctccaggagaatagtagcgattttcaatcaaacattgcatag

SEQ ID NO: 31022 - DNA, 411 bp, Artificial Sequence
  Description of Artificial Sequence: Synthetic coding sequence
atgatcgttaatgactatgaaggcaatgactcagaagccgaagacctcaattttagagagaccctgccttcctcgtcccaggagaatactcctaggtcaaaggtgtttgaaaacaaggtgaactctgaaaaagtcaagctgtcactgcgcaactttcctcacaacgattatgaagatgtgtttgaggagccatccgaatctggatctgacccttcaatgtggaccgcacgcggtcctttcaggagagaccggtggtccagcgaagacgaggaggcagcagggcctagtcaggctctgtccccactcctatcagtgcagcatcacggctactcaggccctaacgaacgcacaactttttggcacggctctaatgagggagccgtgtctctactattgagatactgtgcatag

SEQ ID NO: 31023 - DNA, 462 bp, Artificial Sequence
  Description of Artificial Sequence: Synthetic coding sequence
atgaaactgacttccgaaaaattacccaagaatccattttacgcgtcagtctctcagtacgcggcaaagaatcagaagttcttccagtggaaaaaggagaagactgattacacccacgcaaacctggtagacaaggccctgcagctcctcaaagaacggatattgaagggagataccctagcgtatttcctgcgcggacaactgtacttcgaggaggggtggtacgaagaagcactggagcagttcgaggaaatcaaagagaaagatcaccaggctacctatcagctaggagtaatgtattacgacggactgggtactacgcttgacgctgagaagggggtagactacatgaagaaaatccttgacagtccctgcccgaaagcccgtcacctgaaatttgccgcagcctataatctgggtcgggcatactatgaaggcaaaggtgtgaaacgaagcaattag

SEQ ID NO: 31024 - DNA, 489 bp, Artificial Sequence
  Description of Artificial Sequence: Synthetic coding sequence
atggaagctctacttgagggcattcagaatagggggcacggaggcggttttctgacctcttgtgaggctgagcttcaggaactgatgaaacaaattgacatcatggtggcgcataaaaagtctgaatgggaagggaggacccacgcactggagacctgcctcaaaattcgggagcaggagcttaaatcgctgcggagtcagcttgatgtgactcacaaggaagtgggtatgctgcatcagcaggtagaggaacatgagaaaatcaaacaggagatgaccatggaatacaagcaggagctgaagaagctccacgaggagttgtgcatactgaagcggtcttatgagaaactacaaaaaaagcaaatgagagaatttcggggtaatacgaaaaatcaccgagaggatcgctctgaaatcgagcgcctcacagcgaaaatcgaggagttcagacagaagtctttggactgggagaaacaaagactgatttag

SEQ ID NO: 31025 - DNA, 1530 bp, Artificial Sequence
  Description of Artificial Sequence: Synthetic coding sequence
atgaagaggggtcgcctcccaagctcctcggaagattcggatgacaacgggtctcttagcacaacatggtcccagaactcccgaagccagcacagaagatcctcctgttctagacatgaggatcggaagccttctgaagtgttccggaccgacctgataactgctatgaagctgcacgatagttaccaactgaatcccgatgagtactacgtgcttgctgatccctggcgacaggaatgggagaagggggtccaagtgcccgtgtctccaggcacaataccgcagcccgtagctagggtggtctctgaagaaaagtcattgatgtttattagacccaagaaatacattgtgtcatctggatccgaacctcctgaactcggctacgtcgacattaggaccctggctgacagtgtgtgtcgctacgacctgaacgacatggatgcggcttggctggagctgaccaacgaagaattcaaagagatgggcatgcccgagctggatgaatacaccatggagcgggtcctcgaagaatttgaacaacgctgctatgacaatatgaaccatgccatagaaaccgaggaggggctggggatagagtacgacgaagacgtggtgtgcgacgtctgccagagccctgacggcgaggatgggaacgagatggtgttctgtgacaaatgcaacatatgtgtgcaccaggcctgctacggcatcctgaaggtgcccgaagggtcctggctctgccgcacatgcgctcttggcgtacagcctaaatgcctcttgtgccctaagaaaggcggagcaatgaagcctacacggtccgggactaagtgggttcacgtgagctgtgcactgtggatccccgaagtgtctattggcagcccagaaaaaatggagcccattaccaaagtctcacatattcccagcagccggtgggccctggtctgtagtctgtgcaatgagaaatttggggcatcaatccaatgctcggtgaaaaactgtaggacagcctttcatgtgacatgtgcctttgatagggggctggaaatgaaaacaatccttgccgagaacgacgaggtcaaattcaaaagctattgtccaaagcactcctctcaccgtaaacctgaagaaagtttgggtaaaggagctgctcaggagaatggcgcacccgagtgcagcccgcgtaatccgttagaaccatttgccagcctggaacagaaccgggaggaagctcatcgtgtgtcagtacggaaacagaagctgcaacagctagaggacgagttttacacatttgtgaacctacttgacgtcgcacgggcactccgcctgccagaggaggtggtggatttcctgtatcagtattggaaacttaaaaggaaagtgaattttaataagcctctgattacaccaaagaaggatgaggaagacaacctagctaaaagagaacaggacgttctgtttcgaaggctccagctcttcacacatctaaggcaggacttggaacgggtgatgattgatacagacacgttatag

SEQ ID NO: 31026 - DNA, 90 bp, Artificial Sequence
  Description of Artificial Sequence: Synthetic coding sequence
atgaacggcagagccgattttcgcgagccaaatgccgaggttcctaggccgatcccccatatcggccctgattacattcccaccgaatag

SEQ ID NO: 31027 - DNA, 1236 bp, Artificial Sequence
  Description of Artificial Sequence: Synthetic coding sequence
atgattgtcaatgactacgaaggcaacgatagtgaggctgaggacttgaactttcgggagacattgccgagttcatcccaggaaaacactcctagatcaaaggtgttcgagaacaaggtcaactcagagaaggtgaaactgtctctgcggaacttcccccacaatgattatgaggacgtcttcgaagagccttccgaaagcgggtcagatcccagtatgtggacagctaggggcccattcaggcgggaccggtggagcagtgaggatgaggaggcagctggccctagtcaagctctgtccccactcctttctgatacccggaaaattgtcagcgaaggggagctggaccagctcgcccagatccgtccattaatatttaattttcacgagcagactgctatcaaggactgccttaagattctcgaagagaagaccgctgcctatgatattatgcaggaattcatggccctagaactgaaaaatctgcccggagagtttaatagcgggaatcagccttccaatagagaaaagaacaggtaccgcgatatcttaccgtatgattccacaagggttccccttggcaagtcaaaggattacatcaatgcctcgtacatccgcatcgtgaactgtggtgaggaatatttttatatagctacacaggggccacttttgagcactatcgacgacttttggcaaatggtactagagaacaacagtaatgtcattgccatgatcacccgggaaatcgaaggaggcattatcaaatgctaccattattggcctatatctctcaagaagccgcttgaactaaaacacttccgagtgtttcttgaaaattaccagatcctccaatacttcatcattaggatgttccaggttgtcgaaaagtcaacgggcacaagccattcagtgaagcagctgcagtttactaaatggcctgatcacgggaccccagcgtcagcagacagcttcataaagtatatccgttacgccaggaagagtcatctgacagggcctatggtggtacactgcagtgccggaataggcagaactggcgtcttcctttgcgtcgatgttgtcttctgtgccatcgtcaaaaattgctctttcaatattatggatattgtagcccagatgcgggaacagcggtccggcatggtacagactaaggagcagtatcatttttgctacgacattgttttggaggtgctgcgcaaattgttgaccctcgactag

SEQ ID NO: 31028 - DNA, 300 bp, Artificial Sequence
  Description of Artificial Sequence: Synthetic coding sequence
atggtgatggagaagcctagtcccttactggtggggcgagaattcgttaggcaatattacactctcctcaacaaagctccagagtacctgcatcggttctacggaagaaactcttcctatgtgcatggcggagttgatgctagtgggaagccacaggaggcggtgtacggccaaaatgatattcaccacaaggttctctctttaaacttttccgagtgtcacactaagatccgacatgtcgatgctcatgccacactttctgacggtgtggtagtgcaggtcatgggattgctcagctag

SEQ ID NO: 31029 - DNA, 705 bp, Artificial Sequence
  Description of Artificial Sequence: Synthetic coding sequence
atggccagcagtgctaagtctgccgagatgcccacaattagcaagactgttaatcctactcctgacccccaccaggaatatttagatccacgtatcaccatcgccctgtttgagatcggcagccacagtccaagcagctggggatctctcccatttttgaaaaactcatcacaccaagttacagaacaacagaccgctcagaaattcaataacctactgaaggagatcaaagacattctgaagaatatggccggattcgaagagaagattacggaggcgaaggagctatttgaggaaacaaatatcaccgaggacgtctccgctcataaagagaatatccggggtctggataaaataaacgagatgctttctacgaacctgccggtgtccctcgcgccagagaaggaggacaacgagaagaaacaggagatgatccttgagactaacataacagaggatgtaagcgcacacaaggaaaatataagaggtctcgacaagattaatgagatgctcagcactaaccttccagtgtcgttagccccagaaaaagaagataatgagaagaagcagcagatgattatggaaaatcagaatagtgaaaacaccgcccaggtgtttgccagggaccttgtcaatagactggaggaaaagaaagtcctgaatgagacccaacagtcgcaggagaaggccaaaaacaggctgtag

SEQ ID NO: 31030 - DNA, 1095 bp, Artificial Sequence
  Description of Artificial Sequence: Synthetic coding sequence
atgtatttttgctggggggcagacagccgcgagttgcagagaaggagaactgcaggctcacctggcgcagaacttctacaggccgctagcggagagcggcactcccttttactcctcacgaaccatcgagtcctatcctgcggcgataactccaggggacaactcgggaggaggggagcacagagaggggaacttcccgagcccattcaggctcttgaaacactgatcgtcgacctggtgtcttgcggcaaagaacatagcctggctgtatgccataaggggcgtgtcttcgcctggggcgctggtagcgagggccagctgggaattggtgagtttaaagagatttcttttactccgaagaagattatgactcttaatgatataaagattatccaggtctcgtgcggacactatcacagccttgccctctcaaaagattctcaggtcttttcatgggggaagaactcccatgggcagctgggtcttgggaaagagttcccctcgcaggcctccccccagcgcgtccggagtttggaaggcattcctcttgctcaagtggccgctggcggagcacatagcttcgcactgtccctttgtgggacgtcgtttggatgggggagtaattccgcagggcagttggccctgagtggccgaaacgtacctgtgcaatccaataaacccctgtctgttggggctctgaagaacctcggggtggtttacatcagctgtggagacgcacatacagccgtgttgacccaggatggaaaggttttcacattcggggacaataggtctggccagctgggttactcacctacccctgaaaagcgtggaccacagttggtggagcggatagacgggctcgtcagtcagatcgactgcggctcctaccacacattagcctacgtccacaccaccgggcaggtggtgtccttcggtcatggaccaagcgatactagtaagcccacacacccggaagctcttactgagaacttcgatattagctgcctgatttctgccgaggacttcgtcgatgttcaggtgaagcacatcttcgctggaacctacgccaattttgtaactacacaccaatag

SEQ ID NO: 31031 - DNA, 348 bp, Artificial Sequence
  Description of Artificial Sequence: Synthetic coding sequence
atggccaagtacaacactggtgggaatccaactgaggatgtgtcagtgaactctaggccattccgcgttactggaccgaacagcagtagcgggattcaggcccgtaagaatttatttaacaatcagggcaatgcaagcccaccagcaggtccctcgaacgttcctaaatttgggtcgcctaagcccccagttgcggttaagcccagctcagaggaaaagccggacaaggagccaaagcctccttttctgaagcccaccggcgcaggccagagattcggaacccccgcatcactcaccacgcgggacccggaagcaaaagtcggctttcttaaacccgtgggaccgtag

SEQ ID NO: 31032 - DNA, 486 bp, Artificial Sequence
  Description of Artificial Sequence: Synthetic coding sequence
atggcaggaatccttagactggtggtacaatggccacccggacgactccaaactgtaaccaaaggagtggaatcgctgatttgcactgattggatccggcataaatttacccggtcccgtattccggagaaagtgttccaagcctcacccgaggaccacgagaagtatggcggtgacccccagaatcctcacaagctccacatagtcaccagaatcaagtctactcgcagacgtccatactgggagaaggatataatcaaaatgctgggactggagaaagctcacacacctcaggtccacaaaaatataccctccgtgaacgctaaactaaaggtagttaaacatcttattagaatcaagcccctcaaactcccccagggattacctgcagaagagaatatgtcaaacacgtgtctcaagagtaccggggagctggtggtgcagtggcatctgaaacctgtcgagcaaaaggctcatgaatcctag

SEQ ID NO: 31033 - DNA, 516 bp, Artificial Sequence
  Description of Artificial Sequence: Synthetic coding sequence
atgaatggcagggctgacttccgcgagcctaacgccgaggtcccaaggcccatcccgcatattggcccagattacattccaacagaagaagagaggcgggtcttcgccgagtgtaacgacgaaagcttctggtttaggtcagtgccgctggccgctacaagcatgctgatcacccagggactcatttctaaaggaatcctaagcagtcatcccaaatatggcagcattccaaagctgatcctagcctgcattatgggttatttcgccggtaagttgtcgtacgtgaaaacctgccaggagaagttcaaaaagctcgagaactcacctcttggcgaggcactgcgaagtggtcaagcacgcagatccagcccacccggtcactattaccagaaatcgaagtacgatagctcagttagcggccagagcagctttgttaccagccccgctgccgacaatatcgagatgcttccccattacgagccaattcctttttcgagctctatgaacgaaagttag

SEQ ID NO: 31034 - DNA, 438 bp, Artificial Sequence
  Description of Artificial Sequence: Synthetic coding sequence
atgtcttcgcctcgtgacttccgcgctgagcctgtcaacgactatgagggcaacgacagcgaggcagaagatttaaattttagggaaactttgcctagcagttctcaggagaatacccccagaagtaaggtgttcgaaaataaggtaaactccgagaaggtcaaactcagtttacggaattttccgcacaatgactacgaagatgtttttgaggagccttctgagagcgggtcagacccctcgatgtggacagcaagaggcccattccggagagacagatggagtagtgaagatgaagaggccgctgggcctagccaagcattgagtcctttgctctccgtacaacaccacggctacagtggccctaatgagaggacaacgttttggcacggcagcaatgagggagccgtatccctattactcaggtactgcgcctag

SEQ ID NO: 31035 - DNA, 243 bp, Artificial Sequence
  Description of Artificial Sequence: Synthetic coding sequence
atggtcacctctcttaatgaagacaacgagagtgtgactgtagagtggatcgagaatggcgacactaaaggaaaggagatcgacctcgaatccatcttctcgttgaatcctgatctggtgcccgatgaagagatagaaccaagccctgaaacgcctccgccaccagcttcttctgctaaagtcaacaaaatcgtgaaaaataggaggacagtggccagcatcaagaacgacccaccatcttag

SEQ ID NO: 31036 - DNA, 123 bp, Artificial Sequence
  Description of Artificial Sequence: Synthetic coding sequence
atgaaggccattaagaaaagtctaactgaagaagaatatctgtatctggactttagtcaccagactgaggggtgtattttcccactgcacacctccgtgacactttttctcctgtcatattag

SEQ ID NO: 31037 - DNA, 192 bp, Artificial Sequence
  Description of Artificial Sequence: Synthetic coding sequence
atggaagcacttttggagggcatccagaaccggggacatggcggaggttttctgacttcctgcgaagccgaactgcaggagttgatgaaacaaattgacattatggtcgctcataaaaagagcgaatgggagggaagaactcatgctctagaaacttgcctgaaaattcgtgagcaagagcttaagagttag

SEQ ID NO: 31038 - DNA, 594 bp, Artificial Sequence
  Description of Artificial Sequence: Synthetic coding sequence
atgtggactgccaggggtccattccgaagggacaggtggtcctctgaggatgaggaagccgctgggccttcccaagcgttatcccctctgctctctgacactcggaagattgtgagcgaaggagagttggatcagctagcacaaatcagacctctgattttcaacttccacgaacagactgcgataaaagattgtcttaaaatcctggaagagaaaactgcagcctacgacatcatgcaggaattcatgacagggacctcacatagtgtgaagcaactccagtttactaagtggcccgaccacggtacacccgcttccgccgattcctttattaagtatatacgctatgccagaaagtcccatctgactggacccatggttgtgcactgcagcgctggtattgggcgtactggcgtatttctgtgcgtggacgtcgtcttttgcgctatcgtgaagaactgcagctttaatataatggatattgtggcacagatgagggagcagaggtctgggatggtccaaacaaaggaacaatatcacttctgttacgacattgtgcttgaggtgttaagaaagcttctgacattggattag

SEQ ID NO: 31039 - DNA, 2529 bp, Artificial Sequence
  Description of Artificial Sequence: Synthetic coding sequence
atgaagcggggtaggttacccagtagttccgaggactccgatgacaatgggagtttaagtacaacctggagtcaaaattccagatcccaacaccgtcgaagctcatgtagccggcacgaggaccgaaagcctagcgaggtgtttcgcaccgatctcattactgcaatgaaactgcacgacagctatcagctgaaccccgatgaatattacgtactggcagatccttggcggcaagagtgggagaagggggtgcaagtacccgtgagccccggaaccatcccgcagcctgtcgctcgcgtagtgtccgaggagaaaagccttatgttcattagacccaaaaagtacatcgttagctccggctctgaacctcctgagctgggctacgttgacattagaaccctggccgattccgtctgcagatacgatctgaacgatatggacgccgcatggttggagttgactaacgaggagtttaaggaaatgggcatgccagaacttgacgagtacacaatggaacgcgttctggaagagttcgagcagaggtgctatgacaacatgaaccatgccatcgaaacggaggaaggattaggaatcgaatacgatgaagacgtggtgtgcgacgtatgtcagtctccagacggcgaggatggaaacgaaatggtgttctgcgataagtgcaacatatgtgtgcatcaggcttgctacgggattctgaaggtcccagaaggctcctggctgtgtcggacctgcgctctcggtgtgcagccaaagtgcttgctgtgccccaagaaaggtggggctatgaaaccaactagatcaggaactaaatgggttcatgttagttgcgctctctggattccagaggttagcattggcagccctgaaaagatggaaccaattaccaaagtatcccacattccttccagtcggtgggccctagtctgtagtctgtgcaacgaaaagttcggagccagcatccaatgctctgtcaaaaattgccgaacggcattccacgtcacatgtgcattcgatagaggcctcgaaatgaagacgatcctagccgagaatgacgaggtaaagttcaagtcctactgtcctaaacactccagccataggaagcccgaggagagcctcggcaagggagcggctcaagaaaacggcgctccggaatgctccccgagaaaccctctcgaaccattcgcctctctggaacagaatagagaggaggcacaccgtgtgtccgtgcgcaagcagaagctgcagcaactcgaggacgagttctacaccttcgtcaaccttttggacgttgccagagctctgaggctgccagaggaggtggtggattttctctaccagtactggaagctgaagagaaaggtgaatttcaataagccattgatcaccccaaagaaagatgaggaggataatctcgctaagagggagcaggatgtgctattcaggcgattacagcttttcactcatctgagacaagacctggaacgtgtccggaaccttacctacatggtcacccgacgtgagaaaattaagagaagcgtgtgcaaggtgcaggagcagatctttaacttgtacaccaagttactggagcaagaacgcgtcagtggggtcccttcttcatgctccagcagttcactggaaaatatgttgctgttcaactctcctagcgttggccctgacgcgccaaaaattgaggacctgaagtggcatagtgcgttctttcgaaagcaaatgggaacttctctcgtgcattcactgaaaaaaccccacaagagagacccattgcagaatagcccaggcagcgagggcaaaacactcctaaaacagccagatttatgcggtaggagggagggcatggtcgtgcctgaatctttcctgggactggagaaaacctttgccgaggcacgcctcatatcagctcagcagaagaatggagtcgtgatgcctgatcatggaaaaagacgagataaccgattccattgtgatcttataaaaggggatttaaaagataagtcctttaagcaatcacacaaaccgctgcggtcgaccgacgtgagtcagcgccatctggacaatacgcgcgctgccacatcccccggagttgggcagtccgccccaggaacaagaaaggagattgttcccaagtgtaatggcagtctaatcaaagtgaattacaaccaaactgctgtgaaggtgccgaccacaccagcatctccagtgaaaaattggggagggtttagaataccgaagaagggcgaaaggcagcagcagggagaagcccatgatggcgcatgccatcagcactctgattacccctacctgggattgggccgagttccagccaaggagcgagccaagtccaaactgaaaagcgataatgaaaacgacggctacgtgcccgacgtcgagatgagcgatagcgaatcagaggctagcgagaagaagtgtatccacacatcatcaactattagccgtcgtacggacataatccgacgctcgatcctggcatcttag

SEQ ID NO: 31040 - DNA, 2490 bp, Artificial Sequence
  Description of Artificial Sequence: Synthetic coding sequence
atggcgaagtataacaccggcggaaacccaaccgaggacgtctctgtcaacagccgacccttcagagtcacaggcccaaatagctctagcggaatccaggcccgtaaaaacttgttcaataaccagggtaatgccagtcccccagccggtccaagcaacgtccctaaattcggaagtcccaaacccccagttgctgtgaagccttccagcgaagagaaaccagacaaggagcctaagcctccattcttaaagccaacgggagcgggtcaacggttcggcaccccagcttcccttactaccagagatccagaagctaaagtgggattcctcaagcccgttggcccaaagcccattaatctcccaaaagaagactctaaacccaccttcccttggcctccaggcaacaaaccttccctgcattccgttaaccaggatcacgacctcaaacccttaggcccaaagtcagggcctaccccacccactagcgaaaacgagcagaaacaggcttttcccaagctaacgggggttaaaggtaaattcatgtctgccagccaggacctggaacctaagcctctattccctaagcctgctttcggtcaaaagcctcctctctctaccgaaaattcacatgaggatgagagtcccatgaaaaatgtcagtagttcaaagggcagtcccgctcctttaggggtgaggtccaaatccggaccattaaaacccgctagggaagattctgaaaacaaggatcatgcaggagagatctcctccctccctttccccggagttgtcctcaagcccgctgcatcaaggggcggtccagggctgtcgaagaatggggaggagaaaaaggaagacagaaagatcgacgccgcaaagaatacctttcagtcaaagatcaatcaggaggagctggcatctggcacaccgccagctcgcttcccaaaggccccttcaaaacttacggtggggggaccatggggacagagtcaggaaaaagagaaaggggacaagaattccgccactccaaaacagaagcctttacctcccctgtttacactcggtcctccacctccaaaaccaaatcggccacctaatgtcgatctcactaagttccataaaacatctagcgggaactcaacgtctaaagggcagacgagctacagtactacctctctgccccctccgccaccgagccaccccgcttctcagcctccccttccagcttctcatccttctcagccccctgttcccagtctgccccctcgcaacatcaaacctccttttgacctcaagagtccagtgaatgaggataaccaggatggcgtgacacactctgacggggcagggaatcttgatgaagaacaggattccgagggggaaacgtatgaagatatcgaagcaagcaaggagcgggaaaagaagagggagaaagaagagaaaaagagacttgaactggagaaaaaagagcagaaggagaaggaaaagaaagaacaggagataaaaaagaagtttaagcttacaggaccgatccaggttatccatctcgccaaggcgtgttgtgatgtgaaaggcggtaaaaatgaactgtcattcaaacagggggaacagattgagataatccgaatcaccgacaatcccgagggcaaatggctaggacggactgctcgcggatcgtatgggtacataaaaaccacagcggtggaaattgactacgatagcttgaaactgaagaaagactccctcggcgcaccgtcccgacccatagaagatgatcaggaagtgtacgacgatgtcgccgaacaagatgacatatccagtcactctcaatcaggctcagggggaatttttccacctcctcccgatgacgacatttacgatgggatagaagaagaggatgctgatgatggcagcacgctgcaggtgcaggagaaaagcaacacgtggagttggggtatccttaaaatgttgaaaggcaaggacgataggaagaagtcgatcagagagaaaccaaaggtctctgactctgacaataatgaggggtcctcatttccggcaccaccaaaacagctggatatgggggatgaggtatacgacgacgtggacacctccgacttcccagtaagcagcgccgaaatgtctcaggggacgaatgtggggaaagcaaagaccgaggaaaaggatctgaaaaagctgaaaaaacaggaaaaggaagagaaggatttcagaaaaaagtttaaatacgacggggaaatccgcgtcctctactctacaaaagtaaccaccagtattacctccaaaaagtgggggacccgagacctgcaagttaaacccggtgaatcattggaagtgatacagacaactgacgataccaaggtactatgcagaaacgaagagggtaagtacggatacgttttgcgtagctacctggcagataacgacggcgaaatctatgatgacatcgcagatggatgcatttacgataatgactag

SEQ ID NO: 31041 - DNA, 810 bp, Artificial Sequence
  Description of Artificial Sequence: Synthetic coding sequence
atgatcgtgaatgactacgaaggaaacgactccgaagctgaagacttgaactttcgcgaaaccttgccctctagtagccaagagaatacgcctcgatccaaggtattcgagaacaaggtcaactccgaaaaggtgaaattgtcgctcagaaacttccctcacaacgattatgaagatgttttcgaagaaccctcagagagtggctcagatccatcaatgtggacagccaggggcccatttagaagggaccgttggagttccgaggatgaggaggcggcaggacccagtcaggctctgagccctttgctctccgacacaagaaagatcgtgtccgaaggggaactagaccagctggctcaaatccgacctctgatttttaactttcacgagcaaacagctatcaaagactgtctgaaaatattggaagagaaaactgctgcgtatgatatcatgcaagagtttatgactggtacttctcactcagttaaacagttgcaatttaccaagtggcccgatcatggtacacccgctagcgctgactcttttatcaagtacattcgttatgcaaggaagtcccacttaacgggtccgatggtcgtgcattgtagtgctggaataggaagaactggagtctttctctgcgtggacgtggtgttttgcgcgatagtgaagaattgttcattcaatatcatggacatagtcgctcaaatgcgggagcagcggtcagggatggtacagacaaaggagcagtaccacttttgctacgatattgttcttgaagtcctccgcaagttgctcactctggactag

SEQ ID NO: 31042 - DNA, 492 bp, Artificial Sequence
  Description of Artificial Sequence: Synthetic coding sequence
atgatgttgggcactgaaggaggagaaggtttcgttgtcaaggtgaggggccttccttggtcttgctctgcagacgaggttcagagattcttctccgattgtaaaattcagaatggcgcacagggaatccggtttatatatacaagggaaggcagaccctccggcgaggcgttcgtggagctcgagagtgaagacgaggtgaaactggctctgaaaaaggacagagagacaatgggccaccgatacgtggaagtgtttaagagcaacaacgtcgaaatggactgggtgctcaagcacacaggacccaactctccggatacagctaacgatggtttcgtcagactgcggggattgccttttggatgctcgaaagaggagatcgtgcagttctttagcggactggagatcgttcccaatgggatcacacttccagtcgacttccagggcaggagtacaggcgaggcgttcgtacagttcgccagtcaggaatag

SEQ ID NO: 31043 - DNA, 759 bp, Artificial Sequence
  Description of Artificial Sequence: Synthetic coding sequence
atggctgcaacggccagggaagacggggctagtggacaggagagaggacagaggggatgtgagcactacgatagagggtgcctgctcaaagccccatgttgcgacaagctctatacatgtagattatgtcacgataacaacgaggatcaccagctggacagatttaaggtcaaagaagtccaatgcattaattgtgagaaaatccagcacgcccagcagacctgcgaagaatgcagcacactgttcggcgagtattactgcgacatatgtcacttattcgataaggataaaaaacaatatcattgtgaaaattgtggaatctgccgcatcggccctaaggaggacttctttcactgtctgaaatgtaacctctgtctggccatgaatttgcagggtaggcataagtgtatagagaacgtgagtcgacagaattgtccgatttgtttagaggacatccatacaagcagggtggtcgcacacgttctcccctgtgggcacctgctgcatagaggatacaggtgcccgctgtgtatgcacagtgcactcgatatgacacgctattggcgccagctggatgatgaggttgctcaaacacccatgccctccgagtaccagaacatgactgtagacattttatgtaatgactgcaatggacggtccaccgtgcagtttcacattctaggcatgaagtgcaagatctgcgagtcctataacacagctcaggcgggagggcgtaggatatccctggatcaacaatag

SEQ ID NO: 31044 - DNA, 594 bp, Artificial Sequence
  Description of Artificial Sequence: Synthetic coding sequence
atgtggaccgctcgtggacctttccggagagaccggtggtcctcagaggatgaagaagccgctggcccttcccaggcccttagccccttgctgtctgacaccagaaaaatcgtctccgaaggagaactggaccagttggcccagattcgccctctgattttcaacttccacgaacagacagccattaaggattgtcttaagatcttggaagaaaaaacggcagcttatgacatcatgcaggagttcatgaccggcacctcgcattccgtgaagcagcttcagtttaccaaatggcccgaccatgggacccccgcaagcgctgattcctttattaaatacattagatacgcgaggaaaagtcacttgacaggtcctatggttgtgcactgcagtgctgggataggccgtacgggcgtgttcctgtgcgtggatgtggtattctgcgccatcgtgaaaaattgctctttcaatattatggacattgtggcccagatgagggaacagcgaagcggaatggtgcagacaaaagaacaataccacttctgttatgacatagttctggaggtgctgaggaagctgctgacactcgattag

SEQ ID NO: 31045 - DNA, 4203 bp, Artificial Sequence
  Description of Artificial Sequence: Synthetic coding sequence
tgaccgccaccacctcccccacccatgtggaatccgatgatccccgcttttgacctgttccagggcaatcatggcttcgtggcccctgtcgtaacgaccgccgctcactggagatcagtaaattacactttccccccttctgtgatcagccacacatccccaactaaagtgtggcgcaataaagacggtacgtcagcatatcaagtacaggagacccccgtgtcccaggtggtcaggaaaaagaccagttatgttggcttggtgctggtgctactcagagggttacccggatccggaaaaagctttctcgctcgaactctccaagaagataatcctagtggggtgatactgtcaactgatgattacttttatataaacggccagtatcagttcgatgtcaagtatcttggcgaggcccacgaatggaaccagaatcgcgctaaagaagctttcgagaaaaaaatttcacctatcattatcgacaacaccaacctccaggcttgggagatgaagccctacgtcgctttatcacagaagcataaatataaggtcctgtttagggaacccgacacttggtggaaatttaaaccaaaagaactcgctaggcgcaatattcatggcgtttctaaggaaaagattacaagaatgctggagcactaccagcgattcgtaagcgtgcccatcattatgtcaagcagtgttcccgagaaaatcgagagaatagaattgtgcgcatactcttgcgaggaccgatccacatccccaagggatgatgaggatattatttcggaaaaagaggaaaacatactaagtctgtctctcaagcatttggaatttacggaggaaaagaatctagacgtgaccaaggagactatgctgccggagaacgtagcttacctgagcaatgcggacctcaataagaggcgaaaggaaataagcgacatgaaccccagcattcagagtgctcttatcctggagactccccacatgtattttagcgacagtgagtccaagctccaagctacagacaagtccgaaaatgagcaaattgagatggtggcagtgaaagggtactctaaaactgatacggactcttccatggaaagggtgtcgccatcaacttgctgctcagagaataatcaggaagattgcgacctagctaactccggccctctccagaatgaaaagagtagtcccggtgaaatcgtcgaggaacgggcaaccgtcaccaagaaggcgttcggcaagcagaaatcaaaatctaccctggagaaatttccgaggcacgaactgtctaatttcgtaggagactggcccgtagataagactataggccagcggacaaagaggaatagaaagacagagaaaactagtagcgttcaatcggacaagaaatacaattaccctcagagccacaaactggttaatagcgtttctgttaataccgattgtgtccaacagcggggttcccctcatgagagcgtcgaagatggacgcaagagtcagtgcgacgatgccagtgagcccctaaattcgtacaagtatgacgcctataaaaacatagataaaaacagcttcaatatcatgggggactggcccagctctgactcacttgctcagagggaacaccggtctagaatgcccaagaccggcctgagcgaacctaacctggagatcggtacgaatgacaaaatgaacgaaatcagtttgagcacggctcacgaagcctgttggggcaccagcagccagaaattgaagactctcggcagctctaacttagggtcttccgagatgctcctgtccgagatgacatgcgagtcacagacctgcctgagcaaaaaatcccacggccagcatacatcactccctcttacttttacaaactccgctcctacagtgagtggagtcgtggaaccacagacactcgccgaatgtcaggaacagatgccaaagagggatcccggaaaagaggtcgggatgtgtacccagaccgaaccacaagatttcgcactgctttggaagatcgaaaagaataagatttccatttcagattctatcaaggtcctgaccggacgcttagacgggttcaaaccaaaggtcttcaatattaacaccaaatctgatgtgcaagaggccatcccatacagggtgatgtatgacaaatcaacttttgtggaggagagcgagctgaccagtgccgatgagtctgaaaacctaaacatcctgtgtaaactgttcggctccttttctctggaggcattgaaggacctctacgagcgctgtaacaaggacattatttgggccaccagtttgctgcttgattccgaaacgaagctctgcgaggacaccgagttcgaaaattttcagaaaagctgtgatggcagccagatcgggcctttctccctcggactgaatctcaaagagatcatctcacagagaggtacattggagaacagcaatagccctgtccctgagttcagccacggcattgggatttcgaacgcagacagtcagtcaacctgtgacgcggaacgaggcaattcagagcaggccgagatgcgcgcagtgactcctgaaaatcatgaaagtatgacatcaattttcccaagtgccgctgtggggctgaagaataataatgacatactccccaactctcaggaggagctgctgtacagcagcaaacagagtttcccagggattctgaaagccacaactcctaaagatatgagtgaaaccgagaaaaacctggtggtgacagaaacaggggataatattcactctccaagccacttttccgatatatttaattttgtgtcatctacctcaaatttggaattaaacgaggagatctatttcacagacagcctggagatcaaacggaatgagaactttcctaaggactatgtaaaatttagcgatgaggaggaatttatgaacgaagacgagaaagaaatgaaagagattctgatggctggctccagcctgtccgccggagtgagcggagaggataaaacagaaattctgaatccaacacctgcaatggccaaatcactcacaatcgactgcctggaattagctctaccccctgagctggcgttccagctaaacgagctgtttggcccagtgggcatagatagtggcagcctgactgtggaggattgcgtggtgcatatcgacctcaatcttgctaaagtcatccacgagaagtggaaagagtccgtcatggagcggcagcgtcaggaagaagtctcctgcggcaagtttatgcaggatccttccttggttgggcatacggggctggataacccagagcagaagtcttcacaaaggactggaaagaagctcttgaagacccttactgcctctgagatgctgccactccttgatcactggaatactcagaccaagaaggtgtcccttcgcgagataatgagcgaagaaatcgctctccaggaaaaacataatctaaaacgcgagacactgatgtttgagaaagattgcgctactaagctgaaagaaaaacagctttttaaaatttttcccgcaatcaaccaaaacttcctggtggatatcttcaaagatcataactatagtctggagcatacagtgcagtttctcaactgcgtgctggagggcgatcccgtcaaaacagtggttgcacaggaattcgtgcaccagaacgagaacgtcacctcacatactggccagaagtctaaagagaagaaggattttgaatatcccgattacgacgattaccgcgcagaggccttcctgcatcagcaaaagagaatggagtgctattcgaaagcgaaagaggcttatagaatagggaaaaaaaacgtagccactttctatgctcagcaaggcaccctgcacgagcagaaaatgaaagaggctaatcacctagcggctatcgagatattcgagaaggtcaatgcctctcttttaccccagaatgtgctggacttgcacggtctccatgtggacgaggccttggaacatttgatgagggtgctggagaaaaagaccgaagagttcaagcagaacggagggaaaccctatctgagcgtgattacaggaagaggaaaccatagtcaaggaggcgtagcccgaatcaagccagccgtgatcaaatacttgatcagtcactccttcaggttttcagagatcaagcccggatgccttaaggtaatgttaaaatag

SEQ ID NO: 31046 - DNA, 237 bp, Artificial Sequence
  Description of Artificial Sequence: Synthetic coding sequence
atgctatgctggggctactggagcctggggcagcccggtataagcacaaacctgcagggcatagtggcagaaccccaggtgtgcggttttatttcagatcgctcggtgaaggaagttgcttgtggtggtaaccactcagtatttctgctggaagacggcgaagtgtacacatgcgggctcaacacaaagggccagctgggccacgagcgcgaaggaaacaagcccgagcagatttag

SEQ ID NO: 31047 - DNA, 738 bp, Artificial Sequence
  Description of Artificial Sequence: Synthetic coding sequence
atgaacggacgtgcagatttccgcgagcccaacgctgaggttccaagacccataccacacattgggcctgactatatcccaaccgaggaggaacgccgagtgttcgccgaatgtaatgacgagtccttctggtttaggtccgtaccactcgcagctacttcaatgctcattacacaaggccttatctccaaaggaatcctgagttcccatccgaaatatggctcaattcctaagctgattctcgcatgcatcatggggtacttcgctgggaaactgtcatacgtcaaaacttgccaggagaaattcaagaagttggaaaacagccccctaggggaggctctgagaagcgggcaagcccgaaggagttctccaccaggacactactatcagaaatcgaaatatgacagcagcgtgagcggtcaatcatctttcgtgacctcgcctgccgctgataatatcgagatgttgccccactatgaacctattcccttctccagctctatgaacgagtcagccccaacaggtatcacggaccacatcgtacagggacctgatccaaatttagaggaaagtccaaagaggaagaatattacatacgaggaattgcgcaataagaacagagagtcttatgaagtgagtttgacccaaaaaaccgatccttccgtaaggcctatgcacgagcgggtgcctaaaaaggaggtgaaggtaaacaaatatggtgacacatgggatgagtag

SEQ ID NO: 31048 - DNA, 2112 bp, Artificial Sequence
  Description of Artificial Sequence: Synthetic coding sequence
atggaggcgctgcttgaaggaatccagaacagaggacatgggggtgggttcctcacttcttgtgaggctgaactgcaagagctgatgaaacagatcgacatcatggttgcccacaagaagtctgaatgggaaggcaggactcatgcactggagacgtgtctgaagattagagagcaagagctgaagtccctgagatcccagctcgatgttactcacaaagaggtgggaatgctccatcagcaagtagaagagcacgagaagataaaacaggagatgactatggagtataaacaggaactgaagaagcttcacgaggagttatgtatcctcaagagatcttatgagaagctccagaaaaaacaaatgcgcgaattccgagggaacacaaagaaccatcgggaagaccgcagtgagattgaacgattgacagcgaaaatagaggagttcaggcagaagagtttggactgggaaaagcagaggctcatctaccagcagcaggtgagcagccttgaagctcaacgaaaggctctggccgagcagtctgagatcattcaagcccagctggtgaaccgaaagcaaaaattggagagcgttgagctctcctcacagtctgagattcagcacctcagcagcaagttagaacgcgctaatgacacaatctgcgccaacgagttggagattgaaagacttacgatgcgggtcaacgacctggtgggaacctctatgaccgtcctacaggagcagcagcagaaggaggagaagctgagagagtctgaaaaactgctggaggccctacaagaggagaagcgggagcttaaggccgcactccagagccaggagaatttaatccatgaagccagaatccagaaagagaagctgcaggaaaaggtgaaggcaactaatactcagcatgctgtggaagccattcgcccaagggaggagagtctggccgagaagaagtacacgtcacagggtcagggggaccttgatagcgtactttcgcagctcaactttactcatacatccgaggacctgctgcaagccgaagtgacatgcctggagggatcgctggaatccgtatccgcaacctgcaagcagctttcgcaggaactaatggaaaaatacgaggagcttaagagaatggaagcacacaacaacgaatataaggccgaaatcaaaaagctgaaggagcaaatcctgcaaggagagcagtcctactcttccgctctggaaggcatgaagatggagattagtcacctgacccaggaactacaccaacgcgacataactattgcaagtacgaagggcagctcctctgatatggagaagcgcctccgggcagagatgcagaaagcggaggacaaagccgtggagcataaggaaatactggaccagttagaatccttaaagcttgaaaatcggcatttgagtgaaatggtgatgaagctcgagctgggcctccacgaggctaaggaaatttcactcgccgatctacaagagaattatatcgaggccttgaataaattagtttcagagaatcaacagctgcaaaaagatctgatgaatacaaagtctcaattagaaatcagtacccagatgtgtaagaagcagaatgaccggatctttaaacccacccacagcaggaccacggagttcaagaacactgaattcaagcctacacacggtcagcaccgacacgacggcatcaagaccgagcactataaaacagatttgcactccccacgtggacaagcctccgactccatcaaccctatgagtagggtgttaagcccactgtcgccacagatatctccatgcagttcaacaaggtcactgacaagttattcactgtgcaagacccatagcctgccttccgctctggacacaaatgaggctaactttagcgacacaatgtcagagagtatgaatgaccaggaggaattcatctccagctgttcacttcctgtatctccactcgggagtatcgccacacgattcctcgaggaagaagaactaagaagtcatcacatattagagcgattagatgcgcatatcgaggagctgaaaagagaatcagagaaaaccgtgaggcagtttacagctctcaagtag

SEQ ID NO: 31049 - DNA, 573 bp, Artificial Sequence
  Description of Artificial Sequence: Synthetic coding sequence
atggccggaaccgccagacacgaccgagagatggcaattcaggcaaaaaaaaaacttacgactgctaccgatcccattgagaggctccggctacagtgcctggcccgtgggagtgccggtattaagggtctgggcagggtgttcaggatcatggatgatgataacaaccgcaccctcgacttcaaggagtttatgaagggtctcaacgactacgcagtcgttatggagaaagaggaggttgaggaactatttagaagattcgacaaagatgggaacggaaccatcgacttcaacgaatttctgcttactttgcggccacccatgtcccgcgctagaaaggaagtcattatgcaggcctttcgcaaactggacaagacgggcgacggggtaatcaccatcgaggacctccgcgaggtttataacgcaaagcaccatcctaagtaccaaaacggtgagtggtcagaggaacaggtgtttagaaagttcctcgataattttgatagtccgtatgataaagacgggctcgtcacccctgaagagttcatgaattattacgccggtgtaagcgcatag

SEQ ID NO: 31050 - DNA, 231 bp, Artificial Sequence
  Description of Artificial Sequence: Synthetic coding sequence
atgacccccccacagcagcctccgcctttgcggagcgaacccggtaccctcggatccgctgctagcagctactcaccactggggttaaatggggttcccggatccatttgggatttcgttagcggttctttctccccatccccatcacctatcctctcagccggtccccctagctcatcatcagccagccctaacggcgcagagttagccagggtgcgcagacagttgtag

SEQ ID NO: 31051 - DNA, 108 bp, Artificial Sequence
  Description of Artificial Sequence: Synthetic coding sequence
atggccaccttggtcgtaaacaagctcggcgctggggtggactcaggacgacagggtagcagggggactgctgtggtcaaggtgctggaatgcggcgtgtgcgaatag

SEQ ID NO: 31052 - DNA, 477 bp, Artificial Sequence
  Description of Artificial Sequence: Synthetic coding sequence
atggaggccgacatcatcacaaatctgaggtgtagactgaaggaggctgaagaggagcggttgaaggcagctcagtacggtctgcagctggtagaatcccaaaacgagttacagaaccagctcgacaagtgcagaaatgaaatgatgacaatgaccgagtcttacgaacaggaaaaatacacactccaacgggaagtggagctgaagagcagaatgcttgagagccttagctgcgagtgcgaggcaatcaaacagcagcaaaagatgcatcttgagaaactggaggagcagctgagcaggagccacggacaagaagtgaacgagctgaagaccaaaatcgaaaagctgaaggtagagctcgacgaggccagattgagcgagaagcagctgaagcaccaggtggaccatcagaaggagcttttgtcctgtaaatctgaagagctgagggtgatgtccgaaagagtgcaggaaagctag

SEQ ID NO: 31053 - DNA, 393 bp, Artificial Sequence
  Description of Artificial Sequence: Synthetic coding sequence
atggcacagacagataaaccaacctgtatccccccagaactgcctaaaatgttgaaagagttcgcaaaggccgctatacgcgcacagccacaagaccttatccagtggggcgctgactattttgaggccctgtctaggggggagaccccacctgtccgggaaagaagtgagcgtgttgccctatgcaattgggccgagctgactccagaactgctgaaaatactgcattcccaggtggccggacgccttattatccgagccgaggaactggcccagatgtggaaagtcgtcaatctgcccactgatttgttcaactctgtgatgaacgtgggtcgctttaccgaggagattgaatggcttaagttcttggcattggcgtgcagcgcactttag

SEQ ID NO: 31054 - DNA, 693 bp, Artificial Sequence
  Description of Artificial Sequence: Synthetic coding sequence
atggaagctgacataatcacaaatctgcggtgccgtctgaaggaggccgaggaggagaggctgaaagcggctcagtatggcctgcagctggtcgaaagccaaaatgaattacaaaaccaactcgacaagtgccgaaacgagatgatgactatgacggaatcatacgagcaggagaaatatacgctacagcgagaggtggaactcaaaagccgaatgctggagtcactgagctgcgaatgcgaagctattaaacagcagcagaaaatgcacctcgagaaactggaggaacagctgagcagatctcacggccaagaagtgaatgaactgaagaccaaaatcgaaaaactgaaagttgagttggacgaagcccgtctgtccgaaaagcaactgaagcatcaggtagaccatcagaaagagctactatcctgcaagagcgaggaattacgggttatgtccgagagagttcaggagtctatgagtagtgagatgttggctctacagattgaactgaccgagatggagtcaatgaagacaacactgaaagaagaggtaaatgagctgcagtatagacaggagcaattagagctgctaatcactaatcttatgcgacaggttgaccgcctcaaagaggagaaagaggagagagagaaggaagccgtctcctactacaatgcactggaaaaggcaagatag

SEQ ID NO: 31055 - DNA, 639 bp, Artificial Sequence
  Description of Artificial Sequence: Synthetic coding sequence
atggcccagacagataagcccacttgcattccccctgagttgccaaaaatgctgaaagagtttgcgaaagcagcaattcgcgctcaaccacaggatctaatccagtggggcgctgactacttcgaagccctgtccaggggtgaaacccctcctgtcagggaaagaagtgagagagtggcactgtgtaactgggcagagctgacgcccgaactcctgaagatcctacactcccaggtagctggcagactaattatccgcgctgaggagttggctcagatgtggaaagttgtgaatctaccgactgacttgttcaactccgttatgaacgtgggccgatttaccgaagaaatcgagtggctgaaattcctggcccttgcctgtagtgccctgggcgtcaccatcacgaagaccctgaagattgtctgtgaagttctgtcgtgtgatcataatggaggactgccaaggattcctttctccacatttcaattcttgtatacatacatcgcagaggtagacggtgagatctgtgcatcccacgtgtcccggatgctcaactacatcgaacaggaggtcattggcccagatggcttaataacagttaatgattttacccagaacccgcgtgtgtggctcgagtag

SEQ ID NO: 31056 - DNA, 2844 bp, Artificial Sequence
  Description of Artificial Sequence: Synthetic coding sequence
atgaatttcctgcgcggagtgatgggcggacagagcgccggtccacaacacaccgaggcagagacagtgcggggagctgccgatccaaaagttacttcctcatgcgggctcaaatttaggcacagctttcgcctcgtgaagcacattttgtaccatgtgacgattaacgtttatagcgatagtgaaatcattgggtacgccctcgatactctgtataacatcatcagcaatgaggaggaagaagaagtggaagagaactctacgcgccagtccgaggatttgggcagccaattcaccgagatctttattaagcaacaggagaatgtcaccctcctactgagtctcctagaagagttcgattttcacgtccggtggccgggagttaagctcctgacttcactcctgaagcagctaggcccacaggtgcaacagataatcttggtgtctccaatgggggtgagcaggttgatggacctcttggccgattcacgtgaagtaatccggaatgacggagtcctgctgcttcaggctctgacacgctctaatggagccatccagaagatcgtcgccttcgaaaatgcatttgaacggttgctagacataatctctgaagaaggtaattctgacggtggcatcgtcgtcgaagattgtctgatcctgctacagaatttactgaaaaataacaacagtaaccaaaattttttcaaagagggatcttacattcagaggatgaaaccatggttcgaggtgggcgatgagaacagtggctggtccgcgcagaaagtaactaacttgcacctgatgttgcagctagtacgcgttttagtctctccaacaaaccccccaggcgcaacaagctcctgtcaaaaggctatgttccagtgcggcttgctacaacagctgtgtaccattctgatggctacaggagtgcctgcagatatactcactgaaacaattaatacagtatctgaggtgatccgagggtgtcaggtcaaccaggattatttcgcttcagttaatgcaccatccaatcctcccaggccagcaatcgttgtactgctcatgtctatggtgaatgagcggcagcctttcgtgctccgttgcgccgtcctgtattgctttcaatgtttcctctataagaaccaaaaaggtcaaggagaaattgtgtcgacactgttaccttctaccattgatgccaccggaaacagcgtgtccgccggacagttgttgtgcggtggcctgtttagcactgacagcctgtcaaactggtgcgcagccgtggccttagctcatgctctgcaagaaaacgctactcagaaggaacagcttctgcgcgtgcagcttgccacctctattggcaaccccccagtttctctcctgcaacagtgtactaacatactgagccaaggctccaagattcaaacgcgtgtggggctcttaatgttactctgcacatggttatccaattgtcctatcgccgttacccacttcctgcacaatagcgctaatgttccattccttacaggtcaaattgctgaaaatttaggagaggaggagcagttggtgcagggtctctgcgccctgttgcttgggattagtatttacttcaacgacaattctctggagtcatacatgaaggaaaaactgaaacagcttatcgagaagagaatcggcaaagagaactttatagagaagctgggattcatcagtaagcacgagctctatagccgcgcatcccagaaacctcagccgaactttccctcccctgagtacatgattttcgatcatgagttcaccaaactggttaaagagttggagggagtaattaccaaggcaatctataaaagttctgaagaggataagaaagaagaagaagtgaagaaaactttggagcaacacgacaacattgtgacccactacaagaatatgatacgcgagcaggacctgcagttggaagaactgcgccagcaagtgtcgaccctgaagtgtcagaacgagcagcttcaaaccgccgtgacacaacaggtctcgcagatccaacagcataaagatcagtacaatctcctgaaaatccagctggggaaagacaatcagcatcaaggctcctacagcgagggagctcaaatgaacggaatccaacccgaagaaattgggcgtcttcgcgaggagattgaggaacttaaaaggaatcaagagcttctgcagagtcagttaacggaaaaggacagcatgatcgagaacatgaaatcctcacagaccagcgggacaaacgagcagagttcagcaatcgtatctgccagagatagcgagcaagtcgcagagttgaaacaggaactggcaactctgaagagccagctgaattcacagtcagtggagataacaaagctgcaaacagagaagcaagagttgttgcagaaaaccgaggctttcgctaagagcgttgaggtgcagggggaaaccgaaaccattatcgctacaaagactacggacgtggaaggacgactgtcagctcttctgcaagagactaaggagctgaagaacgagataaaagcactcagtgaggaacgcaccgccatcaaagaacagctggacagttcgaacagcaccattgcaattttgcagaccgaaaaagacaagttggagctggagataaccgattcaaagaaagagcaggatgatctactggtgctcctagcggaccaggatcagaaaattctgagcttaaaaaacaaactgaaggacctcggccatcccgtggaggaagaagacgaacttgagtctggggatcaggaggatgaggacgacgagtcagaggatccgggaaaagatctggatcatatctag

SEQ ID NO: 31057 - DNA, 1095 bp, Artificial Sequence
  Description of Artificial Sequence: Synthetic coding sequence
atggtcaaactcttcattgggaatctaccacgggaagctaccgaacaggagattcgctccttgttcgaacagtatgggaaggtgcttgagtgtgacatcatcaagaattacggctttgtccatatcgaggataaaacagcagcagaagatgccataaggaacttgcatcactataagcttcacggtgtaaacatcaatgtagaagcgagtaaaaacaagtccaaaacttctacaaaactccacgtgggtaacatcagccctacctgcacaaacaaagagcttcgggctaaattcgaagaatacggaccagtcatagaatgcgatattgtcaaggactatgcatttgtgcatatggagcgagctgaggacgcagttgaggctatcaggggtcttgataatacagaattccagggcaaaaggatgcacgtgcaactgtctacctcaaggctcagaaccgcaccaggaatgggcgaccaaagcggctgttatcggtgtgggaaagagggtcactggagcaaggaatgcccaattgatagaagcggcagggtggccgacctcacagaacagtacaatgaacagtacggtgctgtgaggaccccatacactatgtcttacggtgatagtctgtactacaacaacgcatatggggctcttgacgcctattacaaaaggtgcagagcggctcggagctacgaagcagtggccgcagccgcagcgtccgtgtacaactacgccgagcaaacattatctcagttgccgcaagtccagaataccgctatggccagccatttaacatcaacatccctagatccctacgaccgacacctgttgcctactagcggcgctgctgctaccgcagcggcagccgcagcagccgctgctgctgtcacggccgcatctacctcttactacggccgtgatcggagccctctccgaagagccacagctcctgtacccaccgtgggggaggggtatggctatggccacgaatccgaattgtcacaagcaagtgcggctgccagaaattctctctacgacatggcccgttacgagcgagagcaatatgctgatagggcccgatactccgcgttttag

SEQ ID NO: 31058 - DNA, 1236 bp, Artificial Sequence
  Description of Artificial Sequence: Synthetic coding sequence
atgattgttaatgactacgagggcaacgatagcgaagctgaggacctgaattttagggaaaccctaccaagtagctcccaggagaacactcctagaagcaaagtgtttgagaacaaagtaaactccgagaaggtgaagcttagtctcagaaatttcccgcataacgactatgaggacgtttttgaagagccctctgaaagcggaagcgatccatccatgtggaccgcacgaggaccgttcagaagagatcgatggtcgagtgaggacgaggaggccgctggaccttctcaggccctgtccccactgctgtccgatactaggaaaatagtgtcagaaggggaactggaccaactggcccagatccggccactaatcttcaattttcacgagcaaactgctatcaaagattgccttaaaatcctggaagagaaaactgctgcctacgatatcatgcaggagttcatggctcttgaactgaaaaatctgcccggagagttcaacagtggcaatcagccttccaatcgggagaaaaatcgctacagagatatcctcccatacgactcgacgagggtgcctctgggtaagagcaaagactacatcaatgcctcttatatacgcatagttaattgcggtgaggaatacttctatattgccacgcagggacccctgctgagtaccatcgatgacttctggcagatggtcctggagaataactccaacgtcatcgccatgattacgcgcgagatcgaaggtgggatcatcaagtgctaccactactggccaatttcgttaaaaaagccccttgaactgaaacatttcagagtgttccttgagaattaccaaatactgcaatattttataattagaatgtttcaagtggtggaaaaatccacggggacttcccacagtgtgaaacagttgcagtttacaaagtggcctgatcacgggacccccgcaagtgctgactcttttattaagtatatccgatatgccagaaagagccacctaacaggtcctatggtggtccactgttcagcgggaatcggccgaaccggggttttcttgtgtgtagacgtggtgttttgtgcaatagttaaaaactgcagtttcaatatcatggacattgtggcccagatgcgtgagcaacgctccggaatggttcagaccaaggagcagtaccacttttgttacgatattgttctggaggtactgcggaagctgttaaccttagactag

SEQ ID NO: 31059 - DNA, 810 bp, Artificial Sequence
  Description of Artificial Sequence: Synthetic coding sequence
atgatcgtgaacgactacgaagggaatgacagcgaggccgaagacctcaacttccgcgagacactcccatccagctcacaggagaatacacctaggtccaaggtgtttgagaataaagtgaattccgagaaggtcaagctcagtttgcgcaactttccccacaacgactatgaagacgtgtttgaggagccttctgaatcgggatctgatccttcgatgtggaccgccagaggcccattccgccgtgaccggtggtccagcgaggatgaagaagccgctggacccagtcaggccctgagtcccctactttctgatacccgtaaaatcgtgtctgaaggcgagcttgatcaactagcccagattcgacccttaattttcaattttcacgagcagacggcaattaaggactgtctgaagattttagaggagaaaacggcggcttatgacattatgcaggagtttatgacgggtacttctcacagcgtgaagcaactgcagtttacgaagtggcctgaccacggaactcccgctagcgccgattcatttattaaatacatcaggtacgcacgtaaaagtcacctgacaggaccaatggtcgtccattgttccgctggtatcggtcggactggagtttttttgtgcgtagacgtggtgttttgcgcgattgtgaaaaactgctctttcaacattatggacatcgtggcacagatgagggaacagagaagtggaatggtccagactaaagaacaataccacttttgctatgatatagtgctggaggtcctcagaaaactgctgaccctcgactag

SEQ ID NO: 31060 - DNA, 360 bp, Artificial Sequence
  Description of Artificial Sequence: Synthetic coding sequence
atggcttcgcagctgcaagttttttcaccaccatcagtgagttcaagcgctttttgttccgctaagaaactgaagatagagcctagtggttgggacgtgtctggccagtcgagcaatgacaaatactacacacatagtaaaacgctgccggctacacagggacaagctaattcatctcaccaggtcgccaacttcaacatccccgcttacgaccaaggcctcttactgccagcaccagcagtagaacatatcgtggttaccgccgcagattcttcaggctccgcggctacctctacgtttcagtcatcccaaaccctgactcacaggagtaatgtttcactgcttgagccgtatcaatag

SEQ ID NO: 31061 - DNA, 339 bp, Artificial Sequence
  Description of Artificial Sequence: Synthetic coding sequence
atggctactggcgatttaaaacgcagccttcgaaatctcgagcaagtactgaggttgctaaactatcccgaagaggtcgattgcgttggactcattaaaggggaccccgctgcatccctgccgatcatttcctactcctttacaagttactcgccctacgtgaccgagctgattatggagagcaatgttgagcttatcgccaaaaatgacctgagattcattgatgcagtatataaactgctccgtgatcagttcaactacaaacccatcttaaccaagaagcagttcatccagtgtgggtttgctgagtggaaaatccaaatcgtatgtgatatctag

SEQ ID NO: 31062 - DNA, 54 bp, Artificial Sequence
  Description of Artificial Sequence: Synthetic coding sequence
atgaagcgtggtcgcttgccatcttcctctgaagacagcgatgacaatgggtag

SEQ ID NO: 31063 - DNA, 810 bp, Artificial Sequence
  Description of Artificial Sequence: Synthetic coding sequence
atgaatcaagaggacctggaccctgattctacaactgacgtcggggacgtcactaataccgaggaagaactcatccgggagtgtgaagagatgtggaaggatatggaagagtgccagaacaagctgagcctgattggaactgagacgttgaccgatagcaacgcccagctgtccctcctgatcatgcaggtcaaatgtctcaccgcggagctttctcaatggcagaaaaagactccagaaaccatcccgctgactgaggatgtcctcattacactcgggaaggaagaatttcagaagcttaggcaggacctggagatggttttgtccacaaaagaaagcaagaatgaaaagcttaaagaggatctcgaaagagagcagcgctggttagacgagcaacaacagattatggagagcttaaacgttctacactctgagctgaagaataaagtggaaaccttttccgagagtcgtatattcaatgaactgaagacgaagatgctaaacattaaggaatacaaggagaaattgctgagcacactgggcgaatttttagaagaccactttcccctgccagacagatcagtgaaaaaaaagaagaagaacattcaagagtctagcgtgaatctgatcaccctccatgagatgctggaaatactcattaaccgactcttcgatgtacctcacgacccctatgtgaaaattagtgactctttctggccgccatacgtggaactactgctccgtaatggcatagccctgcggcaccctgaagatcctacccgaattcgcttggaggcgttccatcaatag

SEQ ID NO: 31064 - DNA, 339 bp, Artificial Sequence
  Description of Artificial Sequence: Synthetic coding sequence
atgaacgggagggcagacttcagggagcccaatgccgaggtccctcgcccaatcccccatataggacctgattacatccccactgaggaggagaggcgggtcttcgccgaatgcaatgatgagtccttttggttcaggtctgtacctctcgccgcaaccagcatgctcattacgcaggggctcatctctaagggcatcctatcttcgcacccaaaatacggctccatcccgaagctgattctggcgtgcattatggggtattttgcgggaaagctcagttatgtgaaaacatgccaggagaagttcaagaagctggagaacagtccattaggggagtag

SEQ ID NO: 31065 - DNA, 687 bp, Artificial Sequence
  Description of Artificial Sequence: Synthetic coding sequence
atggaggagcagccccaaatgcaagatgcggatgagcccgcagacagcggtggcgaaggccgagccggtggcccacctcaggtcgctggggctcaggccgcttgttccgaggacagaatgacactcctcctcaggctgagagcccagaccaagcagcagctgttggaatataaatctatggtggatgccagcgaagaaaagacacctgagcagatcatgcaggagaagcaaattgaggcaaagatcgaggatctggagaatgagatcgaggaagtcaaggttgcattcgaaataaagaagcttgcccttgattctgttctcatggacaacatgaaacacttattggagctgaacaaacttatcatgaagagccaacaagaatcatgggacctggaggagaagcttctagatatacgaaaaaagaggttgcagctcaagcaggcgagcgagtccaagctgttggagattcaaaccgagaagaacaagcagaagattgatctggattccatggaaaatagtgagagaatcaagattattcgccagaatctccagatggagataaagatcactaccgtgatccagcacgtctttcagaacctgattctgggatcaaaggtgaactgggctgaagatcctgcccttaaagaaatcgtcctgcagctcgaaaaaaatgtggacatgatgtag

SEQ ID NO: 31066 - DNA, 2352 bp, Artificial Sequence
  Description of Artificial Sequence: Synthetic coding sequence
atggccaagtataatactggcggtaaccctacggaagatgtaagcgtcaactcaagacctttcagggttaccgggccaaacagctctagcggcattcaggctcggaagaatctgtttaacaaccagggaaatgcctctccccctgccggtccgagcaatgtgcctaaattcggatcccctaaaccgccagtagctgtaaaacccagtagtgaagagaaacctgacaaagagccaaaaccgccatttctgaagccaacaggcgcagggcaaaggttcggaactcctgcttcccttaccacaagagaccccgaggctaaagtgggatttctgaaacccgtaggcccaaaacccattaacttaccaaaagaagatagcaaacccacctttccctggccacccggaaacaagccaagcttgcactccgtgaaccaagatcacgatctcaagcccttgggacctaaatctggaccaactccacctacatctgagaacgaacagaaacaagcatttcccaagctgaccggagtgaagggcaaatttatgtcagcatcacaggaccttgagccaaagcccttgtttccgaagcctgcattcggccagaagcctccgctgagtacggagaactctcatgaggatgagtctcctatgaagaacgtctctagctctaaagggtcccctgcccctctgggcgtacgctcaaagagcggcccattgaagccagccagagaggactccgagaacaaagaccacgccggagagatcagcagcctccccttcccaggcgtcgtgttgaagccagccgcatcccggggagggcctggtctcagcaagaacggagaagagaaaaaagaagatagaaagatcgatgccgctaagaatacattccagtctaagattaaccaggaggagctggcttccggcactcctccagcccgtttccccaaggcgcctagtaagcttactgttggaggcccttggggccagagccaggagaaagagaaaggagataaaaactctgccacccccaagcagaagcctctgccaccattgttcactctcggaccaccgccacctaagccaaaccgccctcccaatgtcgatctcacgaagttccacaaaacaagtagcggcaacagcacaagtaaaggccagaccagttatagtacgacgtccctgcctcctccacccccatctcaccccgcatcccaaccaccactgcccgcttcacaccctagccaacctcccgtgccaagtctaccccctcgaaacattaaaccgccatttgacctgaagtcgcctgtgaatgaagacaatcaagatggtgttacacatagcgacggagccggtaacctagacgaagaacaagactccgaaggcgagacctatgaggacatagaggcaagcaaggagcgcgagaagaagcgcgagaaggaggaaaaaaagcggctggaactcgaaaaaaaggagcagaaagaaaaggagaaaaaggaacaggagatcaaaaaaaagttcaaactgaccggccctatccaagtgatacatctagccaaggcttgctgtgatgtcaaggggggtaaaaatgaattgagctttaagcaaggggaacagattgagatcattcgtatcaccgataatccagagggcaaatggctgggtagaacagccaggggctcttacggttatatcaaaacgacggccgtagagatcgactacgactctctcaagctgaaaaaggattccttgggcgcaccctcaaggcctatcgaagatgatcaggaggtgtatgacgacgtggctgagcaggacgacatatccagtcatagtcagtccggatcggggggtattttcccaccacctccggatgacgatatatacgacggcattgaggaagaggacgccgatgacgggtttcctgctccgcctaagcaactggatatgggggatgaggtgtacgatgatgtggacacctccgatttccctgtgtccagcgccgagatgtctcagggaaccaacgtcggcaaggcaaaaaccgaggagaaggatctcaaaaaactgaagaagcaggaaaaagaagaaaaagatttcaggaaaaagtttaagtatgatggggaaatccgggtcctgtacagtacgaaagtcacaacctccataactagtaaaaagtgggggacacgggacttgcaggtgaagccgggagagtcccttgaggtcatacagaccacagatgacacaaaggtcctgtgccggaacgaggagggcaagtacggctacgtcctccggtcttaccttgccgataatgacggggaaatctacgatgacatcgcagacggatgcatctacgacaacgactag

SEQ ID NO: 31067 - DNA, 393 bp, Artificial Sequence
  Description of Artificial Sequence: Synthetic coding sequence
atgatgctgggaaccgaaggaggagagggctttgtggtgaaagtgcgcggattaccttggtcttgttctgctgatgaagtccaaagattctttagcgactgtaaaatccagaacggcgctcagggtatccgctttatctacaccagggaagggaggccaagcggtgaggcttttgtggagctggaatctgaggatgaggtcaagctcgcattaaagaaagaccgagaaacaatggggcatcgatatgtcgaagtgtttaaatccaataacgtcgaaatggattgggtgttaaagcacaccggccctaattcacctgataccgcgaatgacggcttcgtgcggctgcggggtctccctttcggatgttctaaggaagagatcgtgcagttctag

SEQ ID NO: 31068 - DNA, 267 bp, Artificial Sequence
  Description of Artificial Sequence: Synthetic coding sequence
atggaggcagatatcattactaacctccgctgccgactgaaagaagccgaagaagagcgcctcaaggccgctcagtacggtctgcagttagtggaatctcagaatgaactgcagaaccaacttgataagtgcagaaacgagatgatgaccatgaccgaatcatacgagcaggaaaaatacacactccaacgggaagtcgagctcaagtcgaggatgcttgagagcttgtcatgcgagtgcgaagccattaagcagcagcagaagtag

SEQ ID NO: 31069 - DNA, 1902 bp, Artificial Sequence
  Description of Artificial Sequence: Synthetic coding sequence
atgaaggctataaaaaaatctcttactgaggaagaatacctctacctggactttagccatcagaccgagggctgtatcttccctctgcacacttcggtaactttgtttttgttgtcctactgtgactgcaagatctttaaaatatgtcttgtcgtaacgaaagaagtcagcagagatagctctctgctgcgggatgatctgatccaggatgtggagatccagataatctcgcgccaggagttgccacctatcgtacaaaattgctgtctgccagccgtggtcgaacgctctgacaacttttgtcgtgccggacttgccgtagttctgaggcatatcatccagaagtcctacgaggccgaccctctgaaaaaggagctgttggagcttctgggtttcaagaaaacttgcctcaaggcctgcgccgaggtcagccagtggacgcgcctatgtgaacttaccatccccctggcgatcgagaacttcctccgtgagtcctccgatcagccaccaacaatacccgttgaaatcctccagctggagaagaaactctcagaacctgttcgagttcacaatgacgacaagctgagacgccagaaactcaaacagcagaaggccgatggagtgggccctcccctaaccaagggcaaggccaagtccaaggtacatacccaggaaactagcgaggggcttgatagttctagcaagtctcttgagttgaaagtggcattttcgaaactgactgtacaggaggaaccggctacaaccaatcgggagccaagccatatccgaaaagctaaggctagtgatttgccgccactcgagcacgtctttgccgaaggcctctattttacactggcagacatcgtgcttctgccctgtatacaccactttctggttattatcagtcgcaagttctcagagaagctggtcgagttccctctcctggcgagctggtatcagcgcatccaggaagtccccggagtgaaaacagctgccagcaagtgcggaatccaattcctccatcttccaaagctgctgactacttcgactgaacagcacccaaacttgtgtgaggtgcccggagttgaggaacagagcgaccccctgttcataggcggtcccaggcccacaatggctaagctgatggagaagggtatagaggttatgttcagccctcatccttgtcccacatggaccctggattggaacgtgctgcctgcagcggtgtcgcctaaggaaggtaagatgagctctgatcgcgctctgcgcaagcaacagcaattaaacaacctggtgtatgtggtgaccaatcaagccaagcctggagaccgcatcgtggacttttgctctggcggaggtcatgtcggcattgttctggcgcacatgctgccttcatgtcaagtgacactaattgagaacaaggaactgagcctcattcgagctaagaaacgcagtgacgagcttggactgagcaatatctggtttattcaggctaacatggaatacttcaccgggatgttcaatatcggagtggcgctgcatgcctgcggagtggctactgatatggttatcgaacattgtatcaaaacaagagcttctttcgtgacatgcccttgttgctacggttttatacagaacacatccaaatttaactttccaaaaagcgaacaatttaagaagacactatcttacaaagaacatatgatcctgtgccggtttgccgatcaaactgcggtccagttgccaccccagcggaggctgattgggaagcaatgtatgtgcctggtcgatctggatcgcgctcgggctgcagaggagtgcggatacagtgtccaggtaattagtatggaacccgaatcctgtagccccaagaacaacatgatcgtgggcgtaccgatatag

SEQ ID NO: 31070 - DNA, 597 bp, Artificial Sequence
  Description of Artificial Sequence: Synthetic coding sequence
atggctacaggtgacctgaagcggtcgctgaggaacctagaacaggtactcagactcctcaattacccagaagaggtggactgtgtcgggcttataaagggggatccagccgcaagtctgcccatcatcagttatagcttcacttcttacagcccttatgtgaccgagttaataatggagagtaatgttgagctcatcgccaagaatgatctccgcttcatcgatgcggtctacaaactgctaagagaccaattcaattataaaccaattctgaccaaaaaacaattcattcagtgcggttttgcagaatggaagatccagattgtctgcgacatattgaactgtgtgatgaagaagcacaaggaacttagctctctacaaaagatacccagtcagcaacggaagaagattagttccgggaaaagtgaaccaccgctaggcaatgagaagattagcgcagaagctgtaggagttgacatatctggacgatttatgacatcaggcaagaagaaggcagtcgtgatccggcacctgtataatgaggataacgttgacatcagtgaggatacactgagtcctatcactgatgtcaattag

SEQ ID NO: 31071 - DNA, 336 bp, Artificial Sequence
  Description of Artificial Sequence: Synthetic coding sequence
atggtgatggagaaaccctcaccccttcttgtgggaagggagtttgtcaggcagtattacactctcctgaacaaggctcccgagtatctgcatagattctatggcagaaacagctcatacgtccacggaggcgtcgacgctagtggcaagccacaggaggctgtctatggacagaatgacattcaccacaaagtgctgtctctgaacttttccgagtgccacacaaagatacgccatgtggacgcccatgccacactgtcagacggggtggttgtgcaagttatggggctgctctcaaattccggacagcccgaacggaagtttatgcagacgtag

SEQ ID NO: 31072 - DNA, 681 bp, Artificial Sequence
  Description of Artificial Sequence: Synthetic coding sequence
atgtccagtcctcgcgattttcgagcggaacccgtgaacgactatgaaggaaatgacagcgaagccgaggacctcaatttccgggaaaccctcccttcttcgagccaggagaatacaccacggagcaaagtgttcgagaacaaagttaatagcgagaaagtgaaactgagcctccggaattttccacacaacgattatgaggatgttttcgaggaaccatcggagtcgggttccgatccctctatgtggactgccaggggtccatttcggagagaccggtggagctccgaagacgaggaagccgcagggccttcccaggccctgtcacctttgctctctgacacccgaaagatagtcagtgagggcgaacttgatcagctggcacaaatcaggcccctcattttcaactttcatgaacagaccgcaataaaggactgcctgaaaattctcgaggaaaaaactgccgcttacgatatcatgcaggagtttatggctcttgagttaaaaaatctccccggtgagttcaactctggcaatcagccctccaatcgggagaagaatcgctacagggacatcctcccttttcagcatcacggctacagcggtccaaatgaaagaactaccttctggcacggctccaatgaaggggcagttagcctgctgctgagatactgcgcctag

SEQ ID NO: 31073 - DNA, 1872 bp, Artificial Sequence
  Description of Artificial Sequence: Synthetic coding sequence
atgtccgacgaggtcttttctactacactagcctatactaaatcgccgaaggtgacgaagagaacaacattccaggacgaactgatccgcgcaataacagcccgttccgccagacagcggtcgtccgaatacagtgacgatttcgatagcgatgaaattgtctcactcggcgatttctctgacactagcgccgacgagaattctgtgaacaaaaaaatgaacgattttcacatcagcgacgacgaggagaagaaccccagcaaactgctcttccttaagacgaacaagagcaacggcaatatcacaaaagacgagccagtatgtgcaattaagaacgaggaggagatggctccagatggatgcgaggatatagtggtcaagagtttctcagagtcacagaataaggacgaggaattcgaaaaagacaaaatcaaaatgaaacccaaaccaagaatcttgtcaatcaagagcacaagttccgctgagaacaattccttagacacagatgaccattttaagccatcaccaagacctaggagcatgctcaaaaagaagtcacacatggaggagaaagacggattggaggataaagaaacagctctgtctgaggaactggagctgcactctgccccaagcagcttgcctacgcctaacggtatccagctggaagccgaaaagaaagccttcagcgaaaacctcgacccagaagatagctgtctaacgtccttggcatcctctagcttaaaacagattttgggagactccttctcccctggcagcgaaggaaatgcatctggaaaagcggaccatgtgacaacagcggtcgagaagagcaaggagagccaggtgactgctgacgatctcgaggaggaaaaagccaaagccgagttgatcatggatgacgacaggaccgtcgacccgctgctttctaagtcacagtcgatattaatctctacctccgctaccgcttctagcaaaaaaacaatcgaagatcgcaatattaaaaacaagaaatcaacaaacaaccgcgcatcgtcagcctccgcccgtctaatgacatctgagttcctgaaaaagagctcctccaaaaggagaacaccaagcactacaacttcttcacactacctgggcacactgaaggtgctggaccaaaagccctcccagaaacagagcatcgagcccgaccgagccgataacattagagcggctgtatatcaggaatggctggaaaagaaaaacgtttacctccacgagatgcatcggattaaacgcatagaatcagaaaacttgcgaatccagaatgaacaaaaaaaggcagcgaagagagaggaagccttagcatcctttgaggcttggaaggcaatgaaggaaaaggaggcaaaaaaaattgcagccaaaaaaagacttgaggaaaagaacaaaaaaaagaccgaagaggagaacgctgccagaaagggagaagccttgcaggcctttgagaagtggaaggagaaaaagatggagtacctgaaagagaagaatagaaaggagagagaatatgaacgcgctaagaagcagaaagaggaggaaacagtggccgaaaagaaaaaggacaatttgacagctgttgaaaagtggaacgaaaagaaggaggcttttttcaaacagaaggagaaggaaaagatcaatgagaagcgaaaggaggagctgaaaagggcagagaagaaagacaaagacaagcaagccataaatgaatacgaaaaatggctcgaaaacaaagagaaacaagaacgtatcgagcgtaagcaaaagaagcgccactcgttcctggaaagtgaagctttgcctccatggagcccgccaagccggaccgtgttcgctaaagtgttttag

SEQ ID NO: 31074 - DNA, 255 bp, Artificial Sequence
  Description of Artificial Sequence: Synthetic coding sequence
atgatgcttggaacagagggcggagagggctttgttgtcaaggtgaggggactgccctggtcctgttcagcagatgaagtgcagagattcttcagtgactgcaagattcagaatggtgcccaggggatacggtttatctatacaagagaaggcaggccatctggtgaggcttttgtcgagctcgaatctgaggacgaggtgaagctggctcttaagaaagatagggaaacaatgggtcacaggtatgttgagtag

SEQ ID NO: 31075 - DNA, 993 bp, Artificial Sequence
  Description of Artificial Sequence: Synthetic coding sequence
atggatcagggagatactccaaccctggaggaggacctaaaaaagctacaattatctgagttttttgatatttttgagaaggaaaaagttgataaagaagctttggctctctgtacagatagagacctccaggaaattggaatccccctcgggcctcggaaaaagatcctgaactatttttctacaagaaaaaattccatgggcatcaaaagaccagctccccagcctgcttcgggagctaatattccgaaagagtccgagttctgctcctctagtaacacacggaacggagattaccttgacgtgggaatcggccaggtcagtgtgaaatatcctcgcctcatctacaagccggagatctttttcgccttcgggtcccctattgggatgttcctgactgtgcgtggactcaaacgcatcgaccccaactacaggtttcctacgtgcaagggcttcttcaacatttaccatcccttcgaccctgtggcatataggatcgagcctatggtggtgcctggtgttgaattcgagccaatgctgatacctcatcacaagggccgtaaacggatgcacctagagcttcgagaaggactcactagaatgtccatggatttgaagaacaatctccttggctccttaagaatggcctggaagtcttttaccagggctccatatcccgctctccaagcttcggaaaccccggaggagacggaggcggagcctgaaagcacaagcgagaaacctagcgatgtgaatacagaagagaccagcgtggcggtgaaggaggaggttctgcctataaatgtagggatgctgaatgggggacagagaatcgattacgtactgcaggagaaaccaatcgagagttttaacgagtacctgtttgcattgcagagtcacctgtgctactgggagtctgaggacacagtgctcttggtgttgaaagagatttaccagacccagggcatttttctggatcagccgctacaatag

SEQ ID NO: 31076 - DNA, 1383 bp, Artificial Sequence
  Description of Artificial Sequence: Synthetic coding sequence
atggatagcgagctgatgcatagtattgtaggttcgtaccataagccacccgaacgagtgtttgtccctagctttacacagaatgaaccgagtcagaactgccacccagctaatctggaggtgaccagcccaaagatcctccattctcctaactcacaagccctgattttagctctgaagacactgcaggagaaaatccaccgcttggagctggagcgtacacaggccgaagataatctgaatattctctcacgagaggcagcacagtacaagaaagctttggagaacgagactaacgaacgtaatctggcccatcaggaactcataaaacagaaaaaagacatctccattcaactctcgtccgcgcaatcacgctgtactctcctggagaagcagctggagtacacgaagcggatggtcctgaacgtggagcgggaaaagaacatgatattggagcagcaagcccagctgcagcgcgagaaggagcaagaccagatgaagctgtatgccaagctggagaaactggacgtactcgaaaaggagtgttttaggctgactacaacccagaaaactgcagaggacaaaattaagcatttggaggaaaaactcaaggaggaggagcaccagagaaagctattccaggataaggcaagtgaactgcagaccggcctggaaatatcaaagataattatgagttcagtatcaaacttaaaacactccaaggagaagaaaaaatctagtaaaaagacgaaatgcattaaaagacgccctccctggcagatttgttcaaagtttggcgctctaccatttgtggctgagaagatgcgccagcatagagacccacacatccttcaaaagccatttaatgtgacagagacccgatgtttacccaaaccaagccgcactacaagttggtgtaaggcgatcccaccagactccgaaaagtctataagcatctgcgacaacctgtcagagctcctgatggccatgcaggatgagctcgatcaaatgtccatggagcatcaggagctcctgaaacagatgaaagagaccgagtcccattcagtttgcgacgatatcgagtgtgagcttgaatgtcttctgaagaaaatggagattaagggggagcagatatccaagttgaagaagcaccaggattcagtgtgtaagttacagcaaaaggtccagaatagcaagatgagtgaggcatctgggatccagcaggaggactcttatcccaagggaagcaagaacatcaaaaactccccaaggaagtgcttgaccgacaccaacctgtttcagaaaaactccagcttccaccctattcgagtccataatctgcagatgaaactgcgccgagatgacattatgtgggagcagtag

SEQ ID NO: 31077 - DNA, 1068 bp, Artificial Sequence
  Description of Artificial Sequence: Synthetic coding sequence
atgactggcagcgctgcagacacacaccgatgcccacacccgaagggggctaaaggtacgaggtcccgatcaagccacgcaagaccagtctctctggctacgtccggcggatccgaggaggaagacaaggacggcggagtcttattccatgtcaacaagtccggtttcccaatagactctcacacttgggaacggatgtggatgcacgtcgccaaggttcaccccaaaggcggtgaaatggttggcgcaattaggaatgccgcattcctggctaagccttccatcccacaggtgccaaactatcggctgtcaatgactattcccgactggctgcaggctatccagaattatatgaaaacacttcagtataaccatacaggcacgcaattctttgagatcaggaagatgcgaccactttccgggctgatggagaccgccaaggagatgacccgagaatccctgcctataaagtgcctggaagccgtgatcctgggtatatatctgaccaatggccaaccatccatcgagcggttcccaatcagcttcaagacgtattttagtggcaattacttccatcacgttgtgcttgggatttactgtaatgggaggtatggcagcctaggcatgtctagacgggctgaactcatggataaacctctgacctttagaacattgtcagacctcatctttgattttgaagactcttataagaaatatctgcacacagtgaaaaaggtgaaaattggattgtacgttcctcacgaaccccactccttccagccaatcgaatggaagcagttggttctgaatgtcagcaaaatgcttcgggctgatatcaggaaggagttagagaagtacgctcgcgatatgagaatgaaaatactaaagccagccagtgcccactcccccacacaagttagaagccgcggaaagtccctgagcccacgccgacgtcaggcttctcctccaaggcggctgggtcgccgagagaaatctcccgcactgcccgagaagaaggtggccgatctcagcactctcaacgaagtgggataccaaatcagaatctag

SEQ ID NO: 31078 - DNA, 384 bp, Artificial Sequence
  Description of Artificial Sequence: Synthetic coding sequence
atggcaagtaaccataaatcatcggccgcacgcccagtgagccgcggtggtgttggtctgaccgggagacccccatcagggatccgtcctctcagcggcaacattagggtggccactgccatgccacccggaactgcgagacctggatcacgcggttgccccatcggaaccggtggcgtgctctcgtctcaaatcaaagttgcccataggccagtgacccagcagggtttgactggaatgaaaacggggacaaaaggtcctcaaaggcagattctcgacaagtcatactaccttgggcttctcagaagtaagatcagcgaattaactactgaagtgaacaaattgcaaaagggcattgagatgtataatcaggagaattcatag

SEQ ID NO: 31079 - DNA, 510 bp, Artificial Sequence
  Description of Artificial Sequence: Synthetic coding sequence
atgcacaaactgcagtctggtatcggcaggctaattcttaaagaggagatgaaggctaggagttcctcatacgctgacccttggactcccccaaggtctagtacgagttccagagaagctctgcacacagctgggtatgagatgagccttaacggctctcctagaagccactacctggccgactccgatccactcataagtaagtctgccagtctaccggcatatcggcgtaatggccttcacaggacgccctccgcagatttatttcattatgacagcatgaatgctgtgaactggggaatgcgagagtataagatatacccttatgaactgctgctggtgactactagaggacgtaatagactaccaaaagacgtagatcgaacccgcctcgagcgccaccttagccaggaagagttctatcaggtttttggaatgaccattagcgagttcgatagactggcactttggaagcggaacgaactgaaaaaacaggcccgtctgttctag

SEQ ID NO: 31080 - DNA, 144 bp, Artificial Sequence
  Description of Artificial Sequence: Synthetic coding sequence
atggcatccgtcttgagtaggcggcttggtaaacgctccctcttgggggcacgggtgcttggtccctcagcttccgagggaccctctgctgccccaccgagcgaacctctgctggaaggggctgcccctcaaccgtttacctag

SEQ ID NO: 31081 - DNA, 558 bp, Artificial Sequence
  Description of Artificial Sequence: Synthetic coding sequence
atggatgactcaatcaataataggtttagttatgtgacgcatgaggacatttgtaactgtttcaatggggacaccctgctggctatccaggctccatctggcacacagctggaggtgccaatccccgaaatgggtcagaacggacaaaagaagtaccaaattaatctcaaatctcactcgggccctatccacgtattactcatcaataaggaaagttctagctctaagcctgtcgtgtttcctgttccgcctccagacgacctgacccaaccttcctcgcagagcctgactcctgtcaccccccagaagagcagcatggccacccagaatctgccagagcaacatgtgtctgaaagatcccaagcacttcaacagacatccgcgactgacatctcaagcgccggatctataagcggcgacatcattgatgagctcatgagctctgacgtattccctttgcttagattgtcgccaacgcccgctgacgactacaattttaacctagatgacaatgaaggagtctgtgatctgttcgacgtgcagattcttaattattag

SEQ ID NO: 31082 - DNA, 492 bp, Artificial Sequence
  Description of Artificial Sequence: Synthetic coding sequence
atgccatctatcaagctgcagtctagtgatggcgaaatcttcgaggtggacgtggaaatcgctaagcagtctgtcacaatcaagacaatgttggaggatttgggcatggacgatgaaggcgacgacgaccccgtgcctctaccaaatgttaatgccgctattcttaagaaggtaattcaatggtgtacacatcataaagatgaccctcccccacccgaggacgacgagaacaaggaaaagagaacggatgatatacccgtttgggaccaggaatttctcaaagttgaccagggtaccctgttcgagcttattcttgccgcaaactatctggacattaaaggcctcctggacgtgacgtgtaagacagtggccaacatgattaaaggtaagacgccggaagaaatacgcaaaaccttcaatattaaaaacgacttcaccgaggaggaggaggctcaggtgcgcaaagaaaaccaatggtgcgaggaaaagtag

SEQ ID NO: 31083 - DNA, 915 bp, Artificial Sequence
  Description of Artificial Sequence: Synthetic coding sequence
atgagcaaaagacgcaggctgaaacagggagagcccattatgacaggaaagactcagacgtctaatgttacaaacaagaatgacccgaaatctatcaatagtagggtgtttatcggaaatctgaatacagccatcgttaaaaaagttgacatagaggcgatcttctctaaatatggaaagatcgtgggatgtagcgtccacaaaggctatgcctttgttcaatacatgtcggaacgccacgcgagagccgctgtcgccggtgagaatgctagagtgattgcagggcagccgttagatatcaatatggcaggcgagcccaagccatataggcctaaaccagggaataaaagacctttgagtgccctctaccgtctggagtccaaagagccgtttctaagcgtggggggatatgtctttgactatgactattatcgcgacgacttctataataggttatttgattaccatggtcgtgtcccacccccaccaagagcggtaatcccactgaagcggcctcgggtggcagttacaaccacgcgtcgcggaaaaggggttttctctatgaagggtggatcacgcagtactgcatctggatctacaggaagcaagctgaagagcgacgagctacaaactattaaaaaagagttgacgcagataaagaccaagatcgatagtctcttgggtcgcttggagaagatagagaagcagcagaaggcggaggccgaagcccaaaaaaaacagctagaggagagcttggtactgatacaggaggagtgcgtgtctgaaatagcagaccattctactgaggagcccgcagagggtggacctgacgcagatggagaggagatgactgacggaatcgaagaggattttgacgaagatggaggacatgaactgtttctgcaaatcaagtag

SEQ ID NO: 31084 - DNA, 405 bp, Artificial Sequence
  Description of Artificial Sequence: Synthetic coding sequence
atgccttcggcagaagctaaactcaagaaaaatcgatgtgctaactgtttcgattgccccggatgcatgcacactcttagcaccagggccacatcaatttccacgcagctgcccgatgacccagcaaaaacaaccatgaagaaggcatattacttggcctgtggcttctgtcgctggacgagtagagatgtcggcatggccgataaaagtgtggcaagcggcggttggcaagaacctgagaacccccatacacaacgaatgaataaactgatcgaatactaccagcaactagcccagaaagagaaggtggagcgggatcgcaaaaaactggcacggagacgaaactatatgcctctggccttttctgacaagtatggattgggcacccgtctgcaaaggccctag

SEQ ID NO: 31085 - DNA, 1230 bp, Artificial Sequence
  Description of Artificial Sequence: Synthetic coding sequence
atgtggagagtgatcgaacccccatgtcccggagccccaagcaccgaaaacggtaaaagcgtccattggaaacttggggctgataaggaagtctgggtctgggtgatgggagaacatcatctggacaagccctatgacgtcctctgtaatgagattatagccgagcgcgcacgattgaaagctgaacaggaagcggaggagcctaggaagacccactccgaagagtttacaaatagcctgaaaactaagtcacagtatcacgatctccaggccccagacaaccagcagacaaaggatatttggaaaaaagtcgccgaaaaagaggagttggaacaggggagccgcccagcgccaacactcgaggaggagaagattcgaagtctttctagcagtagtagaaacattcagcagatgctggcagatagcattaaccgcatgaaggcgtatgcctttcatcagaaaaaggaatctatgaagaaaaagcaggatgaagagattaaccagatagaagaggaaagaactaaacagatatgtaaaagttggaaggaagactctgaatggcaggcaagcctacgtaaaagcaaggccgcagatgagaagcggaggtccttggccaagcaggccagagaggattacaagcgtctgagccttggagctcagaaaggaaggggtggcgagagattgcagtcacctctgcgagtgcctcagaagccagagagaccccctctgcctccaaagccacaatttctgaatagtggggcataccctcagaagcctttgcgcaatcagggggtggtccgcacacttagcagcagtgcccaggaggacatcatcaggtggtttaaggaagaacagctgcctcttcgcgcagggtatcagaaaacttctgatacaatagccccatggttccacggaatactgacgcttaagaaggcaaatgagctgctgctgagcacagggatgcctggctcttttctcatcagggtttcagagcgtatcaagggatacgcccttagctatctgtcagaggatggatgtaaacatttcttgatcgacgcttcagccgacgcatattccttccttggggtagaccagctgcagcacgcaactttggccgatcttgtggagtaccacaaagaagagccgatcacatcactggggaaggaattgctgctatatccttgcgggcagcaggaccagctaccagactatcttgaactgttcgagtag

SEQ ID NO: 31086 - DNA, 390 bp, Artificial Sequence
  Description of Artificial Sequence: Synthetic coding sequence
atgtctgataagtctgacctcaaagcggagctcgaacggaagaagcagagacttgctcagattcgggaagaaaaaaagcggaaagaagaggaaaggaagaaaaaggaggctgacatgcagcagaaaaaagaaccggtgcaggatgattcggacctcgatcgcaaacgcagggagaccgaggcccttctgcagagcatcgggatttcgccagagccacctcttgtccctacacccatgtcaccctcttctaaaagcgtcagcaccccaagcgaggcgggatcacaggattctggtgatctcggccctttgacacgtacgctacagtgggacaccgacccatcagtcctgcaattgcagtctgactcagaacttggatatatgagtgcctag

SEQ ID NO: 31087 - DNA, 780 bp, Artificial Sequence
  Description of Artificial Sequence: Synthetic coding sequence
atggtgggacgcgaaaaagagttgtccattcactttgtgccaggctcctgtcggctggtggaggaagaggtgaacattccaaacaggcgtgttctagtgactggagctacagggctgctgggcagagctgtgcacaaagaatttcagcagaataattggcatgccgtggggtgcggctttcggagagcccgaccgaagtttgagcaggtcaatttattggactccaacgccgttcatcacattatccacgattttcagccccatgtgattgtccactgcgcagcggaacggaggccggacgtggtagagaatcaaccagacgccgcatcgcagctgaacgtggacgcctcagggaatctggctaaagaggccgctgctgtcggagcctttctcatctatatctcttcagactatgtcttcgatgggaccaaccccccatatagggaggaggatatacctgcacctctgaatctctacggaaagacaaagctggacggtgaaaaggccgtcctggaaaataaccttggtgctgccgttctgcgtatcccgatcctttatggagaagttgaaaaactcgaagagagtgctgtgacggtaatgttcgataaggtgcagttcagtaataagtccgcgaatatggatcactggcaacagaggtttcccacccatgttaaggacgtagccaccgtttgtcggcagcttgccgaaaagagaatgctggtgaggaggatccctgaatcctgcttaagtgaaggacccctctgcctcttccacgcctag

SEQ ID NO: 31088 - DNA, 549 bp, Artificial Sequence
  Description of Artificial Sequence: Synthetic coding sequence
tcttacgattccaccttttcctacgttacacacgaagacatctgtaattgcttcaatggcgacacactcctggcgatacaggccccttccggaacccaactggaagtgccaatccccgagatgggtcagaacgggcagaaaaagtatcaaatcaatctaaagtcgcactccggtcctatccacgtcttactgatcaataaagaatcaagctcaagtaaacccgtggtgttccccgtgccacccccagacgatctgacccagccttcgagccagagcctgacccctgtgactccacagaagtcaagcatggcaacacagaacctgcctgagcagcacgtttctgaaaggtcccaagcgctgcagcaaacctccgctaccgatattagcagtgcaggaagcatctcgggggatattatagatgaattgatgagttccgatgtgttccccctgctgagacttagccctacgcccgctgacgactataacttcaatctggatgacaatgagggcgtctgcgatttgttcgacgtgcagattctgaactactag

SEQ ID NO: 31089 - DNA, 162 bp, Artificial Sequence
  Description of Artificial Sequence: Synthetic coding sequence
atggactctgaactgatgcactcaatcgtgggaagctaccacaaaccccctgagagagtctttgtaccgtccttcactcaaaatgagccatcacagaattgccaccccgctaacctagaagtgacatcgccaaaaatcctccacagtccaaatagccagtag

SEQ ID NO: 31090 - DNA, 3018 bp, Artificial Sequence
  Description of Artificial Sequence: Synthetic coding sequence
atggcgggtgctctaagaaggggcagagcactaggttctcgccctagcggccctactgtcagcagtaggcgatcccctcagtgtccagtcgcacaagaagggttaggggcaaggtctagacccagagttgcgccacgctcattggctcggtgtggtccaagctctcgactcatgggctggaagccgtccgaggctcgtggccaaagtcaaagctttcaggctagcgggttgcaaccccgatcactcaaggccgcacgaagggctaccgggagacctgaccgtagtcgcgctgcgaggcccaccatggatccatcagcccacagatctagggctgccccacccaatatggatcccgatcctcaagccggtgtccaggtaggaatgcgagtggtgaggggtgttgactggaaatgggggcaacaagatgggggagaaggaggagttgggacagtggttgagctagggaggcatggcagtccatccactcccgacaggactgttgtagtgcagtgggatcagggcactcgtacaaattatcgcgctggataccagggagcacatgacctgttactttacgataacgcacagatcggagtgagacaccccaacattatctgcgactgttgtaagaaacatggtctgcgcggtatgcgctggaaatgcagagtatgtctcgactacgatttgtgcacccagtgttacatgcataacaaacatgagctagcccatgcttttgacagatacgagacggcacattcccgacccgtgacactgagccccaggcaaggtttgccacgtataccactccgcggtattttccagggtgcaaaggtggtgcgaggccctgattgggaatggggctctcaggatggtaagcctgctgagctccagcggagagtgagcgctgacagccagccatttcagcacggggacaaggtcaagtgcctgcttgacactgacgtgctcagagaaatgcaggaagggcacgggggatggaaccctagaatggcagaattcataggccagactgggaccgtacacaggataacagaccgcggagatgtacgcgtgcaatttaaccatgagacacggtggacgtttcaccccggagccctcactaagcaccactcgttctgggtgggtgacgtggtccgcgttattggagatctggataccgtcaaacgattgcaggcgggacatggagaatggactgacgacatggcacccgcattgggaagagtggggaaagtggtaaaggtctttggggatggaaacttaagagtggccgttgcgggacagcgctggacattctccccttcctgcctggtagcttacaggcctgaggaggatgctaacctcgatgtcgcggaaagagcgagggagaataaatctagcctctcagtggccctggataagcttcgggctcagaaatccgaccctgaacatcccggacgactcgtggtggaagtcgccctcggaaatgccgcaagagcgctcgatctgctgaggaggagaccagagcaggtggacaccaaaaaccagggcaggaccgcactacaggtggccgcatatctcgggcaggttgagctgatccgattactattgcaggcccgtgctggtgttgatctcccagacgatgaagggaatactgcacttcattacgccgcattgggtaaccaaccagaggccactcgagtcctgctctcagctgggtgccgggcagacgccataaactccacacagtcaacagccttgcacgtggcagtgcaaagaggattcctcgaggttgtccgcgcattgtgtgaacgcggatgcgatgtgaacctgcccgatgcccatagcgatactccgctgcacagcgctatctcagccggaacaggggcttccggtatcgtggaagtcctgacagaagtccccaatattgacgtgacagccacaaattcacagggcttcaccctgctgcatcatgcatccctcaagggtcatgccctggcagtgcgcaagattttggctcgcgctcggcagctggtggacgctaaaaaggaagacggtttcaccgccctccacctggctgccctgaataaccatcgagaggtggcgcagatactgatccgggaaggccgatgtgatgttaacgtgcgcaataggaagctgcagtcccctctccacctggcagtgcagcaggctcacgtcggcctggtaccattgctggtagacgcaggttgttctgtcaatgcagaggatgaggaaggcgatacggcgctgcacgtggcattgcaacgacaccagctgctgccgttagtcgctgacggggctggcggagaccccggacccctgcagctgctgtcccgcctgcaagcctcagggctccccggtagcgcagagcttacggttggcgcagctgtggcatgtttcctcgctctagagggggctgatgtgagttatacgaatcataggggacggagtcccctggatcttgcagccgagggacgcgtactcaaggctctgcagggatgtgcgcagcggtttagagaacgccaagctggaggtggagccgctcccggaccccgacagaccttggggactcccaatactgtgaccaatctgcatgtaggagcggctcccggacctgaggccgcagagtgtttggtttgttccgagctggcgttacttgtcctgttctctccttgtcagcacagaaccgtctgcgaagagtgtgcccgaagaatgaagaaatgtatcaggtgccaagtcgtcgtgtccaagaagctccggccagatggctccgaagtcgccagtgctgcccctgctccaggaccacctcgccagctggtcgaggaactgcagtcaagatataggcagatggaggaacgcatcacatgtcccatatgcatcgattcacacatccgcctggttttccagtgcggccacggggcatgcgctccatgtgggtcagccttgagtgcatgccctatctgcaggcagcctatccgagacaggattcagatatttgtgtag

SEQ ID NO: 31091 - DNA, 294 bp, Artificial Sequence
  Description of Artificial Sequence: Synthetic coding sequence
atggctagttccgccgaactggacttcaacctccaggctttgcttgaacaattatcacaggatgaactgtcaaagtttaagtcattgatacgaaccatctcacttgggaaagaactgcagactgtcccccaaaccgaggtcgataaggcaaatgggaagcagctagtggaaatattcacgagtcatagttgttcctattgggcgggaatggctgctatccaggtgtttgaaaagatgaatcagacccaccttagcggtagggctgacgagcactgtgtcatgccccctccatag

SEQ ID NO: 31092 - DNA, 693 bp, Artificial Sequence
  Description of Artificial Sequence: Synthetic coding sequence
atggatagcgaactgatgcatagtatcgtaggaagctatcacaagccgccagagagagtattcgtgccatcctttacgcagaacgaacccagtcagaattgccacccagcaaacctggaggtgacaagcccaaaaattctccactctcccaacagtcaggccctaattcttgctctgaaaaccctccaggaaaagatccatcgccttgaactcgagaggacccaagccgaagacaacttaaacattttaagtagggaggctgcccagtataagaaagcacttgagaatgaaacgaacgaacggaacttggcccaccaagagttgatcaaacagaagaaggacatctccattcagctttccagcgctcaatcaaggtgcacactgctggagaaacagctcgaatataccaaacgcatggtgttaaacgttgaacgtgaaaaaaacatgattctggagcagcaggcacaactgcagagggaaaaagagcaggatcaaatgaagctgtacgcaaagctcgaaaaactggacgtgctcgagaaggaatgttttagacttaccaccacccagaaaactgctgaagacaagattaagcatctagaagagaagttgaaggaggaggagcatcagcgcaaactcttccaggataaggcctccgagctgcaaacgggtctcgaaatcagcaagataatctag

SEQ ID NO: 31093 - DNA, 624 bp, Artificial Sequence
  Description of Artificial Sequence: Synthetic coding sequence
atggatagaggggagcaggggctattgaggacggatcccgtgccagaggaaggcgaggatgtggcagcaacaatatcagctacagagacccttagcgaagaagaacaagaggagttgagacgtgaactggcaaaggtcgaagaagagattcaaaccctgagccaagtcttagccgctaaagagaaacacctcgccgaaattaaacgcaaacttgggattaactctctccaagaactgaagcagaatatagccaaaggctggcaggatgtcaccgctaccagtgcatataaaaagaccagcgaaacactcagtcaggccggacagaaggcctcagctgccttttcgtccgtgggatcggtgataactaaaaagttagaagatgtgaagttgcaggccttcagccatagtttctcgataagaagcatccagcactccatttcgatgccagccatgaggaattcacctaccttcaagagttttgaggagaaggtggaaaatctcaaatctaaggttggaggtaccaaacccgcaggcggagattttggcgaagtgctaaactcagctgcgaacgccagcgcaaccacgacagaacctctgccggaaaaaactcaagaatcgttgtag

SEQ ID NO: 31094 - DNA, 387 bp, Artificial Sequence
  Description of Artificial Sequence: Synthetic coding sequence
atgaagttcaacccttttgttacttccgacaggtcgaaaaaccggaaaaggcatttcaatgctcccagtcacgtccgcaggaagattatgtccagtcccttgagtaaagagctccgccagaagtacaacgttagaagcatgcccatccgcaaagatgatgaggtgcaagtggtgcggggtcactataaaggacagcaaataggcaaagtcgtgcaggtctaccgcaaaaaatatgtgatttacatcgagcgggtccagcgggaaaaggctaacggaaccaccgtgcatgtcgggattcatccttcaaaggtggtcataaccaggctcaagctggataaagatcgtaagaaaatactggagaggaaagctaagtcgagacaggtctag

SEQ ID NO: 31095 - DNA, 126 bp, Artificial Sequence
  Description of Artificial Sequence: Synthetic coding sequence
  Description of Combined DNA/RNA Molecule: Synthetic coding sequence
gggcttaccaagcaactcttggatgacaccatcggaatacatcccacttgtggggaagtgtttaccacactggagattacaaaatcaagcggccttgatattacacaaaaagggtgtugaggctag

SEQ ID NO: 31096 - DNA, 1365 bp, Artificial Sequence
  Description of Artificial Sequence: Synthetic coding sequence
atgctgaagcaaattctctcagagatgtacatcgaccccgaccttttggcggaactctccgaggagcagaagcaaattcttttttttaaaatgagggaagagcagatcaggcgctggaaggaacgcgaggcagcgatggagcgcaaggagtccctacccgtcaagcctagacctaaaaaagagaatgggaaaagcgtgcactggaagctcggagcagataaagaggtgtgggtctgggtcatgggggagcaccacttggacaagccctacgacgtcctgtgcaacgagatcatcgctgagcgcgcaagactgaaagccgagcaagaagctgaagaaccgagaaagacccattctgaggagtttacaaactccctgaaaacaaaaagccagtaccacgacctccaagcaccggacaaccagcagactaaagacatatggaagaaagtcgcggagaaagaggagctggagcaaggctctaggccggcacctactctcgaggaagaaaaaattcggagcctgtcatcttccagtcgaaatattcagcagatgctggccgacagcataaaccggatgaaggcctacgcctttcatcaaaaaaaagagtcaatgaagaagaaacaggatgaagagattaaccagattgaggaggagcggaccaagcaaatctgcaagtcatggaaggaggactcggagtggcaggcatctttgagaaaatccaaagcagcggatgagaagagacgcagtttagctaagcaagctcgggaggattataagaggctgtccctgggtgcacaaaaaggaagaggtggtgaacgcctccaaagtccacttcgtgtgccacagaagcctgagaggcctcctctgcctccaaaaccacagtttctgaattccggcgcatatcctcagaagccactacgaaaccaaggtgttgtccggactttgtcctcatctgcccaggaggatattattcggtggttcaaagaggagcaactcccgctgcgagcaggataccagaaaacctccgacaccatcgcaccttggttccatggaatcttgaccttgaaaaaggcaaacgagctgctgctgtccactggtatgccgggaagctttctgataagggtgtcagaacgaataaagggatacgcactgagttacctgagtgaggatggctgcaagcattttctgatcgacgcatctgccgacgcttacagcttcctgggcgtggaccagctgcagcacgccaccttagcagatctggtcgaatatcacaaagaagagccaatcacctctctgggcaaggaacttctgctgtacccatgtggtcaacaggatcagctgccagattatctggagctgtttgagtag

SEQ ID NO: 31097 - DNA, 438 bp, Artificial Sequence
  Description of Artificial Sequence: Synthetic coding sequence
atgaagtttaatcctttcgtgactagcgatcgaagtaaaaacagaaagaggcattttaatgcacccagtcacgtaagaaggaagatcatgtcctctcctctgtctaaagaactgcggcagaaatataacgtacgcagcatgcccattaggaaagacgatgaggttcaggtggtgagggggcactacaaagggcaacaaatcggaaaagtcgtccaggtctaccgcaagaagtatgtcatttatatcgagcgagttcagagagagaaggccaacgggaccaccgtgcatgtcggtatccaccccagcaaagtcgtgatcacacggctgaaactggacaaagataggaaaaaaattctggagaggaaagcaaagagcagacaagtcggcaaggagaaaggaaagtataaggaggagctcattgagaaaatgcaggagtag

SEQ ID NO: 31098 - DNA, 621 bp, Artificial Sequence
  Description of Artificial Sequence: Synthetic coding sequence
atggactccgaactgatgcacagcattgtagggagctaccataagccaccggaaagagtgttcgtccccagcttcacccagaacgagcccagccagaactgccaccccgcaaatctggaggtcacatcaccaaagatcttacatagcccgaattcccaggcgctgattttagcgcttaagactctgcaggaaaagattcatcggcttgagttggagagaactcaggccgaagataatctcaatattttgagtcgagaggcagcccagtacaagaaggcgttggaaaatgaaaccaatgagcggaatctggcacaccaagagctgatcaaacagaaaaaggacatcagtattcagctgtcctccgcgcagagcaggtgcacgctgctggagaagcagctggagtataccaagaggatggtccttaatgttgagagagagaaaaacatgatactcgagcaacaggctcagcttcaacgggaaaaagaacaggatcagatgaaactctacgctaaattggagaagctggatgtactcgagaaagagtgtttccggctgaccactacgcagaagaccgcagaggacaagatcaaacatctggaggagaaactcaaagaggaatag

SEQ ID NO: 31099 - DNA, 1050 bp, Artificial Sequence
  Description of Artificial Sequence: Synthetic coding sequence
atggaagacccccagtcaaaagagccggctggagaagcggtggccctggcactcctcgaatctcctcgcccagagggcggagaagagcccccaaggccctcgcctgaggaaactcagcagtgtaaattcgatgggcaggagactaagggctctaagtttattacgtcctccgcaagcgacttcagtgaccctgtctataaagaaatcgccattactaacgggtgtatcaaccgcatgtccaaggaggagctgagggctaagctcagtgagttcaaactagaaacccgcggtgtaaaagacgtgcttaagaagaggctcaaaaattattataagaaacaaaaactcatgctcaaagaatctaacttcgcagacagctattatgattacatctgtatcatcgattttgaggctacgtgcgaggagggcaaccctcctgagttcgtgcatgaaataattgagtttcccgtcgttcttctgaatactcatacactggaaattgaagacacgttccagcagtacgtgcgcccagagattaatacccaactgagcgacttttgcatctctctgactggcatcacccaggaccaagttgacagggctgacacattcccacaggtgctcaaaaaagtgatcgattggatgaagctgaaggagctgggcaccaaatataagtactcccttctgactgacggctcttgggatatgagtaaatttctgaatatacagtgccagttaagtcgcctgaaatatccacctttcgctaagaagtggatcaacattagaaagagttacgggaatttctacaaggtgcctcgttcacaaaccaaactgactatcatgctcgaaaagctcggaatggattatgacgggagaccccactgcggacttgacgactcgaaaaacatcgccagaatagccgtaaggatgctccaggacggttgcgagctgcgcataaacgagaaaatgcacgccggtcagctcatgtccgtctcttcttcgctgccaatcgagggcacaccaccccctcagatgccccacttccgtaagtag

SEQ ID NO: 31100 - DNA, 429 bp, Artificial Sequence
  Description of Artificial Sequence: Synthetic coding sequence
atgcccagtatcaaactgcaatcttcagacggcgagatcttcgaagtcgatgtagagatcgcaaagcagtctgtcactattaaaacgatgctcgaagacctggggatggatgacgaaggcgacgacgaccccgtgccactgccaaatgtcaacgcagccattttgaagaaggtcattcagtggtgtacccaccacaaggacgatcctccacctcccgaagatgacgaaaacaaagagaagcggacagatgacataccagtgtgggaccaggaattcttgaaggtggaccaggggactttgtttgagctgattcttgcggcaaactacctcgatattaaggggctactcgacgtgacatgtaaaactgtggctaatatgatcaaagggaagactccagaagagatccgaaagacttttaacatcaaatag

SEQ ID NO: 31101 - DNA, 375 bp, Artificial Sequence
  Description of Artificial Sequence: Synthetic coding sequence
atgtccgctaccgtggtagatgccgtgaacgctgctcccctctctggatccaaagagatgagtcttgaagagcctaaaaaaatgacccgagaagactggcgcaagaagaaggaattagaggaacagagaaagctgggcaacgccccagctgaggtggatgaagagggtaaggacattaaccctcacataccccagtatattagtagtgtgccgtggtatatcgacccatcaaagaggccaactctcaagcatcaaaggcctcagccagagaagcagaagcagttctcctcaagcggggagtggtataaacgtggggtgaaagagaactcgatcatcacaaagtatagaaaaggggcatgcgagaactgtggctag

SEQ ID NO: 31102 - DNA, 750 bp, Artificial Sequence
  Description of Artificial Sequence: Synthetic coding sequence
atggtggatcggttggccaacagcgaagccaatactcgcagaatatccatagtggagaattgcttcggggctgcaggacagcccctgaccatcccagggagggtccttatcggcgaaggagtactgacgaaattatgtcggaaaaaaccaaaggcccgacagtttttcttatttaacgacatcctggtttacggcaatattgtgatacagaagaagaagtacaacaagcagcatataattcctttggagaatgtcaccatcgacagtattaaggacgagggagatctgagaaacggttggctgataaagacccccactaaatcatttgcagtatatgcagcgaccgcaaccgagaagtctgagtggatgaatcacattaacaagtgcgtgactgacctgcttagcaagtccggcaaaacgccctcaaatgaacacgccgctgtgtgggttcctgatagcgaggcgaccgtctgcatgcgctgccagaaggccaagttcacacccgtcaatcggaggcatcactgccggaagtgtgggtttgttgtctgcggtccctgtagtgagaagcgcttccttcttccctctcagtctagtaagccggtccggatctgcgatttctgttacgacctgctgagcgcgggtgatatggcgacatgccaaccggctaggtcagattcctattcccagagccttaagtctcctctgaatgatatgtcagacgacgacgacgacgacgacagttctgattag

SEQ ID NO: 31103 - DNA, 120 bp, Artificial Sequence
  Description of Artificial Sequence: Synthetic coding sequence
atgaaattcaatccatttgttaccagtgaccgctcaaaaaatcggaagcgtcactttaacgcaccaagtcacgtgcgaagaaagataatgagtagcccccttagcaaggagctccgctag

SEQ ID NO: 31104 - DNA, 1401 bp, Artificial Sequence
  Description of Artificial Sequence: Synthetic coding sequence
atggggtggatcactgaggatcttatccgcagaaacgctgagcataatgattgtgtcatcttttccctggaggaattgagcctgcaccagcaggaaatagagcggctggaacatatagacaagtggtgtagggatctgaagatcctgtatctgcagaataacctgatcggcaaaatagagaacgtttcaaaactcaagaagcttgagtatctcaatcttgccctgaataacatcgaaaagatcgaaaatctcgagggttgcgaggagcttgccaagctggacctgacggtcaatttcataggtgagctctcgtccataaagaacctgcagcataacatccatctgaaggagctcttccttatggggaacccctgtgccagctttgaccactacagggagtttgttgtcgccaccctgccccagttgaagtggttggatggaaaagagatcgaaccgagcgagaggataaaggccctgcaggactacagcgttatagaacctcagattagagaacaagaaaaggaccattgcctcaaacgcgcaaagcttaaggaagaagcccagagaaagcaccaggaagaagataagaatgaggataagcgatctaatgctggatttgacggacgctggtacacagatatcaatgccactctgagcagcttagagtccaaggatcacctccaggcaccagacaccgaggagcacaacactaagaagttggacaactccgaggatgatttggaattttggaataaaccttgcttgttcactccagagtcaagactggaaactctacggcacatggagaagcagagaaaaaagcaggaaaaacttagcgaaaagaaaaaaaaagtcaagcccccacggacactcatcaccgaagacggcaaggctctgaacgtaaacgagcctaaaattgactttagcctgaaggacaatgagaagcaaattatcttagacctcgccgtgtatcggtacatggatactagcctcatcgacgtggacgtgcagccaacctacgtgcgagtgatgatcaaaggcaaacccttccagctggtgctgcccgctgaggtgaaaccagactcatcctctgccaaacgtagccagaccaccggccacctggtcatctgtatgcccaaggtcggagaagtgataaccggcggacagagagcctttaagtccatgaagaccacatctgaccgtagtcgggaacagactaatacacgcagtaaacatatggaaaaacttgaggtggaccctagcaaacatagtttccccgacgtaactaacatcgtccaggagaaaaagcacacccccaggaggcggccagagccaaagatcatcccctctgaggaggaccccacatttgaggataatcctgaagttcccccactgatatag

SEQ ID NO: 31105 - DNA, 528 bp, Artificial Sequence
  Description of Artificial Sequence: Synthetic coding sequence
atggcatcgaatcacaagagcagtgctgctcggccagtgtcaagagggggtgtcggccttactggacgtccgccatctggcattagacccttgtcagggaatattcgcgttgccacagcaatgccaccgggaacagcgaggccgggaagccgaggatgtccaatcggcacagggggagtactcagtagtcagatcaaggtggcccaccgccctgtcacccagcagggcctcacaggaatgaagaccggaaccaagggacctcagcgtcagatactggacaagtcatattatctggggctgcttcgctctaagataagtgagctcactacggaggtgaataagctccagaaaggaatcgaaatgtacaatcaggagaattctgtgtatctgtcatatgaaaagcgcgctgagacactggcagtcgaaattaaagagttgcagggccagctcgccgactataacatgctagtggacaagctcaacaccaacaccgaaatggaggaagttatgaacgactataacatgtag

SEQ ID NO: 31106 - DNA, 438 bp, Artificial Sequence
  Description of Artificial Sequence: Synthetic coding sequence
atgaagttcaatccctttgtgacctccgaccgctcgaagaataggaagcgccacttcaacgcgccaagtcacgtcagaagaaagataatgtcttcaccgctgtcaaaggagctccggcaaaaatacaacgtgcggtccatgcctatcaggaaggatgatgaggttcaggtagtgcgcggacattacaagggtcaacagataggtaaagttgtgcaggtctatcggaaaaaatatgtgatctatatcgagagagtacagcgtgaaaaggctaacggcaccactgtgcacgttggcattcatccgagcaaggtggtcattactcggttaaaactggataaggacagaaaaaaaattctggaacggaaagctaagtcccgtcaggtgggaaaggaaaaaggtaagtataaagaagagcttattgagaagatgcaggagtag

SEQ ID NO: 31107 - DNA, 2136 bp, Artificial Sequence
  Description of Artificial Sequence: Synthetic coding sequence
atgtcttctgtgcaatctcagcaggagcagctgagccagtccgacccctctccctcacccaattcttgtagctccttcgaattgattgacatggacgccggaagcctatatgaaccagtatccccccactggttctactgtaagattatcgatagcaaagagacatggataccatttaattcagaggatagccagcaactcgaagaggcctatagctctggtaaggggtgtaacgggagggtggttcccacagatggaggcagatatgatgtccacctgggagaacgcatgcggtacgccgtttattgggacgagttagcttcagaggtgaggcgatgtacatggttctataaaggagataaagacaacaagtatgttccttattccgaaagctttagccaggtcctggaggaaacgtatatgctggccgtgaccctggacgaatggaaaaagaagctggaatcgcccaatagagagataattatactccacaatcccaagttaatggtccattaccagcctgtggcgggtagcgatgactggggatccacacctaccgagcaggggcgtccccgtacagttaaaagaggagtcgagaatatctcagtggacattcactgcggcgagccattgcagatcgaccacctggttttcgtggtgcacgggatcggccctgcctgcgacctgcgcttccggtccattgtacaatgcgtgaatgatttccgctctgtgtccttgaacttgctccaaacccactttaaaaaggcccaggaaaatcagcagatcggacgggtcgaatttctgccggtgaattggcactccccattgcacagcacaggagttgacgttgacctgcagaggatcactcttccatccattaacaggttgaggcacttcacaaacgatacaatcctggatgtttttttctacaactctcccacatattgccagacaatagtggacacagtagcgagcgagatgaacagaatttacacactgtttctgcagaggaatcccgacttcaaaggaggggtctctatcgcaggacacagcctgggatccctgatcctgttcgacattctcacaaaccagaaagacagcctgggggacattgattccgagaaagattcacttaatattgtgatggaccagggggacacccctacgctcgaggaggacctcaagaaacttcaattgagcgaatttttcgacatcttcgagaaggaaaaggtagacaaggaggcactcgccctctgcacagatagagacctgcaggagattgggatccctcttggcccaaggaaaaagattctgaattacttctctactcgaaaaaattcgatgggaataaaacgccctgcaccacagcctgcatccggagcaaacattccaaaagagagcgaattctgctcaagttcaaataccaggaatggcgactatctggacgtcgggatcggccaggtttctgtgaaatacccacggctcatatataagcctgagatttttttcgcctttgggtctccaatcggtatgtttcttactgtgaggggactaaagcgaatcgaccctaattacaggtttcccacttgtaaggggttttttaatatctatcacccattcgatcccgtagcttatagaatcgaacccatggttgtcccaggggtggaattcgaacctatgcttatccctcaccacaaaggcagaaaaaggatgcatctggaattgagagaagggttgaccagaatgtccatggacctaaaaaataacctcttgggctctctaagaatggcctggaagtctttcacccgcgcaccctacccagctctccaagcgagcgaaacccctgaggagacagaagcggaaccggagtcaacatccgagaaaccatcagatgttaacactgaagagacgtcagtagctgtgaaggaggaagtattgcctattaatgtgggaatgttaaatgggggacagaggatcgattacgttctgcaggagaagcctatcgagagttttaacgagtacttgtttgcactgcagtctcacctgtgctactgggagagcgaggacacagtgttactggtactgaaggagatatatcagacccagggaatctttctcgaccagccgctgcagtag

SEQ ID NO: 31108 - DNA, 471 bp, Artificial Sequence
  Description of Artificial Sequence: Synthetic coding sequence
atggcgtcggtgctttcgagacgtctcgggaaacgatccttactgggcgcacgggtcctcggtccttctgccagcgagggtccatcggccgctcccccttctgagccactcctcgagggcgcagcaccacagccattcactacaagcgacgacactccttgccaggaacagcccaaggaggtcctcaaagccccaagtacttcaggacttcagcaggttgccttccagcctggccagaaggtgtacgtctggtatggcggtcaggaatgcacagggttggtagaacagcactcatggatggaagggcaggttacagtctggctgctggagcaaaagctccaggtctgctgcagagtcgaggaagtgtggcttgcggagctccaagggccttgccctcaggcaccccctctagagccaggcgctcaggccctggcttacaggccagtatcccgtaatattgacgtgccgtag

SEQ ID NO: 31109 - DNA, 309 bp, Artificial Sequence
  Description of Artificial Sequence: Synthetic coding sequence
atgccgtctattaaactccagagctctgatggcgagatttttgaggtcgatgtcgagattgccaagcagagcgttactattaagaccatgctcgaagacctgggaatggacgacgagggggatgacgaccctgtccctttgcccaacgtgaacgctgcaatattgaagaaggtgattcagtggtgcacacatcataaagacgaccccccaccacccgaggatgacgagaacaaggagaagaggaccgacgatataccggtgtgggaccaagagtttctgaaggtggatcagggcacattattcgagtag

SEQ ID NO: 31110 - DNA, 465 bp, Artificial Sequence
  Description of Artificial Sequence: Synthetic coding sequence
atggcggatgatctagacttcgagaccggagacgctggagccagcgctacctttcccatgcagtgtagtgccctgaggaagaatgggtttgtcgtattaaaggggtggccctgtaaaattgtggaaatgtcggcctcgaagaccggtaagcatggacacgcaaaggttcacctcgtgggcatcgatattttcaccgggaagaaatatgaagatatttgtccgtcgacacataatatggatgtcccaaacataaaaaggaacgatttccagctgattggaatccaggatggctatctgagccttttgcaggacagcggggaagtgcctgaagatctacggttgccagaaggagacctgggcaaggaaatcgaacagaaatacgattgtggtgaggaaatcctgatcaccgttctctccgcaatgactgaggaggcagctgtggctataaaggccatggctaagtag

SEQ ID NO: 31111 - DNA, 306 bp, Artificial Sequence
  Description of Artificial Sequence: Synthetic coding sequence
atgtccgccactgttgtagatgccgtgaacgcagctccactgagcggcagcaaggagatgtccctggaggaaccgaagaaaatgacgcgtgaagactggcgcaagaagaaagaacttgaagagcaacggaaactgggtaacgcacccgcagaagtagacgaagagggcaaagatataaacccccatatacctcagtatatcagcagcgtcccctggtacatcgacccctcaaagcgtcccaccctgaagcatcaacggccacagccagaaaaacaaaaacaattctcttcctctggggagtggtag

SEQ ID NO: 31112 - DNA, 3201 bp, Artificial Sequence
  Description of Artificial Sequence: Synthetic coding sequence
atggcgggtgcactcaggcggggaagagcgctgggtagtcggccttctggcccaaccgtatctagcagacggagcccccaatgccctgtggctcaagagggattaggagcaaggtcacgaccgagagtagcacccagatccttggctaggtgcgggccaagcagtcggttgatgggatggaagccctccgaagcacgcggtcagagccaatccttccaagcatccgggctgcagcctcgatcgttgaaggcagccaggcgggcaaccggtagaccagaccggagccgagccgctcgccctacaatggatccaagcgcccaccgttcaagagcagcacctcccaatatggatcccgacccccaagcaggagtccaggtgggcatgcgcgttgtaagaggtgtcgactggaagtggggacagcaggatggaggggaggggggagtgggcacggtagttgaacttgggcgtcatggtagcccaagtacaccagatcgaacagttgtcgtgcagtgggatcaggggaccagaaccaactacagggcaggttaccagggagcccatgatctcctgctgtacgacaacgcgcaaattggagtccggcatcccaatatcatctgtgactgctgtaagaagcacggactgagaggaatgaggtggaagtgtagagtgtgcctcgactatgatctctgcacgcagtgctacatgcataataagcatgaactggctcatgctttcgataggtacgagacagcacattctcgccctgtgactttgagcccgagacagggcctgcccagaatacctctccggggaatttttcagggcgcaaaagtggttaggggcccagactgggaatggggtagccaagatggcggagaggggaagcccggacgggtggtagacattcggggatgggacgtggaaaccggccgaagtgtggcgtctgtgacatgggcagacgggacaacaaacgtctaccgggtgggtcataaagggaaagtggaccttaaatgcgtaggtgaagccgcagggggattctactacaaggatcatctgcctagactcggaaaacccgcagagctgcagagacgagtgagtgcagactcccagccctttcagcatggcgataaggtaaagtgtctcctcgataccgatgtcctgcgagaaatgcaagagggccacggcggatggaacccacgaatggccgagacagggacagtacacaggattaccgatcggggagacgtccgcgtgcagtttaatcatgaaacaagatggacgtttcatcccggtgcgcttacaaagcatcactctttctgggtcggtgatgtcgtgagagtcatcggtgatctagatacagtaaaacggctccaggccggtcacggagagtggactgacgatatggcgcctgccctgggcagggtgggtaaagttgtgaaggtgtttggagacggcaacttacgggtggcagtcgctgggcagcgctggactttcagccccagttgtctggtggcctaccgccctgaagaggatgcgaaccttgacgtggcagaacgtgcacgagaaaataagagttcgctgagcgttgcgcttgacaagttgcgggctcagaagtccgaccctgaacatccgggaagactcgtagtggaagttgccctgggaaatgctgcaagggctttggatctgctgaggcgcaggccagagcaggttgacacaaagaatcagggccgtaccgccctgcaggtcgccgcatacctgggccaggtcgaactaatcagactgctgcttcaggcccgtgctggggttgatctcccagatgacgaggggaatacagctctgcattacgccgctcttggcaaccaacccgaggccacccgcgtgctcctgagcgcaggctgccgagcagacgctattaactcaacacagtctactgcattacacgttgcggtgcagaggggtttcttggaggtggtaagggccctgtgcgaacgcggatgtgacgtgaatcttcccgacgcccactctgataccccactgcactctgcaatcagcgccggaacaggggcaagtggaatcgtggaagtgctgactgaggtaccaaacatagacgttaccgcaacaaatagccagggattcacgttactccatcatgcatcactcaaggggcatgcccttgccgtgagaaagatcctcgccagggctaggcagttggtggatgccaagaaagaggatgggttcaccgccttgcacctggcggctttaaacaaccaccgagaggtggctcagattctgataagagagggcaggtgtgatgtgaatgttagaaaccggaagctgcagtctcctctccacctcgctgttcagcaggcgcacgtcggcttggttcctctgctggtggacgcgggatgctcggtaaatgctgaggacgaggagggtgacaccgcattacacgtggcactgcaacgccatcagttactgcctcttgtcgccgacggggctggaggtgatccagggccactccagcttctctcacgcttgcaggcctcaggtctcccaggatctgccgagcttacagttggggctgctgtggcatgcttcctcgccctggaaggagcagacgtttcatacacaaaccatcgagggcgatcccccctggatctcgccgctgagggcagagtactaaaggccctgcaggggtgcgctcagaggttccgggaaagacaggcaggcggtggtgccgcacctggccctagacagaccctcggaacacccaacactgtcaccaacctgcacgttggggcagctcccggtccggaggccgcagagtgtctggtgtgttccgaactagcactcttggttctcttctcaccctgccagcacaggaccgtgtgtgaagagtgcgctcggagaatgaaaaaatgtatacggtgtcaggtcgtggtctctaagaagctgcgccctgacggctcggaggttgcctccgccgcacccgctcctggccctcctaggcagctggtggaggagttgcagtcaaggtaccgtcagatggaggagagaatcacttgcccgatctgcatcgacagtcatattaggctggtattccagtgtggtcacggcgcttgtgcgccttgcgggtctgccctatccgcttgtcccatctgtagacagccaattcgggaccggattcagatcttcgtgtag

SEQ ID NO: 31113 - DNA, 348 bp, Artificial Sequence
  Description of Artificial Sequence: Synthetic coding sequence
atgatgctgggaaccgaaggcggagagggcttcgtcgtcaaggtgaggggcctgccgtggagctgcagcgcggacgaagttcagcgcttcttctctgactgcaagatccagaatggagcacagggcatacggtttatctatacaagggaaggacggcctagcggggaggctttcgtcgagctggagagcgaggacgaggtgaagctcgcactgaagaaggacagggaaactatgggacaccgatacgtggaagtgttcaagtccaacaatgtggaaatggattgggtcctgaaacatacggggccaaactcccccgatactgccaacgacggcttcgtcaggctgtag

SEQ ID NO: 31114 - DNA, 375 bp, Artificial Sequence
  Description of Artificial Sequence: Synthetic coding sequence
atggcttctgtgctcagccggagattggggaagcggtcgctgttgggtgcacgtgtgctcggcccttccgccagtgaaggcccatccgccgctccccctagtgagccattactcgaaggcgctgcgcctcaaccttttactacgagcgatgataccccctgccaggaacagcccaaagaagtgctgaaagcaccgtccacgagcggcctgcagcaggttgccttccagcctggccagaaagtctacgtgtggtatgggggtcaagaatgtactggcctagttgagcaacatagctggatggaaggtcaagtcacagtctggttgctggagcaaaaactgcaagtttgctgcagagtggaggaggtgtggctctag

SEQ ID NO: 31115 - DNA, 438 bp, Artificial Sequence
  Description of Artificial Sequence: Synthetic coding sequence
atgaaattcaacccatttgtgacctctgatcgttccaaaaacaggaaaagacacttcaatgccccaagccatgtgcggaggaagatcatgtcctcccccctctctaaagagctgagacagaagtacaatgtgaggagcatgccgattcggaaggacgacgaggtacaggtggtgcgaggccactacaaagggcagcagattggaaaggtggttcaggtttaccggaaaaaatatgtgatttacattgagagagtccaaagagagaaagcaaacggaactacagtccatgttggaatccacccttccaaggtagtgattacccggctgaagctggataaggaccgcaaaaagatcctggagcgcaaggccaaatctagacaggtgggaaaggaaaaagggaagtacaaagaggaactcatcgaaaaaatgcaggagtag

SEQ ID NO: 31116 - DNA, 339 bp, Artificial Sequence
  Description of Artificial Sequence: Synthetic coding sequence
atggattcagaactcatgcatagtattgtgggtagctatcacaaaccacctgaaagggtgtttgtgcccagtttcacccagaatgaaccttctcagaactgccatcctgccaatctggaggtgacttcccccaagattttacattcccctaatagccaagccctgattctggcattgaagactctccaagagaagattcaccgtctcgaactggagcggacacaggccgaagacaaccttaatatcctctccagagaagccgcacaatacaaaaaggctctggaaaatgagacaaacgagagaaacctggcccatcaggagctgatcaagcagaaatag

SEQ ID NO: 31117 - DNA, 345 bp, Artificial Sequence
  Description of Artificial Sequence: Synthetic coding sequence
atgccatccgccgaggctaagctcaagaaaaatcgctgcgccaactgtttcgactgccccggatgcatgcacaccttgtctacccgggcaacctccatcagcacccagctgccagatgatcccgcaaagacaacaatgaagaaggcttactatttggcttgcgggttttgtcgctggacgagtagagacgtgggcatggccgacaaaagcgtggccagtgggggttggcaggaaccagagaacccacatacgcaacggatgaataagctgatcgaatattatcagcagctggcacaaaaggaaaaagtggaacgtgatagaaagaagttagctaggagacggtag

SEQ ID NO: 31118 - DNA, 648 bp, Artificial Sequence
  Description of Artificial Sequence: Synthetic coding sequence
atgcccggagaagccaccgagacagtgcctgccaccgaacaggaactcccacagtcacaggccgaaaccggatccggtacagccagcgactctggagagagcgtccctggtatcgaagaacaggatagcacgcagacaaccacacagaaagcatggctcgtggccgcagcggaaattgacgaggagcccgtaggtaaagccaaacagtcacggtctgaaaaacgtgctcggaaggccatgtcaaaattgggactgctacaagttacaggtgttacacgtgtaaccatctggaagtctaaaaatatactcttcgtaattaccaagctggatgtctacaagtccccggcatctgacgcctacatcgtgttcggcgaggcaaaaatccaggacttgtcccagcaggcgcagctggccgcagccgaaaagtttcgcgttcagggggaagccgtgggcaacatccaggagaatactcagactccaaccgttcaagaggagtccgaggaggaagaagtggacgaaaccggcgtcgaggttaaagatgtaaagcttgttatgtctcaagcgaacgtaagccgggcaaaggcagtccgcgctctcaagaacaattctaatgacatagtcaacgcgattatggaactcactgtgtag

SEQ ID NO: 31119 - DNA, 432 bp, Artificial Sequence
  Description of Artificial Sequence: Synthetic coding sequence
atgtctgccacagtggtcgatgccgtgaacgctgcgcctctatcaggctccaaagagatgtccctcgaggagcccaaaaaaatgactagggaggattggcgtaagaagaaggagttggaagaacagcgcaaattagggaatgcccctgccgaggtggacgaggaggggaaggatataaatcctcacatcccacaatatatctccagcgtgccttggtacatcgatcccagcaaaagacccacattgaagcatcagaggcctcagcctgaaaaacaaaagcagtttagcagttccggggagtggtacaagaggggcgttaaggaaaattcaattatcaccaagtaccggaaaggggcatgcgaaaactgcggggctatgactcacaagaagaaagattgcttcgaacggcctcgcagggtaggagccaagtag

SEQ ID NO: 31120 - DNA, 567 bp, Artificial Sequence
  Description of Artificial Sequence: Synthetic coding sequence
atggcctccgttctttcgagacgactgggaaagaggtctctgttgggggctcgcgttctcggacccagtgcttccgaagggcctagtgcagcccctccctccgaacctctgctcgaaggcgctgcacctcagccatttactacgtctgacgataccccatgccaggagcagcctaaggaagtccttaaggccccttctacatcagggctgcaacaggtcgcattccagcctggtcaaaaggtttatgtctggtatggtgggcaggaatgcaccggactcgtggagcagcattcatggatggaaggacaggtgactgtatggctacttgagcagaaactccaggtgtgctgcagagttgaagaggtgtggttggccgaactccagggaccctgcccacaagctcccccacttgaaccaggggcacaggcccttgcatatcggcctgtctcaagaaacattgacgtgcctaaacggaaaagcgacgctgttgaaatggacgaaatgatggccgctatggtgctaacatcactgtcttgtagccccgtggtccagtcaccccctggctag

SEQ ID NO: 31121 - DNA, 87 bp, Artificial Sequence
  Description of Artificial Sequence: Synthetic coding sequence
atgatgctaggcacagagggaggcgagggatttgtcgtgaaggtgagaggcctgccctggagttgtagtgctgacgaggtgcaatag

SEQ ID NO: 31122 - DNA, 87 bp, Artificial Sequence
  Description of Artificial Sequence: Synthetic coding sequence
atggatagcgaactgatgcacagcatagttggatcctaccataagcccccagagagagtgttcgtcccctcctttacccagaattag

SEQ ID NO: 31123 - DNA, 1074 bp, Artificial Sequence
  Description of Artificial Sequence: Synthetic coding sequence
atgggcggagccgtgtcagcaggtgaagacaacgatgacctgatagacaatctgaaggaggctcagtatattagaacagaacgtgtagagcaggcattccgcgcaatcgacaggggcgattattatctggaagggtacagggacaacgcgtacaaggacctggcgtggaaacacggtaacattcatctcagtgcaccttgtatatattccgaggtgatggaggccctcaaactgcaacccggtctgagttttctgaacctgggcagcggtactggatacctgagcacaatggtcgggttgatccttggtccctttgggatcaatcacggcatcgagctgcatagcgacgtggtggaatacgccaaagagaagttggagtccttcattaagaattccgatagcttcgataaatttgagttttgtgagcccgcatttgtggtgggtaattgcctacagatcgcgagtgactctcaccagtacgaccggatctactgtggagccggagtgcagaaggatcatgaaaactatatgaagatcctgctgaaggtagggggaattttagttatgccgatcgaagaccaactgacccagattatgcggacagggcaaaacacctgggaatcgaagaatattctcgctgtgtcctttgcccctctggtgcagccctctaaaaacgataacggcaaaccggattctgtagggttacccccttgcgccgtacgaaacttgcaggacctcgcaagaatctatattcggagaacccttaggaacttcataaacgacgagatgcaggccaagggtatcccacagcgtgcccctcctaaacgcaagcggaagcgggtcaagcagcggataaatacttacgtgttcgtaggcaatcagctgatcccgcagccactagattccgaggaagatgagaaaatggaagaggacaacaaagaggaggaggagaaggatcacaacgaggctatgaagcctgaagaaccacctcagaacctgttgagggaaaagataatgaagcttccactccccgagtcactaaaggcgtatctgacctacttcagggataaatag

SEQ ID NO: 31124 - DNA, 483 bp, Artificial Sequence
  Description of Artificial Sequence: Synthetic coding sequence
atgccatccatcaaactacagagctccgatggggaaattttcgaggtggacgttgaaatagccaagcagtctgtgaccataaaaacaatgctggaggatttgggaatggacgacgaaggtgatgacgatcctgttccgctgccaaatgttaatgccgctatcctgaagaaggtgattcagtggtgcacacaccataaagatgaccccccacctccagaagacgatgagaataaagaaaagcggacagacgacattccagtctgggaccaggaatttctaaaagtggatcagggcacactcttcgagcttattctggcggcaaactatctggatatcaagggtctgttggacgttacctgcaaaaccgtcgcaaatatgatcaaaggaaaaacgcctgaagaaattaggaagactttcaatatcaagaacgacttcaccgaggaggaagaggcccaggtcgggagtacgcagttctgtctgtag

SEQ ID NO: 31125 - DNA, 342 bp, Artificial Sequence
  Description of Artificial Sequence: Synthetic coding sequence
atggacagcgaattgatgcacagcatagtcgggagctaccataagcccccagaacgggtcttcgtgcccagtttcacccagaacgagccatcccagaattgtcaccctgccaatctcgaagtgacctccccaaagattcttcactctcccaactctcaggccttaattctagccctgaaaacactgcaagagaaaatccatcggcttgagcttgagcggacccaggcagaagacaatctgaatatcctgtcacgggaagctgctcagtacaaaaaggccctcgagaatgaaaccaacgaaagaaatctggcccatcaggaactgatcaagcaaaagaaatag

SEQ ID NO: 31126 - DNA, 309 bp, Artificial Sequence
  Description of Artificial Sequence: Synthetic coding sequence
atggcaagcgtcttaagcagaagactaggaaagcgctcattactcggcgcaagggttctgggacctagcgcaagtgagggaccttcagccgctcctccctcagaacccctgctcgagggcgcagctcctcagccatttacaactagcgatgatacaccctgtcaggagcagcccaaagaggttctaaaagccccaagtacaagtggtttacagcaggtggcgttccaacctggtcagaaagtgtacgtatggtacgggggacaggagtgtaccggcctggtggaacagcattcctggatggaaggttag

SEQ ID NO: 31127 - DNA, 492 bp, Artificial Sequence
  Description of Artificial Sequence: Synthetic coding sequence
atgccatccattaagctccagtcttccgacggggagattttcgaggtggacgtggagattgccaaacagtcagtgaccatcaagaccatgctggaggacctagggatggatgatgagggcgacgatgatcctgtgcccctgcccaatgtgaacgcagcgatccttaagaaggtgattcagtggtgcacacaccataaggatgaccctccaccaccggaggacgacgaaaacaaggaaaagcggactgatgacattccagtctgggaccaggaattccttaaagtggaccagggcacgctttttgaactcatcctcgcggcaaactacctggatatcaaaggcttattagacgtgacctgtaagaccgtggctaatatgatcaaaggcaagacccccgaagagatccggaagacatttaatatcaagaatgacttcaccgaggaggaggaagcccaagtgcgcaaggaaaatcaatggtgcgaagagaagtag

SEQ ID NO: 31128 - DNA, 441 bp, Artificial Sequence
  Description of Artificial Sequence: Synthetic coding sequence
atgtgtccagggaattggttgtgggcctccatgaccttcatggcgaggttcagcaggagctccagccgcagtcccgtgaggactcgtggtactttggaggagatgccaactgtgcagcacccttttctcaacgttttcgaacttgagagacttctgtacacaggcaaaacagcctgcaatcacgctgacgaagtctggccagggctgtacttgggcgatcaagatatggccaacaataggcgcgagctccggaggctaggcattacccacgtgctaaacgcctctcacagtaggtggagggggactcctgaggcatacgagggcttaggtattcggtatttgggcgtagaggctcacgatagtcccgcatttgacatgtccattcattttcagacagctgctgatttcatacacagagccctgtcacagccaggcggttag

SEQ ID NO: 31129 - DNA, 1542 bp, Artificial Sequence
  Description of Artificial Sequence: Synthetic coding sequence
atggccagcgtcctgtcaagacgcttagggaagagatcactgctgggggcaagagttctcggaccttccgcatcagaaggcccttccgccgctcctccgagcgaacccctgctggagggcgctgcccctcagccttttacgacaagcgacgacacaccttgtcaggagcagccaaaggaagtgctcaaagccccttccaccagcggcttgcaacaagtcgcgtttcagccagggcagaaggtatacgtctggtatggcggacaggagtgcacaggcctcgtcgaacagcattcctggatggagggtcaagtcacagtctggctgctcgaacagaagctacaggtttgttgtagagtagaagaggtctggctcgcagagttgcagggaccctgtccccaggcgccacctctggaacccggagctcaggcattagcttataggcctgtgtctcggaacattgatgtgccaaaacgcaaatctgatgctgtggagatggatgaaatgatggccgcaatggtgctgaccagtctctcgtgttctcccgtggtccagtccccccctgggaccgaggcgaattttagtgccagtcgcgctgcctgtgacccttggaaggagagcggagacatcagcgactccggctctagcacaacaagcgggcactggtctggcagtagtggagttagcacaccgtcacccccacaccctcaggcctccccaaaatatctgggagacgcctttggcagtcctcagacagaccatggcttcgagaccgatcctgacccttttctgctggatgaaccagcgcctagaaagagaaaaaactcagtaaaggtcatgtataaatgcctttggcctaattgtgggaaagttcttagaagcattgtgggcatcaagagacacgtgaaggcgctgcacctcggcgacaccgtcgactccgaccagttcaaacgggaagaggacttctactatacagaagttcagctgaaggaggagagcgcagcagccgcagctgccgcagcggcaggaacccccgtgcccggtacacctactagcgaacctgcacccacgcctagcatgacaggcctccccctcagtgctcttccccctccattacacaaagctcaaagtagcggtccagaacatccagggccagagtcgtccctcccgtcaggagccctgtccaagtcagccccaggtagtttttggcatattcaggccgaccatgcatatcaggccctacccagcttccaaatacctgtgagcccacacatttacaccagcgtcagttgggccgctgccccatccgctgcctgttctctcagccccgtgcgatccagatctcttagtttcagtgaaccccagcagcccgcacctgccatgaaatcacacttaatcgtcacttctccccctcgcgctcagtccggtgccagaaaagcgaggggcgaggccaagaagtgtagaaaggtgtacgggattgagcacagggaccagtggtgtaccgcctgtcggtggaagaaggcctgtcagaggttccttgattag

SEQ ID NO: 31130 - DNA, 438 bp, Artificial Sequence
  Description of Artificial Sequence: Synthetic coding sequence
atggcagtctccactggcgtgaaggtgccacgcaatttcagacttctcgaggaactcgaagaaggccagaagggggttggggatggcactgtttcctggggactggaagatgatgaggatatgacactcacccggtggaccggaatgataataggccctccaaggacaaactatgaaaacaggatctactcactcaaggtggaatgcggtcctaagtacccagaagcccctccgagcgtcagattcgtgactaaaatcaatatgaacggcatcaataacagcagcggcatggtcgacgctcggtcgattcccgtcctggcgaagtggcaaaactcctattccatcaaggtcgtccttcaagagctgcgtcggctgatgatgtcaaaggaaaatatgaagctgcctcagccccctgaaggccagacctacaacaactag

SEQ ID NO: 31131 - DNA, 1542 bp, Artificial Sequence
  Description of Artificial Sequence: Synthetic coding sequence
atggcgagcgtgctgtcacgccgactggggaaacggtccctcctgggggcacgggtcttgggaccatctgcgtctgaagggccttccgctgcaccgccttctgagcctctgctggaaggcgcagcaccccagcccttcaccactagcgacgacactccttgtcaggagcagcccaaagaggtgttaaaggctcccagcacgtcaggcttgcagcaggtggcctttcaaccagggcagaaagtctacgtctggtacgggggacaggagtgcactggacttgtcgagcagcacagttggatggagggacaggtgaccgtgtggctgctggagcagaagttgcaggtgtgctgccgcgttgaagaggtttggctggctgagttacaagggccatgtccccaagctcctccccttgagcctggtgcccaagcgcttgcgtatagacctgtgagccggaatattgacgtccccaaaagaaagtcggatgcagtagagatggacgagatgatggccgctatggtgctgactagcttgagctgcagcccagttgtccagtctccacccggaacggaggccaacttttctgcaagtagagccgcttgcgatccctggaaagagtccggcgacatatctgacagcggcagctcaacaaccagcggacactggtctggctcaagtggtgtctctactccttcacctccccatccccaggcaagtcccaaatacttaggagacgcattcggcagcccccagacagaccacggattcgagacagatccggatcctttcctgctcgatgaaccagcacctaggaagcgtaaaaattccgtgaaggtcatgtataaatgtctgtggcccaattgtgggaaggtactgcgtagcatcgttggcattaagcggcatgtgaaagcactccacctcggtgataccgttgacagcgatcaattcaagcgagaggaagacttttattacactgaagttcaattgaaggaggagtctgccgctgccgcagccgctgcagcggctggtacccctgtgcctggcactccgacatcagagcccgcacctacaccatctatgaccggcctgccactttcggcactcccacccccactgcacaaagcacagagcagcggacccgaacacccgggtcccgagtcaagcctgccctcaggcgctctttctaagtctgctccgggtagcttctggcacatacaggccgatcatgcttatcaggccctgccttcttttcagatccccgtgtccccgcacatctatacttcagtaagttgggcggctgcccctagcgccgcttgtagtctaagtcccgtacgctccaggtccctgtcattctcagagccccagcaacctgctcccgcaatgaaatcccatcttattgttacgagtcctccccgagcacaatctggagcccgaaaagctcgaggtgaggccaagaagtgtaggaaggtatacggtatcgaacatcgagaccagtggtgcactgcgtgccgttggaaaaaagcttgtcagcgttttctggattag

SEQ ID NO: 31132 - DNA, 57 bp, Artificial Sequence
  Description of Artificial Sequence: Synthetic coding sequence
atgccatcgattaaacttcaaagcagcgacggggagatcttcgaggtagacgtctag

SEQ ID NO: 31133 - DNA, 1935 bp, Artificial Sequence
  Description of Artificial Sequence: Synthetic coding sequence
  Description of Combined DNA/RNA Molecule: Synthetic coding sequence
gttgctagcgaggggagtgtgaggcgcccaagcgggccagtacccgcacctcagccacccgcttttcggtttgtgtcacgtccgggtcgtgcacggagcgagagtgagactctagaacgctccccaccacaaagccccggtcctgggaaggccggagacgctcctaatcgccgaagcgggcacgtgcgcggtgccagggtgctttccccccctggtcggagagcgcgactgagttctcctggcccaagccgcagctccgaggcccgagaagaactgcgacgccacttagtgggactcattgaaaggagcagggtcgtgatctttagtaagagttactgtcctcatagcactagggtcaaagagctttttagctccttgggagtcgaatgtaacgtgttagagctcgaccaggtggacgacggcgctcgggtgcaggaggtactgagcgagatcacaaatcagaaaacggtgcccaatattttcgtgaacaaggtacatgtgggcggttgcgatcagactttccaggcctaccagtcagggcttctccaaaagctgctgcaggaggatctcgcatacgattatgacctcataataatcggtggcggttctgggggactcagctgcgcgaaggaggccgcaatccttgggaaaaaggttatggtcctcgatttcgtagttccatccccccaaggcacctcttgggggctaggagggacatgcgtgaacgtgggctgcatcccaaagaaattgatgcaccaagcggcactcttgggtcaagccttatgcgactccagaaagttcgggtgggagtataaccagcaagtgcgccataactgggaaaccatgactaaagctatacagaaccacatctccagcctgaactggggatacagactttctctacgagagaaggccgttgcctatgtgaattcatacggcgaattcgtggaacaccacaagatcaaggcaaccaataaaaaggggcaggaaacatactacactgcagcccagttcgtgatagcaacaggtgaaagacccaggtatctgggtatacagggagacaaagaatactgcatcacctctgatgacttatttagtctgccatactgcccgggtaagaccctcgtggtgggcgcatcatacgtggcacttgagtgtgctgggtttctggccggattcggccttgatgtgacggtcatggtgagaagtatactccttcggggattcgatcaggagatggctgaaaaggtggggtcatatatggaacagcacggcgtaaaatttctgcgtaagttcattccagtaatggtgcaacaactggagaagggaagtccgggaaagctcaaagtcctggccaaaagcaccgaaggaaccgaaaccattgagggggtctataacactgttttgttggccattgggcgagactcttgcacgcgcaagattggcctggagaagatcggggtgaagatcaacgagaagagcgggaaaatccctgttaatgatgtggaacagaccaatgttccctatgtctatgctgtgggcgacatcttagaggacaagcctgagttgacacctgtggcgattcagagtgggaagctcctggctcagagactgttcggcgcatctctagagaagatttaccatacactattttggcctctggaatggaccgttgctggtcgagagaacaatacttgttatgccaaaattatttgcaacaaattcgaccatgatcgggtgataggctttcacatcctcggacccaacgcaggggaagttacccagggattcgccgcagcaatgaagtgtggcctgaccaaacagcttctggacgatacgattggcattcatcccacctgtggcgaggtatttacgacccttgagatcaccaaatcgtccggcctcgacataacgcagaaaggttgcugagggtag

SEQ ID NO: 31134 - DNA, 1338 bp, Artificial Sequence
  Description of Artificial Sequence: Synthetic coding sequence
atgaacaaaggtattagtagtatcccgatcaacctgagggtgtacagtccacacgtgttgaacctgacccttatagaccttcccggtattacaaaagtcccggtaggcgaccagccccctgatattgagtatcagatccgggaaatgataatgcaatttatcacaagagagaactgcctaattctggcagtgaccccagcaaatacggacctggccaatagcgatgccttaaagctggccaaggaggtcgatccacagggactgagaacgatcggtgtgatcaccaagctggatctaatggacgaaggtaccgatgccagagacgtgctagaaaataagctcctccctcttcgcagaggttatgtcggcgttgtcaatcgcagccaaaaagacatagatggtaagaaagatattaaggccgctatgctggcagaaagaaagttttttctgtcacatccagcttaccggcacatagccgatcgaatgggcacacctcatcttcagaaggtactgaatcaacaactcacaaatcatatacgagatacacttcctaactttagaaacaagctccagggtcaactgctgtctattgagcatgaggtggaggcatacaagaattttaagccagaggatccaacacgcaaaactaaggcgcttcttcagatggtccagcagttcgctgttgactttgaaaaacgaatcgagggctctggagaccaggtggacacactggagctgagcggaggagcaaagatcaaccggatttttcatgagcggtttccattcgaaatcgtgaagatggagtttaatgagaaagagctccggcgagagatttcctatgccatcaagaatatccacggtattaggaccggactgttcacgcccgatatggctttcgaggccatcgtcaaaaaacagattgtgaaactcaaaggcccaagtctcaagtcagtggacttggtaatccaggagctgataaacactgtcaagaaatgcacaaaaaaactcgccaacttcccccgactctgtgaggaaacagagaggatcgtggctaatcacatcagagagcgtgaagggaagaccaaggaccaggtgctccttctgatcgatattcaggtatcctacattaacactaatcatgaggacttcatcggatttgccaatgcacagcagagatcatctcaagtgcacaaaaaaaccacagttggtaatcaggtgatccgaaaaggctggctgacgatctctaacattggcatcatgaagggagggtcaaaaggttactggtttgtgctcaccgccgagtctctgtcttggtacaaagatgacgaagagaaatag

SEQ ID NO: 31135 - DNA, 1560 bp, Artificial Sequence
  Description of Artificial Sequence: Synthetic coding sequence
atgctgcagctgatggattcaggaataacgatctgtctgaggaatggtgcagcatctgtgttcaaaaagaaagaatggagcactcagggtgaagaaaacaagcaagatagtaaattgaagaagctgtctgaggactccctaaccaagcagcctgaggaagtgttcgacgtgctcgagaagctgggggaaggctcttatggttcagtgttcaaggccattcataaggagtctgggcaggttgtggccattaaacaagttcccgtagagtcagatctccaggaaattattaaggagatctcgattatgcaacagtgcgatagtccatacgtagtgaagtactatggctcttacttcaagaacaccgatctgtggatagttatggagtactgtggtgctggttcagtgagcgacataatccgcttgagaaataagactttgattgaggatgagatcgctacgattctaaagtccactctcaagggactagagtacctccacttcatgcgcaagatccaccgggatatcaaagcgggaaacattctccttaacacagaggggcatgcaaaactggcggattttggtgtagctggccagttgaccgatacaatggcgaagcgtaacacggtgatcggcaccccattctggatggctcccgaagtgatccaagaaatcggttataactgtgtcgccgatatttggtctctgggaattacttcaattgagatggccgagggtaagcctccctatgccgacatccaccccatgcgcgctatattcatgattcccacgaatccccctcctacgttcaggaaacccgaactgtggagcgatgatttcaccgatttcgtcaagaagtgtttggtgaagaacccagagcagagggctaccgccacgcagttgttacagcatcccttcatcaaaaatgcaaagcccgtatcgattctgagggatctcattaccgaggctatggaaattaaggcaaagaggcacgaagagcagcagcgtgaactcgaagaggaggaggagaactcagacgaggacgaactggattcccacaccatggtgaagacaagtgtcgaatctgtggggactatgagggcaactagtactatgagcgaaggggctcagacaatgatcgagcataactctacaatgcttgaatcagacctgggtaccatggtcatcaactcggaagacgaggaagaggaggacggcacgatgaaaaggaatgccacatcaccgcaggtacagagaccaagcttcatggactacttcgataagcaggattttaagaacaagtcacacgagaattgtaaccagaacatgcatgaaccattccccatgagtaagaatgttttccccgacaattggaaggttccccaagacggtgactttgatttcctgaaaaaccttagtttagaggaactccagatgcgcctaaaggcactcgacccgatgatggaaagggaaatcgaagagctcagacagaggtacaccgccaaacgacaacctatcctggatgctatggatgccaaaaagcgtcgccagcagaacttttag

SEQ ID NO: 31136 - DNA, 1392 bp, Artificial Sequence
  Description of Artificial Sequence: Synthetic coding sequence
atgaagatcatggactcagagttgatgcactcgatcgtgggcagctaccacaagccacccgagagggtattcgtgccatctttcactcaaaacgagccctcccaaaattgccaccccgctaaccttgaagttacgtccccaaaaatcctgcactctcctaattcccaagccctgattcttgctctgaaaaccctccaggaaaaaatccaccggttggagctcgagcggacccaagcagaggacaacctcaacatactcagcagggaagccgcacagtataaaaaagctctggaaaacgagacaaacgaaagaaaccttgcccatcaggaacttatcaagcagaaaaaggacatatccattcagttgagcagcgcccagtcccgctgtacactccttgaaaagcagcttgagtatacgaagcggatggtgctgaatgtcgagagagaaaagaacatgattctcgagcaacaggctcagctccaacgcgaaaaagagcaggatcaaatgaagctgtatgccaaactggagaagttagatgtgttggagaaagaatgtttcagactcaccaccacacaaaaaacggctgaggataaaattaaacacttggaagaaaaattaaaagaggaggagcaccagcgcaaactgttccaggacaaggcctcagagcttcagacaggtctggaaatcagcaagattattatgtcttccgtctccaaccttaagcactcaaaagaaaagaagaagagctccaagaagacaaagtgcatcaagaggaggccaccctggcaaatttgcagcaaattcggggcacttccatttgtagccgagaagatgcgccagcatagagaccctcacatcttgcaaaaacccttcaatgtgaccgagacaaggtgcctgcccaaaccctcaaggacgacgtcctggtgtaaagccattccacccgactcagagaagagtatctccatctgtgacaacctttctgaacttcttatggctatgcaggacgagcttgaccagatgtcgatggaacatcaagagctgctgaaacagatgaaggaaaccgagagccattccgtgtgcgatgacattgagtgcgaacttgagtgtctcttaaagaaaatggaaatcaagggggagcaaatctcaaagttgaagaagcatcaggacagtgtatgcaagctacaacagaaagtacagaactcaaagatgtccgaggccagcgggattcagcaggaggacagctatccgaagggttccaaaaatatcaagaattctcctagaaagtgcctgactgatactaacctgtttcaaaaaaactcttcttttcaccccatcagagtgcataacttgcagatgaagttgcgaagagacgacattatgtgggaacagtag

SEQ ID NO: 31137 - DNA, 1050 bp, Artificial Sequence
  Description of Artificial Sequence: Synthetic coding sequence
atggaggatccccagtctaaggaaccagctggggaagccgtggccctcgctctcctggagagcccacgccctgaaggaggggaggaacccccaagaccctcgccagaggaaacccagcaatgtaagttcgatgggcaggagactaaggggtctaaatttatcacctcatctgctagcgattttagcgacccagtctacaaagagatcgctattacaaacggatgcatcaatagaatgtctaaggaggagctgagggctaagctatcggaattcaagctggagacacgtggtgtgaaggacgtcctgaagaagcgattaaagaactactataagaagcagaaactgatgttaaaggagtccaattttgcagacagctactacgattacatatgtattatcgacttcgaggctacatgtgaagagggcaacccacccgaatttgtgcacgagatcatcgagttccccgtggtactgctgaacacccacactttagagatcgaagatacctttcagcagtatgtgcgcccagagatcaacactcagctctccgacttttgtatcagcctgactggtataacccaggatcaggttgatcgtgcagacactttccctcaggtgttaaagaaagtgattgactggatgaagctcaaggagttaggcaccaagtataaatactcactgctgaccgacggatcttgggacatgagtaaattcctaaatatacaatgccagctctcccggctcaagtacccaccattcgccaagaagtggattaacatcaggaaaagttatggcaacttttataaggttcctaggagtcagaccaagctgacgatcatgctggaaaaactggggatggattatgacgggaggccacactgtggcctggatgattcaaaaaatatcgcgcgaattgctgtgcgcatgctgcaggatggatgcgagttgaggatcaatgaaaagatgcacgctgggcaactaatgagcgtttcttccagcctgccaatcgaggggaccccacctccacagatgccacattttaggaagtag

SEQ ID NO: 31138 - DNA, 636 bp, Artificial Sequence
  Description of Artificial Sequence: Synthetic coding sequence
atgtgtccagggaactggctgtgggcctctatgacttttatggccaggttctcaagatccagctctagatcaccagtgaggactcgtggtacactggaagaaatgcccactgtgcaacaccccttcctgaacgtgtttgagttggagcgtctactttatactggaaagaccgcctgcaaccacgcagatgaagtttggcccggactctacttgggagaccaggacatggccaacaatcgccgagaacttcgcaggttgggaatcacacatgtactcaatgcaagccatagcaggtggcggggaaccccagaagcctacgaggggctcggaattcggtatctcggtgtggaggctcatgactcacccgcattcgatatgtccatccactttcagactgcagcagatttcattcaccgcgctcttagccagccgggtgggaaaatactcgtccactgcgccgtgggcgtctcacgcagcgcgaccctggtgttagcttatctgatgctctaccatcatcttacccttgtggaggcaataaagaaagttaaggatcacagaggcatcatcccgaatagaggtttcttacgccaacttctggctctcgacagacgccttcggcaggggttggaagcctag

SEQ ID NO: 31139 - DNA, 438 bp, Artificial Sequence
  Description of Artificial Sequence: Synthetic coding sequence
atgatcccaatatggaagcagcaggctaggcccggtgacggccctgtgatctgggactatcacgtggtcctgctgcacgtaagctccggaggacagaatttcatctacgacctcgacactgtgctgccatttccttgcctcttcgatacctatgtggaagatgccttcaagagtgacgacgatatccaccctcagttccggcgtaagttcagagtgattagagctgattcataccttaaaaatttcgcgtctgaccgaagccacatgaaggattcttctggcaattggagggaacctcccccaccctatccgtgtatagaaacaggggattccaagatgaatcttaacgactttatttccatggatcccaaagtgggctggggagctgtctacacactgagtgaatttactcatcgctttggttccaaaaactgctag

SEQ ID NO: 31140 - DNA, 258 bp, Artificial Sequence
  Description of Artificial Sequence: Synthetic coding sequence
atgagtgataagagtgacttgaaggctgagctcgaacgaaagaagcaacgtctagctcagattcgcgaagagaagaagaggaaagaggaagagaggaagaaaaaagaggccgacatgcaacagaaaaaggagcccgtgcaagatgattcagatttagaccgaaagcgcagggagacagaagccctgttgcagtccatcggtatctcaccagagccccctctggtgcctacccccatgtctccttctagcaaaagctag

SEQ ID NO: 31141 - DNA, 588 bp, Artificial Sequence
  Description of Artificial Sequence: Synthetic coding sequence
atggacagcgaattgatgcattctattgtgggtagctaccataagcctccggaacgagtgttcgtccctagtttcacacaaaatgagcctagtcagaactgccatccagcaaacctcgaggtaacttctcccaagattctgcattcccccaacagccaggccctcattctggcgctgaaaaccttacaggaaaaaattcaccggctcgagctcgagcgaacacaggcggaggacaacttgaacattctgtcacgggaggctgcgcagtacaaaaaggccttggagaacgaaaccaatgaaagaaatctcgcacatcaggaactgataaagcagaagaaggacatcagtatccaattatcatccgcccaaagccgatgtactttgctcgagaaacaactggagtacacaaagaggatggtattaaacgtagagcgcgaaaaaaatatgatcttagagcagcaagcgcaactgcagcgcgagaaggaacaagaccagatgaagctgtacgccaagctagaaaaattggacgttcttgaaaaggagtgttttaggttgacaaccacccaaaaaacagctgaagacaaatag

SEQ ID NO: 31142 - DNA, 1272 bp, Artificial Sequence
  Description of Artificial Sequence: Synthetic coding sequence
atggaagacaaacgatccttgtcgatggccagatgtgaggaaaggaacagcagaggacaggatcatgggctggagagagtaccgtttcctccacaattgcagagcgaaacatacttgcaccctgctgacccaagtccagcctgggatgaccccggttctacgggcagccctaacctgcggctgttgacggaggagatagcctttcaaccactcgctgaggaggcctccttccgaaggccccaccccgacggagatgtccctcctcaaggggaagataacctcctcagcttaccatttccccagaagctctggcgcctggtgtcttccaatcagttctcctcgatttggtgggatgacagtggagcctgccgcgtgataaaccaaaaactgttcgaaaaggagatcttgaagcgggatgttgcccacaaggtcttcgctacaacttcaattaagtctttttttagacagttaaatctctatggtttccgcaagcggagacagtgtacgttcaggaccttcacacggatcttctccgccaagcgcttagtgagtatactcaataaattggaattttattgccatccatattttcaaagagactccccacatttgcttgtgcgcatgaagagaagagtgggggttaagtcagccccaaggcaccaggaagaggataagcctgaggctgcgggtagctgcctcgctcccgcagacaccgagcagcaagaccacacaagtcccaacgagaatgaccaagtgacaccgcagcatcgagagcccgctggccctaatacacagattcggtcgggaagcgcaccacctgcaactcccgtcatggtgccggactccgccgttgcgtctgacaacagtcccgtgacacagccagcaggcgagtggagtgagggcagccaggcccacgtcactcccgtggccgcagtaccaggacccgcagctctgcctttcttatatgtgccaggttcacccacccagatgaattcatatgggccagtggtggcccttccaacggcgagccggagcaccctggccatggacaccacaggcctgcctgctcccggtatgttacccttctgtcacctgtgggtgccagtgacccttgttgcagccggtgctgcccaacctgccgcttcaatggtgatgtttcctcacctccctgccttgcaccaccattgcccccatagtcatcgaacctctcaatatatgcccgcatccgacggccctcaagcttacccggattacgccgaccaatccacatag

SEQ ID NO: 31143 - DNA, 2097 bp, Artificial Sequence
  Description of Artificial Sequence: Synthetic coding sequence
  Description of Combined DNA/RNA Molecule: Synthetic coding sequence
ggagtcggaggtcggggagagaggctcccgaggggattcgcgagagtcgtgagagtcgcttccgaagggtcggtgcggcgaccctctggcccagtgccagctccccaacctcccgcattccggttcgtgagtaggccaggaagagcgcgaagcgagtccgagacactggaacgctcccctccccaatctcctggcccagggaaggcaggagatgctcccaatagacgatccggacatgtacgtggtgccagggtactgtctccacctggacgcagagccagactgtctagcccaggtccttccaggtcttccgaggctagggaggagctgcgtagacacctagttggactgatcgaaaggagcagggtggtgattttcagcaagtcctattgcccccacagtacaagagtcaaagaactgttctccagcttgggggtggagtgtaatgttctggagcttgaccaagttgatgatggggcacgtgttcaggaggttctgagcgaaattactaatcagaaaacggtcccaaatatcttcgtcaacaaagtgcacgtcggaggatgcgatcagactttccaggcgtatcagagcggactactccagaagcttctgcaagaggacttggcctatgattatgatctcatcatcattggcggtggatctggaggcctcagttgtgccaaggaggctgccatactcggcaaaaaggtaatggtgttagatttcgtagtgccgtctccacagggcaccagttgggggctcggcggaacatgcgtgaatgtgggctgtatacctaagaagctcatgcatcaggccgctttactgggtcaggccttgtgcgatagccgcaagttcggctgggaatataaccagcaggttaggcacaactgggaaacaatgacaaaggcaatacagaatcacatcagttctctaaattggggctaccggcttagtctgagggaaaaggcagtggcttatgtgaatagctatggtgaattcgtagaacaccacaagattaaagcaacaaacaaaaagggacaagagacgtactataccgccgcacagttcgtgatcgcaacaggcgagagacctcgctacctggggattcagggcgacaaggaatactgcattacttcagacgacctcttctccctcccctactgtcccggtaaaactctggtggtgggcgcttcgtatgtcgcactggagtgcgcaggttttctggctggctttggacttgatgtgacagtgatggtacgcagcattttgttgaggggattcgatcaagaaatggcagaaaaagtgggaagctatatggaacaacacggggtgaagtttctccggaagtttattcccgtgatggtacagcagctcgagaagggctcccctggtaagctcaaagttctggccaagtctactgaaggaactgagacgattgaaggagtgtacaacacggtcctgctggccatcgggagagactcatgcacccggaagatcggactggagaaaattggtgtgaaaatcaatgaaaaaagcggcaagatacccgttaacgacgttgaacagactaatgtcccctacgtgtacgccgtgggagatatcctcgaggacaaacccgagctaacccctgtagctatccaatcaggaaagttactggcccagagactgttcggcgcttcactggagaaatgtgactacataaatgtgccaaccactgtgttcacccccctcgagtatggttgttgcggactgtcagaggaaaaggcaattgaagtatataaaaaggagaatctcgaaatttatcacaccctattctggccacttgagtggaccgtagctggacgggagaacaacacgtgttacgctaaaatcatttgtaataagtttgaccatgatcgggtgattggcttccacatattaggcccaaacgcgggtgaagtaactcagggatttgctgccgcaatgaagtgtgggctgaccaagcagctgttagacgatacaataggaattcaccccacctgcggcgaggtcttcactacacttgaaatcactaaatcatccggtctcgatattactcagaagggttgcugaggctag

SEQ ID NO: 31144 - DNA, 609 bp, Artificial Sequence
  Description of Artificial Sequence: Synthetic coding sequence
atgaccggctccaactctcacattacaatcctcacattgaaggttctcccccatttcgagagcctcggaaagcaggagaaaattcctaataaaatgagcgcattccgaaaccactgtccacacctggacagtgtcggtgaaattacaaaggaggacctgattcagaaaagtctgggtacctgccaggactgtaaggtgcagggacctaacctttgggcatgcctggaaaaccgttgcagctatgtgggctgtggcgaatcacaagtcgaccattcaaccatccacagccaagagacaaagcattacctgacagtcaacctgaccaccctgcgcgtgtggtgctacgcctgtagcaaggaggtgtttctggatcgaaagctagggactcagcccagcttgcctcacgtgaggcagccccaccagatacaggagaattctgtccaggactttaaaatccctagtaatactaccctgaagacccccctcgttgcagtgttcgatgacctggatatcgaagcggacgaagaggatgaattgcgggcacgcggattaaccggattgaaaaacattggcaacacgtgttacatgaacgccgcactgcaagcgtag

SEQ ID NO: 31145 - DNA, 1443 bp, Artificial Sequence
  Description of Artificial Sequence: Synthetic coding sequence
atggagactgatctgaacagccaggaccgaaaagatctggataagttcatcaaattcttcgccctaaagacggtccaggtaatcgtccaggcgcgactcggagagaaaatatgcacccgttcctctagctcccccacgggatctgactggtttaatctcgccattaaggacataccagaagtgactcatgaagccaagaaagcactggcaggccagctgcccgctgtgggcaggtccatgtgtgtcgaaatctcgctcaaaacaagcgaaggggactcgatggaactagaaatttggtgcttagagatgaacgagaaatgtgacaaagagataaaagtctcttatactgtgtataatcgcctttccctattattaaagtccttactggcgatcaccagagtcactcccgcatataggctgtccaggaaacagggacacgagtacgtcatcctctatcgcatctacttcggcgaggtgcagttgtccggtctgggggagggctttcagaccgtgagagtaggcactgtgggaacacctgtggggactatcacactctcgtgtgcatacaggatcaacttagcatttatgagtacacggcagttcgagaggacaccccctattatgggcattatcatagaccactttgtggatcgcccatatcctagctccagtccaatgcacccatgcaactaccggaccgcaggggaggatacaggagtaatttatccttctgtggaagattcccaagaggtgtgcactactagtttcagcacaagtcctccttcacaacttatggtacccggaaaagaaggaggagtgcctctggcccctaaccagcccgtccacggcactcaggccgatcaggagcgcctcgcaacctgcaccccctccgatcgaacgcattgtgcagccaccccttcttccagtgaggacactgaaaccgtgagcaactcttctgagggtcgggcatcaccccacgatgtcctggagactatcttcgtgaggaaggttggggcatttgtgaataaacccatcaaccaggtgaccctgactagcttagatattccctttgccatgtttgcacccaagaacctggaactcgaggataccgaccctatggtcaatccccctgactctccagaaacagagtcaccactgcagggcagtctccactcggatggaagttctggaggctccagcggcaacacacacgacgacttcgtgatgatagactttaagcccgctttctccaaagatgacatcctacccatggatctagggaccttctatagagaattccaaaatccaccacaactctcatcactcagcatagacatcggcgcacagtctatggccgaagatctcgactccctaccagagaaattagcagtccatgagaagaacgtgcgagagtttgacgcctttgtggagactcttcagtag

SEQ ID NO: 31146 - DNA, 309 bp, Artificial Sequence
  Description of Artificial Sequence: Synthetic coding sequence
atgctgagcgaagaggagaaggaggagctcaaagccgagctggttcagctagaagacgagattaccactctcagacaggtcctatcggccaaagaacgtcaccttgtcgaaattaaacaaaaactcgggatgaacctaatgaacgagcttaaacagaacttttctaaatcttggcatgacatgcagaccacgactgcctataaaaagacccacgagacccttagccacgcagggcagaaagctaccgctgcatttagcaatgtcgggacagcgattagcaagaagttcggggacatgcgcaggaagtag

SEQ ID NO: 31147 - DNA, 318 bp, Artificial Sequence
  Description of Artificial Sequence: Synthetic coding sequence
atgtctcagtctggagctgtgtcctgctgccccggagcaacaaatgggtcactgggccgtagcgacggggtggccaagatgtcacccaaagacttgttcgaacagagaaagaagtattccaatagtaatgtgatcatgcatgagacttcacagtaccacgtgcagcatctggcaaccttcataatggacaagagtgaggctattacaagcgttgatgacgctatcagaaagctggttcagctgtcctctaaggaaaaaatctggactcaagagatgctcctccaggtcaatgatcagtcgttaagactgctcgattag

SEQ ID NO: 31148 - DNA, 222 bp, Artificial Sequence
  Description of Artificial Sequence: Synthetic coding sequence
atgagcgctttcaggaaccattgcccacacttagatagcgtcggagagattacgaaagaggatctgatacagaaatcactgggtacctgtcaggactgcaaggtccaggggccaaatctttgggcgtgtctcgagaataggtgtagttacgtggggtgtggtgaatcacaggtggatcactccactatccactcccaggaaacaaagcactacctcacctag

SEQ ID NO: 31149 - DNA, 276 bp, Artificial Sequence
  Description of Artificial Sequence: Synthetic coding sequence
atggcaatgaccgttgtcaccaaagagaagaataagaaagtacctactatttttctcagtaagaaaccgagagagaaagaagtcgattcaaaatctcaggtaatcgaagggattagtcggttgatctgttccgccaagcagcagcagacaatgctgcgcgtatcaatcgatggagtcgagtggtcagatatcaagttctttcagctcgccgcacaatggcctacgcatgtgaagcacttcccagttggactgttctcgggatctaaggcgacatag

SEQ ID NO: 31150 - DNA, 2535 bp, Artificial Sequence
  Description of Artificial Sequence: Synthetic coding sequence
atgttttggaagttcgacctgcactcaagctctcatattgacacactgctcgagagggaggatgttaccctgaaagagctgatggacgaagaagacgtactgcaagagtgcaaagctcaaaacaggaaattaattgagttcctgctgaaagccgaatgtctggaggacctggtctctttcatcattgaggagcctccacaggacatggacgagaagataagatacaaataccctaatatctcttgcgagctcctcacatccgacgtatcccagatgaacgaccggctcggtgaggacgagagtctgcttatgaagctttacagcttcttactcaatgactcaccgctaaaccctctccttgctagcttctttagcaaagttctgtctattcttatttccagaaaacccgagcagatcgtcgattttctaaaaaaaaagcatgattttgtggacctcatcataaaacatataggtacttccgcaatcatggatctactactccgcttgttaacctgtatagagcctcctcagcctaggcaggacgtgttgaactggctgaacgaagagaaaataatccaaaggcttgtcgagatcgtgcacccaagccaagaggaggatcgccactccaatgctagccagtctctctgcgagatcgtgcgtctgtctagagaccagatgttacagatacaaaactcaacagaacctgatcctctgcttgcaaccctcgaaaagcaggagatcatcgaacagctcctgtctaacatcttccacaaggagaagaacgaatctgctattgtttcagctattcagattttattaacgttgttggagactcggcgaccgacttttgagggccatatagagatctgtcctcccggaatgtctcactctgcctgtagcgttaacaagtctgtcctcgaagctatcagaggtagattgggatcttttcatgagctccttctggaaccccctaagaagtccgttatgaagacgacatggggggtactggatccccctgtaggaaatacaagactcaatgtcatcagactaatctccagtctcttgcaaaccaatacctcttcaatcaacggcgacctgatggagctaaactctattggggtgatccttaacatgttctttaagtacacctggaacaactttctccacacgcaagtggagatctgcatcgccctcatcctggcttcacccttcgaaaatacagaaaacgctactattactgatcaggattcaacaggggacaacctgctgcttaaacacctcttccagaaatgccagttaatcgagcggatcctggaagcttgggagatgaatgagaagaagcaggccgaagggggaagaaggcacggctacatgggccacttaacgaggattgccaactgcattgtgcactctaccgacaagggcccaaattcagcgcttgttcaacagctcattaaggacttgcctgacgaggtccgcgagagatgggagacattctgtacctccagtctgggcgagaccaacaagcggaataccgtcgacctggcattcagcgactatcagatgcaacagatgactagcaatttcattgaccagtttggttttaacgacgaaaaattcgcagatcaagatgatataggcaacgtctcttttgacagagtgtcagatataaactttactctgaacactaatgagagcggcaatattgctttgttcgaggcttgctgcaaggaacgaatccaacagtttgacgacggaggttccgacgaagaggatatctgggaggagaagcacatcgcctttacacctgaaagccagaggagatcttcttccggatcaactgatagtgaggaaagcacggacagtgaggaagaagatggcgctaagcaggacttgttcgaaccttcctccgctaatacagaagataagatggaagtggacctgtccgagccacctaattggagcgcaaattttgacgttccaatggaaacgacacatggagcgccattagattcagttgggtcagacgtttggtccaccgaggagccaatgccaacaaaggaaacaggctgggcttcattttccgagttcacatcctccttgtccacgaaagactctctgaggtcgaacagtccagtggaaatggaaacaagcacggaacctatggacccattgaccccttctgcggcagctctcgcagtccagccggaggctgcgggatccgtggctatggaggcttcctcagatggagaggaggacgctgagagtacggataaggtcacagagacagtgatgaatggcggaatgaaggagactctttctctgaccgtagatgcgaaaaccgaaactgcagtgttcaagtctgaagaaggcaagctgtctacttctcaggatgccgcttgcaaggacgctgaggagtgtcctgagaccgccgaggcaaagtgcgccgctcctcgccctccatcatcttccccagagcaaaggacgggacagccctccgctcctggcgacacttctgtgaacggacctgtctag

SEQ ID NO: 31151 - DNA, 2604 bp, Artificial Sequence
  Description of Artificial Sequence: Synthetic coding sequence
atgttttggaagtttgacctgcattcgtcaagtcatatagatactctcctcgaaagagaagatgtcacactcaaggagcttatggacgaggaggacgtgctacaagagtgtaaagcacagaaccgaaagctaattgaattcctgctaaaggccgagtgcctcgaagacctcgtgtcctttattatcgaagagccccctcaagacatggatgaaaagattagatacaagtaccctaatatctcttgtgagctgctgacatctgatgtgtcgcaaatgaacgaccgtctgggggaggatgaatcactgctgatgaagttgtattcttttcttttgaatgacagccccctgaatcccctcctcgcgtcttttttcagtaaggtgctttccatactcatttctcgcaagcctgagcagatcgtcgactttctcaagaagaaacacgattttgtcgacttaataataaaacatattggcaccagcgctattatggacttactgctgagattgctgacctgtattgagcctccccagccgcgacaggacgtactgaactggctgaatgaagagaagattattcagagactcgtcgagattgtccacccatcacaggaagaggatagacacagtaatgccagccagtccctgtgcgagatcgtgagactcagccgcgatcagatgctgcagattcagaattctacagaacccgatccccttctagccactctcgagaaacaagagattattgaacagctgctaagcaatattttccacaaggaaaagaatgaatcagccattgtctctgctatacagattctgttaacgcttctcgagaccaggcgcccaacatttgagggccacattgagatctgccctcctggcatgtcacacagtgcctgttctgtcaacaagagtgtcctggaagccatccgcggaagacttggtagttttcacgagctgctgttagagcctcccaaaaagtccgtaatgaaaactacatggggcgtgctcgacccccctgtggggaatacccggctgaatgttataaggctcatatccagcctgctgcagaccaataccagttcgattaacggcgacctcatggagttgaacagtattggggtgatcctgaacatgttttttaagtatacttggaataattttctacacacacaggtggagatctgtattgccttaattctcgccagccccttcgaaaacaccgaaaatgcgacaatcacagatcaagattctaccggggacaacttgctgctcaagcatcttttccaaaagtgccagcttatagagcggatcctggaggcatgggagatgaacgaaaaaaagcaggccgaaggcggacgcagacatgggtatatgggccacctgacccggattgctaattgcatcgttcactccacagacaagggacccaactctgcactggtgcagcaattgattaaggatctgcccgatgaagtcagggaacgatgggaaacattttgcaccagctctcttggggagacaaacaagcgaaacactgttgatctggtcaccacatgtcacattcatagttcttctgacgatgaaatcgatttcaaagagacgggcttttctcaggactcctccctccagcagatgcagcagatgaccagtaacttcatagaccaatttggctttaatgacgaaaaatttgcagaccaggatgatatcgggaatgttagtttcgatagagtgagcgacatcaacttcacgcttaacacaaacgagtctggcaatatcgcattgttcgaagcatgttgtaaagagcggatccagcagtttgatgatggcggaagcgacgaggaggatatttgggaggaaaaacacatcgccttcactcccgagtcccagagaaggtcgtcatctggttcgaccgactccgaagaatctaccgatagcgaagaagaggatggcgcaaagcaggacctattcgaaccttcttccgccaatactgaagataagatggaagttgatctaagcgaaccccctaactggtctgccaactttgatgtgccaatggaaacgacccacggggctcctctcgactccgtgggatctgatgtgtggagcacagaagagcctatgcctaccaaagaaacagggtgggcctccttctccgagttcacttcctcactgtccaccaaggattccttgcgctccaattcccctgtggaaatggagaccagtactgagcctatggaccccctgacaccctctgccgctgccctggcagtacagccagaggcggcaggtagtgtggcgatggaagctagtagcgacggggaggaggacgctgaatccaccgacaaagtcaccgagactgttatgaacggtggtatgaaggagactctcagccttactgttgatgccaaaactgagactgctgtgttcaaaagcgaggagggaaaattgagcacctcacaggacgctgcttgcaaagatgccgaggaatgccccgagaccgctgaggctaaatgcgccgctcctcgacctcccagttcgtctcccgagcagagaaccgggcagcctagcgccccaggtgatacaagtgtgaatgggcctgtatag

SEQ ID NO: 31152 - DNA, 174 bp, Artificial Sequence
  Description of Artificial Sequence: Synthetic coding sequence
atgacgtctaagaagctcgtgaacagtgtggccggatgcgccgatgacgctctggctggcctggtcgcgtgcaatccaaacttgcaacttctccagggacaccgggtggctctccgcagtgacctggatagcttgaagggacgagttgccctgctgtcagggggagggtcctag

SEQ ID NO: 31153 - DNA, 2709 bp, Artificial Sequence
  Description of Artificial Sequence: Synthetic coding sequence
atgtttcccgcacttgagacccatctcaagcagaccataccagacccttatgaagactttatgtatagacatcttcaatattacggctactttaaggctcagagaggatctctgcccaacagcgccacccaccaacatgtccggaagaataaccctcagtgtttacttaacgggagcctgggcgaaaaggacgaccttattcccgacaccctgcagaaggaaaagctcctgtggccaatcagcctctcatccgctgtacaccggcagatcgaggcaattaaccgagactttcactcttgtctcggatggatgcagtggcggggtctttctagtcttcagccgccacccccacgcttcaaagattcaccagccagtgcattccgggtggccggaatcacagattcacatatgttgagcttgcctcaccttcgatcccggcagctgctgtacgacgagctagacgaggttaatccacgccttagggagccacaggagctattctcaatcctgagtactaaacggccactgcaggccccacgatggcccatagaatgcgaggtgatcaaggaaaatatccaccatatcgaatgggcccctcctcagcccgagtacttctatcagcccaagggcaatgagaaagtccctgagatcgtcggagaaaagaaagggacagttgtgtaccagctcgacagcgtcccgattgaagggtcttacttcacgtcctcacgcgtgggcggtaaacggggtattgtgaaggagctagctgttacgcttcagggccctgaggacaatactctgctgttcgagagtcggtttgaatcaggaaacctgcagaaggctgttcgagtggacacatatgagtacgaacttacccttcggacagatctttatacaaataagcacacccagtggttttatttccgggtgcaaaatacccgaaaagatgcaacatatcgtttcaccattgtgaatttgctcaaaccgaaatccttgtataccgtgggcatgaaaccactcctctattcccagctggatgccaacacacggaacatcggctggcggagggagggtaacgaaataaagtactataagaacaataccgacgatggccagcagcctttttattgtttaacatggacaatccagttcccctatgatcaggacacatgtttcttcgcacacttttacccttacacatataccgatctccagtgttacctgctcagcgttgcgaataatcccatccagtcccagttctgtaagcttcagactttgtgtagatctttagcgggtaataccgtgtatctgttgacaatcacaaacccttctcagactccccaggaagctgctgcgaagaaggccgtcgtccttagcgcccgagtgcacccaggagagagcaacggatcttgggtcatgaaagggtttttggacttcatcctctccaattcacctgatgcccagctgcttcgagatatattcgtgtttaaggtgcttcctatgctcaatcccgacggagtgattgtagggaactacaggtgctcgctggccggtcgcgatctgaatagacattataaaacgattcttaaggaatcatttccctgcatttggtacaccagaaatatgataaagaggctcttggaagaacgcgaagtgctgttgtactgcgacttccatggccacagtaggaagaataacatatttctgtacggctgcaacaataataatcgcaagtattggctgcatgaaagggttttccctctgatgctgtgcaaaaatgcaccggacaaattcagttttcacagctgcaacttcaaggtgcagaagtgcaaggaggggacaggcagagtcgtgatgtggcggatgggaatcctgaacagctacaccatggaatccactttcggaggctccaccctgggaaacaaacgggatactcacttcaccatcgaggatctgaagagcctcggctaccatgtgtgcgacacgctgctcgacttctgtgaccccgaccaaatgaaattcacacagtgtctggccgagttgaaggaactgcttcgacaggaaatacacaaaaaatttcacgagctcggccaggatgtcgatcttgaaggctcatggtcagacatctcccttagtgatatcgaaagctcaaccagtgggagcgactcaagcctctcagatggattacccgtgcacctggccaatatcgccgatgaactcacgcaaaaaaagaaaatgtttaagaaaaagaaaaagaaaagtctccagactcggaagcaaagaaacgagcagtaccaaaagaagaatctgatgcagaagctcaaattaactgaggacaccagcgagaaagcagggtttgcgtcaacactgcagaagcaaccaactttttttaagaattctgagaattcatctttcctgcctatgaaaaacgaaaaccccaggctgaacgagacgaacctgaaccgtagggacaaggacacacctctggacccctcaatggctacactgattctgcccaaaaacaaaggcagaatgcaaaacaagaagccaggtttcacagtgtcctgctcccctaagaggacgattaacagcagtcaggaacctgcccctggaatgaagccaaactggcccagatctagataccctgctactaagagaggttgcgctgccatggctgcatatccatctttgcatatctacacctatccctag

SEQ ID NO: 31154 - DNA, 537 bp, Artificial Sequence
  Description of Artificial Sequence: Synthetic coding sequence
atgaatagaagaaggaagttccttctcgcctcagtacttgctctgcagaacagcagttttatttacccatcatgccaaaaatgcttttcccggataatccttgtgtccaaaagatccaattgccctaaatgcgggtcaaccggggagtcgggcaatgccaattaccgctataagttgagtctgaaggtcgccgaatcaaacaaacttttcgtaatcaccgtttttggatcatgcctcgacacgtttttcggcctgacggccacgggactgcataggtatattcaagaccccaacaagattcctgagacactggacaatgacacaactcagaatcttttgaccaaggcagttgagacctgctttgtaggtcaatccttcatcttcggcgtcacgaacttcgaaaaccagcccggtcagggctctgacgcatctaacttcttacaacagtgttcagatcacaaacgtaaagctaaggctttggttgcctgccagatcgtcctgcccgacccggcaactcaggatgccaagaccaagtag

SEQ ID NO: 31155 - DNA, 441 bp, Artificial Sequence
  Description of Artificial Sequence: Synthetic coding sequence
atggttgccatggcagaggctgaggcaggggtcgctgttgaggtgagggggctgccaccagctgtgcccgacgagctgctgaccctctatttcgagaacagaaggcgttcagggggaggccctgtcctctcatggcaacgcctgggctgcgggggtgttcttacctttagagagccagcagacgcagagcgagtacttgcccaggccgatcacgaattacatggcgcacagctgagcttaagacctgcacctccaagggcccctgctcgcttgcttctgcaaggccttccacctgggacgaccccccagcgacttgaacagcatgttcaagctctgctccgagcttctggcctgccagtgcaaccatgttgcgctctggcttctcctcgtcccgacagggccctggtgcagctaccaaaacccctgtcagaagccggttag

SEQ ID NO: 31156 - DNA, 348 bp, Artificial Sequence
  Description of Artificial Sequence: Synthetic coding sequence
atggccggacgcccactgaggatcggcgaccagcttgtactggaggaagattacgacgagacatacattccctcagagcaggagattctggagttcgccagggagatcggaatcgaccccattaaggaacctgagttaatgtggctcgcacgagagggaatcgtcgccccactgccaggcgagtggaagccctgtcaggatatcacaggggatatctactatttcaatttcgccaatggacaaagcatgtgggaccatccttgcgacgagcattatagaagcctcgtgattcaggaacgggctaagctttccacaagcggcgctataaagaaaaaaaagaagaagtag

SEQ ID NO: 31157 - DNA, 1191 bp, Artificial Sequence
  Description of Artificial Sequence: Synthetic coding sequence
atgcggacatcttataccgtcacgttgcctgaggacccaccagctgcaccttttcccgcactagccaaggagctgcgtcccagatcgcccttatcacccagtctcctgttatccacatttgttggcctgcttctgaacaaggccaagaactcgaagtccgcccagggactagctggcctcagaaaccttggtaatacttgctttatgaactccatcctccagtgcttaagtaacacaagggagctgagggactattgcctccagcggctgtatatgcgggatctgcatcacggaagtaacgcccatactgctctggtcgaggagttcgctaagctcattcagacaatctggactagctcgccgaacgacgtggtctcaccatctgagttcaaaactcagatccaacggtacgcccctcgcttcgtgggatataaccagcaagacgcacaggaattcctgcgctttctgctggacggcctgcacaacgaagtcaatagagtgaccttgcgcccaaagtctaatccggaaaaccttgaccacctgccagatgacgaaaaggggcgtcagatgtggcgcaagtatctcgagcgggaagattctaggatcggtgatcttttcgtgggccagttaaaatcatctcttacctgcactgactgtggctactgctccacagtattcgacccattctgggacttaagtctccctattgcaaaacgagggtatcccgaagtaacccttatggactgtatgaggctgtttaccaaggaagacgtactggacggcgacgagaaaccaacctgttgtcgttgtaggggcaggaagcgctgcattaagaaattctccatacagcggtttcctaagatacttgtgctgcaccttaaaaggttctctgagtcgaggattagaaccagcaagctgacaacttttgtgaacttcccacttcgggatttagatctccgcgagttcgcctccgagaataccaaccatgctgtgtacaatctgtacgccgtgagtaatcattcagggaccacaatgggcggtcactacactgcatactgtcgatcacctggcaccggggaatggcatactttcaacgactcgtcagtcacgcctatgtcatcttctcaagtgcgcacatctgatgcttacctgctgttctatgagcttgcttcccctccttcacgcatgtag

SEQ ID NO: 31158 - DNA, 633 bp, Artificial Sequence
  Description of Artificial Sequence: Synthetic coding sequence
atggcggcaagcgttgaacagcgggaggggaccattcaggtgcagggacaggctctgttctttcgcgaggccctgccagggtccggccaggcccgtttttcagtgctcctgctccacgggatcagatttagctcagagacttggcagaatctgggaaccttgcatcgcttagcacaggcagggtaccgggcagtggccatcgatctgccaggtctcggccactcaaaggaggctgccgctccagcaccaattggcgaactggcgccagggagcttccttgctgctgtggtcgacgcactcgaactgggtccccctgtcgtgatttcccctagcctgtcaggcatgtactctttacctttcctgactgctcctggaagccagctcccgggatttgtgccagtggcccctatctgtacagacaagatcaatgcagcaaattatgccagcgtcaaaactcccgcactgatcgtgtacggggaccaggatccgatgggccaaacaagcttcgagcatctgaaacagctccctaaccatcgcgtgcttattatgaaaggtgcaggtcacccatgttatctggataagccagaagagtggcatacaggactcctggactttttacaggggctgcagtag

SEQ ID NO: 31159 - DNA, 1428 bp, Artificial Sequence
  Description of Artificial Sequence: Synthetic coding sequence
atggagctctggcaggcagcgctttcaacactgaatcctaaccctactgattcgtgccctttgtacctgaattatgctaccgtggcggctctcccctgtagagtctcacgccacaatagtccatccgctgcacacttcatcacaagactcgtcaggacctgtctgccccctggagctcaccggtgcattgttatggtgtgtgagcagccagaagtttttgcatcggcatgtgccctcgctagggccttccctctgtttacccaccgctcaggggctagcagaaggctggagaagaaaacagtgacagtggagtttttcctggtcgggcaggataatggtcctgtggaagtcagcaccctccaatgtttagccaatgctacagatggtgtgaggctggcagctcgcatcgtcgatactccatgtaacgaaatgaacaccgatactttcctggaagaaattaacaaggtgggcaaagagctcggaatcattcctactatcattagggacgaggagctcaagacccgcggattcggaggcatttatggcgttggcaaggccgcacttcacccccctgccttagcggtgctgtcccatacccccgatggagccacccagactatcgcctgggtggggaaaggaatcgtttatgatactggagggctaagtatcaaggggaaaacaacaatgccagggatgaagagagattgtggaggcgcagccgctgtgctgggagcctttagggccgctattaagcagggcttcaaggacaatttgcatgccgtcttttgcttggcagagaattccgttgggcctaatgctactagacctgacgatatccacctcctctactccggaaagaccgtggaaattaataacacggacgctgaggggcgtctggtgttagccgacggggtatcttacgcttgcaaggatctcggcgctgacataatattggatatggcaacactgacaggagctcaaggcatcgcgactgggaaatatcatgccgctgtgctgaccaactcggcggagtgggaagccgcatgtgtgaaagctgggcgaaaatgtggcgaccttgtgcaccccctcgtctactgtccagaactgcatttttccgagtttacaagtgctgtggcggacatgaagaactctgttgctgaccgagacaactcgccttcgtcttgtgccggactatttatcgcgagccatattggttttgattggccaggggtgtgggtgcatctggacatagcggcacccgtacatgctggagagcgtgccacaggctttggggtagctttgctcctagcactgtttgggcgagcctccgaggacccgctgctgaacctcgtatcccccctgggttgtgaggtggacgtggaggagggggatcttggaagagatagcaagaggaggagactcgtttag

SEQ ID NO: 31160 - DNA, 537 bp, Artificial Sequence
  Description of Artificial Sequence: Synthetic coding sequence
atggtagccatggcggaggctgaagctggagtcgccgttgaggtgcggggtcttcctccagctgttcccgacgagctgctgaccttatacttcgagaacagacgcagatcaggcggtggcccagtgctaagctggcagagactgggctgcgggggtgtgctcacttttagagaaccagccgatgccgagcgggtgctagcacaggcggaccacgaactacacggtgcgcagttatccctgaggcccgcacccccacgtgcacctgctcggctgttactgcaaggcctcccaccgggaactacgccacagcgcttggagcaacacgtccaggccctcctgagggcctcaggactgcccgttcagccctgctgcgccttggctagtcctcggccagacagggccctggtacagcttccgaaaccgctgtctgaagcagatgtccgcgtcctggaagagcaagcccagaatctgggcctagaagggacactcgttagcctggctagggttccccaggctcgtgcagttcgagtcgtgtag

SEQ ID NO: 31161 - DNA, 1893 bp, Artificial Sequence
  Description of Artificial Sequence: Synthetic coding sequence
atggaaaaggtgctgggctgtgaactgctgaagggcttaaacgtgctggatctgggtctgaatatggagatcctcgaagaacaaatgctgcacgagattctttgcagggagtatcccgaactggaaacaagatggcaggacctcaagatacgggctctggacacttgcaaggctgtggaggccgctgaggagagactgctcacaatgctcctctttcaaaatcccaagagacagaagcccgcaaaatttttaaggaacatcgttcgagctcaaggaaagctgtgtcaattgagggcacattgtgaagagctggaggggcagaagctacaggagatggtgctttgggccccataccgacctgtggtgtggcacggtatggctatggtgaaggcactgagtcagcttcaaaaccttttacccctgttctgtatgagcccagagaactggcttgcagtgaccaagcaggcgttggatagcatgaaaccgcgtgagatcaaccacggagaggatcttgcttcacatctcttgcagctgcgagctcatttgacaagacagctgctgggctctaccgtcactgccctgggactcacacaagtaccactggttggtgctctcggcgctctagcccttctgcaggcaacgggtaaagctagtgagctcgaaaggcttgcactgtggcccggactggccgcttccccatccacggtccattcgaagcctgtgagcgatgtggcccgacccgcatggcttggacctaaggcatggcacgagtgcgagatgttggaacttctgcctccattcgtgggcctctgcgctagtctggcaggccattcatcggcttggcaggcctacctctccctgtcttcaacggtattggggcctgcccctggtccaggccctgaaccactgagcctactccagaaacttatcctgtggagagtgctgcgcccagagtgcctcgctggggctctggccgacttcacaacgagtctgttagggaggcccttggatgagaatacatacgcacccacaatgcccttcaagcactcccaggctacacagcctatgctgatcctcctccctcccccaggacaccccagcgccacactgcaccccctgacagtgatacagaagcttgcagccaagtatcagcagggccagaaacagttgcaggtgattgcgctgggcagtgaggcttgggaccccgtttcagtggtagtctctacactttctcaagccatgtacgaaggacactggctcgtcctggacaattgtcacctgatgccacactggcctaaggaactgctccagctcctactggaactgctcggacgcgcaaaggtcgtggccgatctcgaatccgagcagctgcttgatcagcctgagagccgaaatgtgagcaccgtccatcgggacttcaggctgtggctcattgtcccggctgaatcctctgcctctttaccggctgtgcttacgcagcactccatgccggttttctggaaccagtcactggaacttggacacgttcttatcgactcagtagaactagcacagcaggtgctttatatgcagcccccaacacaggccctgcctctgctgctactgcacggcctcctcttgcatcggcagttgtacggaacccgcttacaggctcatcggggacgttggagccaggtgactctcacccaggtactgcaaacccaggatcagctgtgggcatccctgtcaaatccccgtgctgcaatgcaggagctggctggggagaccctccctcttcctctaggagtgatttcgccccaggagtcccttgaagaaggagggggaggcatccagttcacagccttagttcttgctgtggttgagactgaagggactggcaccgaacgcctctag

SEQ ID NO: 31162 - DNA, 1488 bp, Artificial Sequence
  Description of Artificial Sequence: Synthetic coding sequence
atggagcttcacggcggaaaccgcggagggtaccagccaaaggccttggagcaatccggctgctggctgtggcaagctgccctgagtacactgaaccctaaccctacggacagctgtcctctgtatttaaattacgccacggtggccgctctgccatgtagggtgagcagacacaatagccctagcgccgcacacttcattacgaggctcgtcaggacttgcctgcctcccggtgcacataggtgtatcgttatggtatgcgagcaacccgaggtgttcgcatccgcttgcgcgttggcacgggcttttcctcttttcacccaccgctcaggcgctagccgccgtctcgaaaagaagaccgttacagtagaattcttcctcgttggtcaggacaatgggcctgtggaggtcagtactctccagtgcctggctaatgcaaccgacggtgtgcgcctcgctgctcggatcgtcgacaccccctgtaacgagatgaacacagatacctttctggaggaaatcaacaaagtgggtaaagagctcggaatcattccaaccatcataagagatgaagaactgaagacacgcggattcggaggcatttatggcgtgggaaaagccgcactgcatcccccagcactggcagtcctgtctcatacacccgatggcgcaacccaaacgatagcctgggtagggaaaggcatcgtgtacgataccgggggactgtccattaagggcaaaactactatgccgggtatgaagagggactgcggcggagcagccgcagtgctgggggcattcagggccgcaattaaacaaggatttaaggataatttgcacgccgtcttttgtcttgcagagaactctgtcggccctaatgcaacccgacccgacgacatccacttactctatagcggcaagaccgtggagatcaataacaccgatgccgaaggcaggctagtactggctgacggtgtctcctacgcctgtaaggacctgggcgcagatatcattctcgacatggcaacgttgactggcgctcagggcatagccaccggcaagtatcatgccgctgtgcttactaatagtgctgaatgggaggcagcctgcgtgaaggcagggaggaagtgtggtgatttggtccaccctcttgtctactgccctgagctgcatttttccgagtttactagcgccgtggcggatatgaaaaactcagtggcggaccgggacaactctccttcatcttgcgctggcctattcatagcatcccacatcggattcgattggcccggagtttgggtccacttagacatcgccgctccggtgcatgctggcgagagggcaacaggattcggagtggccctgcttcttgccttgtttggcagagcaagcgaagaccccctccttaacttggtgtcccctttgggatgcgaggtggacgtagaggagggcgatctcggaagagactccaaacgacgcaggctggtctag

SEQ ID NO: 31163 - DNA, 618 bp, Artificial Sequence
  Description of Artificial Sequence: Synthetic coding sequence
atggagacagatctcaacagtcaggatcgcaaagatctcgacaagtttattaaatttttcgccctgaaaaccgtgcaggtaattgtgcaggctagactgggagagaagatctgcacgaggagcagctcatctccaaccggctcagactggtttaatctggccataaaagacattccagaagtgacccatgaggctaaaaaggcacttgctggccagctgcccgctgtaggtcgctcaatgtgcgttgagattagtttgaagactagcgagggagactcaatggagcttgagatttggtgtttggaaatgaatgagaaatgcgataaagaaattaaggtgtcgtacaccgtgtacaatagactatccttactgctcaagtccctactggcgatcactcgggtgaccccggcttacagactgtcacgaaagcagggacacgaatacgttattctctatagaatctattttggcgaagtgcagctttctggtttaggcgaggggtttcagaccgtgcgagtgggaaccgtgggtacaccagtcgggaccattactctttcttgtgcctaccggatcaatctggctttcatgagtacacggcagttcgagcgaaccccctag

SEQ ID NO: 31164 - DNA, 117 bp, Artificial Sequence
  Description of Artificial Sequence: Synthetic coding sequence
atggctgcatttaaattagattttctaccagagatgatggtggaccactgctctctgaactcttcccccgtctctaagaaaatgaatgggactcttgaccacccagatcaaccgtag

SEQ ID NO: 31165 - DNA, 1554 bp, Artificial Sequence
  Description of Artificial Sequence: Synthetic coding sequence
atggagacggatttaaatagccaggacagaaaagacctggataaattcataaaattttttgccctgaaaaccgtgcaggtcatcgtacaggcccgactaggcgagaagatctgcacacgctcatcctcatcacctactggctctgattggttcaatctcgccattaaggacatccctgaggtgacacacgaggctaagaaagccttggcaggacagttgcccgcagtgggaagaagtatgtgtgtcgagatttccttgaaaacatccgaaggtgacagtatggagttagagatatggtgtctcgaaatgaatgagaaatgcgacaaggagataaaggtgtcttacaccgtgtataatagattgtcattgctgctgaaaagtcttttagctatcacccgagtgacgccagcatatcggctgtctcggaaacagggccacgagtatgtgattctgtacaggatctacttcggggaggtgcagttgtctgggctgggagagggattccagactgtgcgcgtcggcaccgtgggtacaccagtggggacaataacactgtcatgtgcttatcggattaacttggcattcatgtccacacgtcagtttgagaggactccaccaattatgggcattattatcgaccatttcgtggatcggccttatccatctagcagtcccatgcatccatgcaactaccggacagctggcgaagacacaggcgtcatataccccagcgtggaagacagtcaggaggtgtgtacaactagctttagtacttcacctccttcccaactctcgagcagtagattatcctaccagccagcggctctcggggtgggaagtgccgatctggcttatcccgtggtgtttgcagccggactgaacgccacccatcctcaccagctgatggtgcctggaaaagaaggtggagtacccttggcgcctaaccagcccgtgcatggcactcaagccgaccaagagagattggccacctgcacacccagcgatcgcacgcactgcgcagctacccctagttccagtgaagataccgagactgtgtcaaactcctcagagggccgagcaagtccccacgatgtcttagagactatcttcgtgaggaaagttggcgcttttgtaaacaaaccgataaaccaggttacactgactagcctggacataccattcgccatgtttgcaccgaagaacttagaactggaagataccgaccccatggtgaaccctccagattccccagaaacagagtcccccctccaaggatctttgcactcagatggttcatcgggaggctcttccggcaacacccatgatgattttgttatgatcgactttaagcctgctttttcaaaagatgatatcctgcccatggacctggggactttttaccgagagttccagaatccgcctcagctctccagcttgtccatagatatcggagctcagagcatggccgaggaccttgattctctgcctgagaagctggctgttcatgagaagaacgtcagggagttcgacgcgtttgtggagaccctgcagtag

SEQ ID NO: 31166 - DNA, 768 bp, Artificial Sequence
  Description of Artificial Sequence: Synthetic coding sequence
atggagaggagcggacaacgagtgaccacctgggattgtgaccagggcaaacattccgactctgcacagaagaatgagcgcgagtcgatcaggcagaaactggctttaggaagcttcttcgatgacggccctggcatttatacatcttgctcaaagagtggaaagccaagcttatccagccgattgcagtctggcatgaaccttcaaatttgcttcgttaacgattcagggagcgataaggacagcgacgccgacgactcaaagactgagacgagcctcgacacacctctaagcccaatgtccaaacaatctagctcctattcagatcgggataccacagaagaagaatcagagtctctggatgacatggactttctgacccgacagaaaaagttacaggctgaggctaagatggccctggctatggctaaacccatggccaagatgcaggtggaagtagagaagcagaacaggaagaagtctcctgtagccgacctccttccacatatgccacacatatccgaatgcttaatgaaaagatcgttgaagccaacagacctgcgggatatgacgattggacagcttcaggtgattgtcaacgatcttcacagtcagatcgagtcattaaacgaagaactcgttcagctgttactgattcgcgacgagcttcacaccgagcaggacgcaatgctggtcgacatcgaagacctgactagacacgccgaatcacaacagaagcacatggctgaaaagatgcccgcaaaatag

SEQ ID NO: 31167 - DNA, 78 bp, Artificial Sequence
  Description of Artificial Sequence: Synthetic coding sequence
atgtcccagagcggtgccgtctcgtgctgcccaggcgcaaccaacggatctcttgggcgtagcgacggcgtggcctag

SEQ ID NO: 31168 - DNA, 360 bp, Artificial Sequence
  Description of Artificial Sequence: Synthetic coding sequence
atggtccttgagggtaaccccgaagttggctctcctaggacatcagacctgcagcatagggggaataaaggcagttgcgttctttcttctcctggagaggacgcccagcctggggaggaacccataaagtatggagaactgatagtcctgggatgctgtgaggagggtggtgaggagacagaggcccagagaggcgaagtgaccggcccaagagcacactcctgttataatggctgcctggccagcggagataaagggaggagacgaagtcgactcgcactcagcaggcgatcacatgctaacggagttaagcccgatgtcatgcatcacatttcaacaccattggtcagtaaggcctag

SEQ ID NO: 31169 - DNA, 348 bp, Artificial Sequence
  Description of Artificial Sequence: Synthetic coding sequence
atggcgggaaggcctctaagaatcggtgaccagttagtgttggaggaggactacgatgagacttacatcccaagtgagcaggagattctcgagttcgcccgtgaaatcggaatcgaccccatcaaagagccggagctcatgtggctcgcgagggaaggcattgtggcgcctctccccggtgagtggaaaccttgccaggatatcacgggcgatatctactactttaattttgcaaatggtcagagtatgtgggatcacccttgtgacgagcactatcgatcgctcgtcatccaggaaagggcaaaactcagtacatccggagctatcaagaagaagaaaaaaaaatag

SEQ ID NO: 31170 - DNA, 471 bp, Artificial Sequence
  Description of Artificial Sequence: Synthetic coding sequence
atgtcttccgtgcaaagtcagcaagagcagctgtctcagtcggatccttccccatcacccaactcttgctctagttttgaactgattgacatggacgctggttcgctgtacgaaccagtgagccctcactggttctattgtaagatcattgacagtaaagaaacatggatcccatttaactcagaagacagccagcagctggaggaagcatacagcagcggtaaagggtgcaatggtcgggttgtgcccaccgacggcggacgttatgatgttcatctcggcgagagaatgcgttatgccgtttactgggacgagctggcaagtgaggtgcggagatgtacatggttttataagggcgacaaagacaacaagtatgtaccctactccgagagtttcagtcaagtcctggaagagacttacatgctcgcagtgactttggacgaatggaagaagaagctggagagcccttag

SEQ ID NO: 31171 - DNA, 14262 bp, Artificial Sequence
  Description of Artificial Sequence: Synthetic coding sequence
atggtgcctgaagagcgtagagtaggcctgtcttcagatgagacgtcttccgactccttaaagtcatggcactctatttgcgttctcgacagcaaggaacagcctttagcatgccagcagaaacagcgtcagtttgtaaaacctgtgacagagtccgagcagcctaccgtattagagttattactggcggaacttaggacactcttcagcgcagtgttgcaggacagctcccccgcagcctggcgctacctgcatgcggtactcggacttttgccaccatatcgggaactgctggtggggcacttagatctactgccttttctcgagcaactctattgttgggccccttgggtccagactcaccttcatctggacctgttgggggcaattgtccaagcctttcctcctgatagctcattgctggatagtgccagtcacgctgattgttgcccacagaaacgccgacttcaccacaggcccccatgccccgcttgcccctttgtccaggcccagtggagccgtcagcaagtaaaagaggaactggctacctggctcaggccccttactttaccagagctgcagcgctgtcttggcattgtcggcgcacaggtcgctctcgaagaggcagtttggctggatggccttagccttctgccactcgccctggcagccgacattcccgtccgctacgaatcatccgatacagataacgctgaggtagagcctgtcggacgcaaggagacacgttcccagttggattacgaggtgccaagggagaaagctttccagaaaagcagcaccggtttcagtccagaaaccagttttttggactcacaggtgatgaccgctcttaagatggagcggtacttgaaaaagattcactttttgtatcttaatgtcgctccatcccgttacttccggccttatagcctgatggtggtaccacccgacaaagtgaatcctgaacattatattttctctccttttggcatcctacacgtgcatcctgttgaggggtctgaaacgatgaccttgggcacatggcaccaccattgtgtgctgtggcagcaactacaatttatccccttttttaagtattgcttgttacggaagtcgtttacctgctggaaaaagaatgtacgtctccagggcctgcaccgcctgcagaagtttctcgagaaccacttactgttagccgtgccacactttggcgcagggttgttgcatatctctcgacttctacaggaactgcattctgtttcctggcttccacaggaactcgatcggtgctacgagctactggatctgcagactgccctagcagaggagaagcataaagcactgcgcctgcttcacagatgcctgaacctgtgcacatcaatactacggctcgtccacgaagacacctaccacatgcagcagtgcctacaggaacgagtgcaaaactgcgaccgcatcagaaccggccagggatccatttatttgcagcgagtgcagcataagcagctggagcaaaaacttaagcaggccgaagcatggtggctccagctgggcaagttcgcgagacttgtggattacatgatctgccagtctctaatcagcgtcttggaagagcagatcaccagtttcgtggcgaacattctccaagctcctaggcaaaagccttttctgtcctcccagctggtatttgatgatcacgggcagctttctcacgtgccttgcgtcgaaaatatgatccagaccttgactggagggttgcagtctgtcaagacatcagcattgcaggtggttcaatccgctgacctcaagaccagttccgactccttgtattcggaagaggaggacgaggaagaagacagcaaagacgagtttctgatgcccaagtttcagggccaaccttcggacgctgttagtattttctgtggcccaaatgtgggcttagtgtggccttggaaatcacatcctattgcaggaattctcgaggtccgtggctgtagacttaggggccaatattttccgcacaattataaacagctcgaagaggacctagacaataaccctaagattcagcaggcattaaacatacagcaagtcctgctggagggcgtactgtgcaaggtgcaggagttttgtcgcgagcatcattggattacaggcatttatgagtttttacagtcgtggggcccacaaaagcttgaagatatgcgcggaggcccaataaagaactacgtgaccctcgtgtcgcgtctcaatgtgtggcaagcccgagtgtctagtatgcctatcgagttactaacaaaaggcggtttgctccttctgtcatgtcacgacgtccaggcagaaatggaatccaagctgaattcaatacggaaagacattctggcccacgttcagaatgagtgttggaatttaagccagcaactaatgacagaactgacagatttcatgcacatttttcgaacgataaattcagatattcacgcaatcgcgcagtgcacccagaaattgaacgaagccaatgagcagtatgtggagctggaagagcggatggaatacgttcgtgcgctccacgagctgattcgcaatcacttctctctgttctccgcagagaacgaagccttggatattagcgtgaggaggcagtttggagagtcacctattccaccctgccccccaccaccccagcctcacctcctacactgtcccctgctcgccccacaattactggatatgtgggaagccttccagtttgagaagagccaagcttcagagtttctgctgagtaaacgtcacgctatcatgccaaagctgcagcagctgatggctgccgctcttgctgaactggaaggcctcctggccaaggccctgtccggacctttcatggatccaacccaggaccagcgcagcactgaacaccagctcgtgtcccttgagcgccagttccagaatacggtctctgacctgagcgaactgcatcacgcctacgcgattttcaccgaggacgagacacctgtccctctccctatttgtggtaccaggccaatcgtacagcagcagaggatatggcacctgtaccgcgtcataagtgagaatatctccgaatggaagtgcatggccttcgcgaaattttccccagccatggcccaagagaagacagaaggctggctcaccgaggcagccaggatgtcaaccaccctcgaactccactccccagtgctgcagcattgtatgcggatcctgggtgagttccggtcctatctcccgctcttaactaaactaggcagtctgcaccctcaatctctaaattgtcagtgcctactgcgggcacttggcctggggtccttgcaaacaatcgagctgctgactttaggacaattgctaacatatccgctgttggaatttgcagaccgaattaatcaagtttggcaaaacgaaaacgagcgtatccacgctcaggagactatcaggagattgcagaggtattgggaggctagacaactgagactgctgaacttcatactgcatgtgccatatgagccccctgcttcagaaagatccaagagacaggtattgagaagcccgcagtgggaggttgtggacaaggactccggcacgttcattctgtctgattattctaatcttcaggattctatccaggagagcctgcaggttctaagcaagattttggccattgaaaaaagcggcgatcttaacaagatagctcttgaatgggtggcaattatgcacggactaggagcgcttttggaagtgtggttaacatttcaacaaaagtggatcttcctgaataaggtcctgcatgagatgaagatccagtttccaaacgccgatctcaattctcgtttcaaggtgatggacgaccagtaccgcacacttatgcggatttctgtggccgatccaatggtgctgtccttggtagtaccgtccgccgaaaggagcccttacttccaggggcagcagttacaacagctgctccaggccggttccgttgagctcgagggaataattatgtcactggagtctgtgctgtacggcgtgtgtgcgcatttccccagactgttttttctatccgacagcgagctcgtcgcactgcttgctgcacgcttggaatcgtgtgaggcgcagctctgggttagaaggtgttttccacacgtccacgctgtttcctttcggagctgtcccaccggagagaagaacacagatgattgggagtccagcccgaacacccagactcaagtcgaggcactggctgtgctgggtgccggtggcgaagaggtgaaactccagggtcccctaccactgcatcctgacctccccaagtggcttgcgtccctggaaaagtgcttgaggttggctctggtccacatgttgcagggatgcgtcgctgctcggctggcgagaggtccctcactcggggaggcgctaaagcagttgccgaaacagaacaagttatacctccaactctacgtgcagcactggatcgacctcgtgcaagcctttccgtggcagtgcgtccttgtggctgaagaagtcgtgtggagggccgaaatggaggaagcacttctggagtgggggacactcgccatggtctccatgcacatgcgaaaacttgaagtgttggtcaactttatgagagcacagagagcgagccagggcggtcagtcactgccatctgttcggcaaactagcctgttgtcagccctgttggtaatggccgtgacacatagagacatcgcccagttgctggaacagcaccaggtgtcagacctgaccgatttccactgggttcggcagctaaagtaccacctaggcagtcctcacatcattccgaagtcacctctccagtcactgaaaaccatcgctagtagtgagccatctctgagcccagcggcatgttggattgatgtcctcggtcgatccttcctgtacaactatgaatatctcggcccaaggcttggccctctgccctccctgcttcccgagaggccagcattggtgctccttctagctctggaggaggttgcttgcggaacggtgttggggcctaacggcgtcggcaaacgggcaatcgtcaatagcctagctcaggccctggggaggcagttagtcatgctcccgtgctctcctcagatcgaggcccaatgtttaagcaattaccttaacggcgctttacaggggggtgcttggctcctgttagagaaggtgcatcagctgccgcctgggttattgtctgctctcgggcagaggctgggggagctgcatcacctttatgccccactgtatcaagaagccagtcggaacacttcaacgatcgatccaactcagccccagcttctgggctcgtcattcttcgaaaaacaccacgtaagtgtgaggctgggatacggctgtttgcttgtgctccgagccctatccagtgctgtgcccgcaaatttgcacctgttgctacgtcccgttgccttagcactccctgaccttagacaggtcgccgaattaacccttctcggagctggcatgcgtgacgcctttcaaatggctaccaggttgtctaagttcttctctcttgaaagagagctagtgtccggacccttaccttgcaggctcccactccttaaacagattcttgaggatactatcagaactctcaatgttacaaaggaggaaccaaagtgtcagaagcctaggtcactggccgctatagaggaggcagctctgctgcggagccctctgttcagcatcctcaatgggctgcacctgcacaatttgcgagggctgctctgcgcgctcttcccatcagctagccaggtactcgcagagcccatgacgtacaaactgatgaaacccctggtcgttgaagagctgcagcaggtaggcctcgatccctctcctgacattctgggttctctcgaacagctgtcccaggctctgtctcgggcttctggaatattacttctggggccagcgggatccggtaaaacaacctgctggcacagcctgttcaaaattcagaatcggttggccgcaatggaggacaccagcacccagggatgtcagcctgtcgaaatcactcacctctacccctccggcctgtccccacaggagttccttgggtggctggaaggaagctgctggcaccatggaatttttccaaaggtactgcgagccgctggtcaatgtaataacatgggccaaaaacgccaaacagaggagagcatcggcatccaacattggatcatctgcgacggcgcttccaatggcgcttggctggactcaatcacctgtcttctcagcgagcttcctcaactaagtttaccttctggccagcaaatagcccgaccccctggaacatttctcctgatggaggttgccgatactaccgggatctcaccgaccgtggtagggtgttgcgctttggtctggtgcggtggcgagcaaacatggcaatgcattctatcagctcttatggcatcactgccttacgaatatagactgcagcacaggaccgttgccgaactgaatcacatggccgaagtgctcgtgcctgcaaccctgagattcctgacctgccaaggcgtgtcatctcttctgcaggtccatggtcagcaggcagtgtgcgcaggtgtggctgaggttaccagtatggccagaattctgcactccttgttggacttgcacctgaggctcaaggaagaaaaggccccaggccctgaagacctcagctactccgaccccgttgcccagtcattccggtcgagcaaatctagttttctcaaccggtctcaggtggacagcgatgacgtgccagataagtgtcgcgagcatctcttggctgttagttctttcttgttcgctttaatttggggcttcggtgcccatttgccatctaggttttggcccatcttcgataccttcattcgagatagcataagccgcctgtctaattaccctgagccccctccctcagctctggtttttgacttacatgtgtcccctgaggatgggaccttggtacccttcaccggccagtacttaagctctcatatcaaggggaccttgggaacctttcacccaagtatacagactgaacgcctgctgtatgtcgtcgatctgctcctaagtggtggacagcccgttcttctcgcaggagaggcggctacgggaaaaagtgccttcgtggaagtcctggtcgagccccaccacccatatatctatagccctatccacccagcctttagcagctcgcacctgagactgcttctgtcaagaggcattcagggtcagacccaagcatcccctcagcctggacatcaccaagactctaaaccatcacttctgttcttgctcgaagatctgcacctggccacgtccgatcccgagaagtcctgccaacccgtgctggagacgctcaggcaggcaatggatgggaccgtctacgcacacagcaccttggagttacagaccctgcagcctaccgtaaatttcctggctactgttacagtcccagggtattgtgagaggccattatgtcccaggctgtttcgccttttcacggtactggcactggagtccatgactcaagccacactcttggagcgccacgtcccgattatacaggcgtggctggagagatttccctcggtggagcgggagcgagccctggctcgcggtttagttagggcaagtgtcgaggcatgggaagcggtttgcaactgctttatgcccagccccttgcatccacactaccatttctctttacatagcgtttctcacctgctgagctccctccagctgttgccgaacagaaccggctcgagggggttcgtggactacccaaaccaccaggagcacctcagaagagtgtctggcttgagaggaacatgtctaaccgttatgatggccacacggaacgtggtccggctttggctgcacgaagcccagaggactttctgtgaccggctcgactctcctagggaaaggtcctactgcgccaagttgctgttggtggtggcgcagtctgtcttttgttgtggtcccggaccgcagcatctcggcaaagatcaccaggagtccgaagaggaggaggaagaggagcgggtacctgaggtagaatcggagggagaactggcacagtgggaagacttctcgaacagtaacagcgagacagaagaggaagaagagccctacgggctgcaggtggctagggtatcgaattcacgagaccctagcttaacacccagtattggacctgtcagtagaggcatgaaggagtccatttcacataaaatacggcaggagaagggtacacgcgcttctaactatcggctgcaggtgcgccgttcctttaaaacatggtggcaaaaaaaacctcaaatggacctgatcagtcccctgctgttacccgtgctgctgctgcacccacaagagaagccaagtgacctggttttctcacaggagctcattctgggacctaattcagagacgccgaatctctatttggaaagacagtgggaaaaattggaggaacagctggctaccagtgccgcacaactcaaactttccccccacctggccaggtgtcattctatggcacagcatgtcgctaggttagtcagagttctggccaggccacgccagcatggactgcttctgtctggcgctctgggcactggaagacacactgccataaccctcgcatcaagcatttgtcaggctcacttctttcatttgcctagtggttctgaggaggcaatcctacagtgtcttcgcgacgcatcctggcacgcaggaatgctgtcacaacctgtagctctactcgttccttcaggagttgatctaaccactctacatcgcctgctggcactggccacgagcggcagtttccctgggcagtacaccgaggctgatttagaccggattggcgaacacctccctagagaaaacctcggagtgaagcagaacatcaagaaagagatggtactgcagagattccatcagcaggtctgcagccatcttcacctctttttcctgattggcgacaaacaggctcacaagcagctacccagcaccctcttcctccgactcctgcagttggccacagcttcaatcgacagatatgagccttgggaccaggctgccctggccaaagtggcccagcaccacctcgagggggctcaatcagtacccctggacgatggtagttggaagtaccctgatctccaggcctctatccctagcgtcgccaaagcaatggcacttatccatctgtcagctacccattaccatgaacacctgtgcccggcactcccactagtcacccccaagaccttcctcgacttcctggacacttttctcatgctccagcagcaaaccattctgaagatcaagaacaaggcccagcgcgtgcagaacgcactggagaacctgcgaatgttgatcaaagagcacggaacccacgcaaatctaatcttcgacctggaacagcaactgaaggacagcggaaagtctttatcaatgttccagcagcaacttgaacagtccaagctcctctacaaacaacagttggaggagtgcagacatcaggagaatctgatcgagaatctggctagacagcgagacgccctccaagctcaaagagaagcatttctcgaacagatgagcaaggcttttctggagcccctgtctcaactgcaggtcgcagacttcgaagaaatccgcagctaccgggctcctcctgaatcagtggttcgggtcactgatgccatgtgcgacctgttccaccacgaaaccggctgggcttcagcgaaacagctcctgtgtaccgaagatttctaccaggaactggtcttcttccccaaagagaaaattacagactccgaacttattaaacttcacctcatcctgaaggcgcctggaatggatgacgctgctctgcgggctgtgagccgtcccgctgctagtctcgccgcttggctgtgggcagtgcttcactacggtctggctcactgtcgcggtctgcctaccgatctgctcctccaacaggtcgaggcgacattgacgcgcgaacaggctaggctgggatattaccaattccaggcccaggaaacattggagcacaatctggccttggcgaagatggtagaggacgcacaggcctcacataactgcgtggccaagactttgtcccaagctcagtgtggacagtatcacaaatggcctatgaaggctgctctgctgacccctatgagggcatggactacacagctgcagaaactgaaggggagatgcatgaccgttttcggagacacactgctgtgtagcgcagcgattatctacctaggacctttcccacctctgcgtcgtcaagagctgctcgatgagtggctcgctctgtgccgtgggtttcaagaggctctcggccctgacgacgtggctcaggccttgaaacgcaagcagaagtccgtctcaataccccctaaaaatcctctgctggcaacgcatagtcctttcagcattctctcactcctttcatcggaatctgagcagtatcagtgggatgggaatctcaaacctcaggccaagtccgctcaccttgcgggactgctgctacgtagtccaacccattacagcagctgccgatggcctctgttactggatcctagcaatgaagctctgatttggctcgatccactgccactggaggagaatagaagctttgctccagcacttacagaaggtcggggaaaaggccttatgcgaaatcaaaaacgtgagtcaaagacagacatgaaagaggaagatgacgaatcagaggagtccaatgaggccgaagatcaaacgaaagagcaaaaagctgaggagagaaaaaatgaacaggagaaggagcaggaggagaatgaagaaaaggaggaagagaagacagagtcccagggatctaaacctgcctacgagacacagctgcctagcctgccgtatctgtctgtacttagcggggctgaccccgaactgggatcccagctacaagaggctgcggcatgtggccttccagtgctattgacaaacgtggaactgggactcggatgtgaagaactgcaatggctcctccagcgggagcaactctccccgcctcaggtccagccaggcttttgcttgtacctctctacaaccctgagcctatgtgcaatggaaaaggtcctcggatgcgagctcctgaagggcctcaatgttctggaccttgggttgaatatggagatcctggaagaacagatgcttcacgaaatactgtgtagagaatatcctgagttggagacacgttggcaggatcttaaaattcgagcgctggacacctgtaaagctgtagaagccgctgaagaaagactgctgacaatgctgctgtttcagaatccaaagcggcagaagccagccaaatttctgagaaatatagttcgcgctcagggtaaactttgtcagttacgggcacattgcgaggagctcgaggggcagaagctacaggagatggttctctgggccccttaccggccagtagtgtggcacggtatggcaatggtgaaggcactctctcaacttcagaatctgctgcccctcttctgcatgagtcccgagaattggctcgccgtgacaaaacaggcactggattcaatgaagccccgtgaaattaaccatggtgaggacttggcatcccacctgctccagctgcgggctcacctaacccgacagctgcttggatctaccgtaaccgccttgggtctaactcaagtgcctctagtgggcgcactcggcgcactagcacttctgcaggcaacaggcaaagctagtgagctcgagcggctggctttatggccaggactggccgcttccccgtctaccgtacattcaaagccagtgtctgatgtggcccgtccagcctggttaggaccaaaagcctggcacgagtgtgaaatgctggaactacttcctccctttgtcggtctgtgcgctagcctcgcgggacactcctctgcctggcaggcctatctaagccttagctcaaccgttcttgggcctgccccagggcctgggccagaaccactgagtcttctgcaaaaacttattctctggcgcgtactcaggccggaatgtttggccggagccctcgccgacttcacaacctcactacttggtaggcccctggacgagaatacctacgcccctaccatgccttttaaacactcccaggccactcaaccgatgttaatcttgttgcctccgccagggcatccttcggccaccctgcaccctctgaccgtaatccaaaaattagcagccaaatatcagcaaggccaaaagcagctccaagtgatcgctttagggtctgaagcctgggatccagtgtcagtggttgtatcaacgctttcccaggctatgtatgaggggcattggttggtgcttgacaattgtcatctcatgccgcactggccaaaagagttgttgcagctgttactcgagctcctggggcgagctaaagtggtggccgatctcgaatccgagcagctgttagaccagccagagtctcgaaatgtgtcaacagtccatcgcgatttccgtctatggctaattgtcccagccgagagcagcgcttctttgccagctgtgctcactcagcacagtatgcccgtgttctggaaccaatcactggagctgggtcatgttctcatagactccgtcgagctggcccagcaggtcctgtatatgcagccacccacccaagccctgcccctgctgctgcttcacgggttgttactacaccgccagttgtacggcacacgcctgcaggcccaccggggaagatggagtcaagtgacactgacccaggtactgcagacacaggatcagttgtgggccagtctgtccaacccaagggccgctatgcaggaactggccgcatccgtgttttatgggggacctctgggggatactgaggatagagaagccctcatttccctgacgcaagcctgtctctcccctagttccggatcatgggtgcaaccacataccccacaaagcctgctggccacactgatgccgttgcccgaacttcgggagctcgacgccatggcagagtgcaaggcccaaatgcatttgttgccgagccccccagaacccaggctctgcggtttatccgagggccctcaggcttggctgttgaggagacaaagcagggccttgctgagtgctcttcagaggtcgtccccagtgtgggtcccggagtctagacggggagcccagctagccgaacgcagactgagacaaaggttggtacaagtgaatcgccgattagagagcctccaggatctcttaacacatgtgattcgtcaagatgagagcgatgctccatggagcgttctcgggcctaatgctagaagacccctagaaggggtattggagactgaggcccttgagctgtcacagctcgtcggcactctgcaaagggatctggactgtctgctccaacaactcaagggagcccctccctgcccaagccggcgatgcgcagctgtggcgcatgccctgtggactggtagactccctttaccatggagaccacatgccccagcaggaccccagccaccttggcactggctgcgacagctctcaagacgtggtcaactcctggtacggtatcttggggtcggcgctgatgcctcctccgacgtacctgaaagggtgttccacttgagtgcttttcgccacccacggaggctgttactggcgctgcgtggtgaggccgcactggatcagaatgtcccttcttctaacttcccaggcagcaggggttctgtctcatcacaactacagtataaacgattggaaatgaactccaaccctcttcatttcagagtggagaacggtccgaacccaactgtcccggagcgcggtctactactgatcgggctacaagtgctccatgctgaatgggaccccatagccggagcactgcaggatagccccagttcgcagccctctcctcttcctccagtaagcatctcaacccaggcacctggcactagcgacttacccgctcccgcagacctcaccgtttattcatgtccagtctatatgggtgggcctctcggcaccgccaagttacaaagtagaaatatcgtgatgcacctgccactacccacaaagctcaccccaaacacttgcgttcaaagacgagtgcatgtgtgcagcccacccctaagctaa

SEQ ID NO: 31172 - DNA, 390 bp, Artificial Sequence
  Description of Artificial Sequence: Synthetic coding sequence
atggtagccatggccgaagccgaagccggagtggccgtggaagtacgcggtttgcctccagctgtgcccgacgaactgctgactctctattttgaaaacaggagacggagcgggggaggacctgtgctgtcctggcagcgtcttggctgtggcggagtgctgacgttccgggaacctgcagatgcagaacgggtcctcgcccaggccgaccacgaactccatggcgctcaactatctctgcggcctgcaccccctcgggctcctgctagactgctgttacagggtttacccccagggacaacacctcagaggcttgagcagcatgtccaagcgctgcttagagcaagcggacttcctgtgcagccctgctgcgcgcttgcctctccctag

SEQ ID NO: 31173 - DNA, 867 bp, Artificial Sequence
  Description of Artificial Sequence: Synthetic coding sequence
atggaacgtgaaccttcggccagcgaggccgcacccgctgccgctgctctgtttgcttggggagctaattcttacggtcagctgggactgggtcacaaggaggatgtgttgttaccccaacagctgaacgacttctgtaaaccacggtcggttcggaggataaccggcggtggcggacacagcgccgtagtgacagatggaggggacctcttcgtgtgcgggctgaacaaggatggccagcttggcctaggtcacaccgaagacattccttatttcactccttgtaagtcgttatttggctgccccatacaacaggtcgcctgcgggtgggacttcacgatcatgctgaccgaaaatgggcaggttctaagctgcggaagtaacagttttggtcagctgggcgtcccacacggccctaggcgctgtgtggttccccaagctatcgaactgcataaggagaaagtggtttgcattgccgcaggtctgagacacgctgtcgcggctaccgcgagtgggatcgtgttccagtggggcactggactggctagttgcggccgaagactttgtcctgggcagaccttgcctcttttctttaccgccaaagaaccatcaagagtaaccgggttggagaacagcaaggccatgtgcgtcctagcaggcagcgatcatagtgcgagtcttaccgacgccggagaggtatacgtctgggggagcaacaaacatggacaactggccaacgaggctgcctttctgccagtgcctcagaaaatcgaagcccactgcttccagaatgagaaagtcaccgccatctggtctgggtggactcaccttgtggctcagacaggactcctatggttaagggcctag

SEQ ID NO: 31174 - DNA, 372 bp, Artificial Sequence
  Description of Artificial Sequence: Synthetic coding sequence
atgaacagaaggcgtaaatttctgttggcttccgttctcgctctgcagaattcatcctttatataccctagctgtcagaagtgcttttcacgcattatcctagtgagcaaaagaagcaactgccccaaatgcggttcaaccggagaatccgggaatgctaactatagatacaagctgtcactgaaggtcgctgaatccaataaattgtttgttattactgtctttggctcctgcctggacacatttttcggtctaactgctacaggactgcataggtatatccaggaccctaataagattccagagaccctcgataacgacaccactcagaaccttttgaccaaagcggtagagacatgctttgtgggatag

SEQ ID NO: 31175 - DNA, 324 bp, Artificial Sequence
  Description of Artificial Sequence: Synthetic coding sequence
atgcttaggttgtatcccggaccaatggtgacagaagctgaagggaaggggggtcccgagatggcatcattaagttcaagcgtcgttcccgttagctttattagcactcttcgcgagtcagttcttgatccaggcgtgggcggtgaaggtgctagcgataaacaaagaagcaaactgtcactgagccactcaatgattcctgccgctaaaatacatactgagttgtgcttgccggcttttttctccccagctggcacacaacgacgctttcaacagcctcagcaccacctgaccctgtcaatcatccacacggctgcccgttag

SEQ ID NO: 31176 - DNA, 1653 bp, Artificial Sequence
  Description of Artificial Sequence: Synthetic coding sequence
atggagaccgatctcaactctcaggatcgcaaagacctggacaagttcataaagttcttcgctttgaaaactgtccaggtgatcgtacaggccaggttgggcgaaaagatctgtacccggtcctcgagcagtcctaccggatctgactggtttaacctggcgattaaagacattcccgaggtgacacacgaagcaaagaaggcactggccggacaacttccggcagttggaagaagtatgtgcgtggagatttctctgaagacttcggaaggtgactctatggagctagagatatggtgtttggaaatgaacgagaaatgtgacaaagagattaaggtgagttacaccgtgtacaatagattatccctgcttctcaaaagcttgctcgccatcacaagggtcactcccgcataccgcttgtcccggaaacaagggcatgaatatgtaatcttgtaccggatctacttcggggaagtgcaactcagcggccttggggagggatttcaaacagtgagggtgggaacagtagggacccctgtcggaacaattaccctgtcatgcgcataccgtataaacctcgcattcatgtctaccagacaattcgagcgaaccccccctatcatgggcattattatcgatcatttcgtggatcgtccatatcccagctcaagccccatgcatccctgcaactatagaactgccggagaggatactggagtgatttaccccagcgttgaggattctcaggaagtttgcaccacatcattctctacttccccaccttcacagtgtgtgttcacggttaccaaagcccacttccagactccaacgccagtggtgacagacactctgcgggttccgatggcgggtctggccttttcccaccagttgagctcaagtcggctctcttaccaaccagccgcactgggcgtgggctccgccgatctggcctaccccgtggtgttcgcagccggacttaatgctactcatccccaccagctcatggtgcccggaaaagaaggaggggtgcctctcgcccctaaccagccagtacatgggacccaggcagaccaggagagactcgccacctgcactccctcagatagaactcactgcgccgctacaccttcatcttctgaggacacggaaactgtttcaaacagcagcgagggcagagcctcaccacatgatgtgctggagactatcttcgttcggaaggttggtgcctttgtgaataaacccatcaatcaagtcacactaacatccctcgacatcccttttgctatgttcgcaccgaaaaacctggagctagaagacacggaccctatggtgaaccctccagacagccccgagactgaatcccctctccagggaagtctgcacagcgacggcagtagcggaggatcaagcggaaacactcatgatgatttcgttatgatcgactttaaaccagcattttccaaagacgacatcctgcccatggatttaggaactttctatcgagagttccagaatcctccgcagttgagcagcctgagcattgacattggcgctcagtctatggccgaggatctggactcactccccgagaaactcgccgtccatgagaaaaacgtgcgggaattcgatgcattcgttgaaaccttacaatag

SEQ ID NO: 31177 - DNA, 4104 bp, Artificial Sequence
  Description of Artificial Sequence: Synthetic coding sequence
atgggaaattcagactctcagtatactctccagggatccaagaaccattctaatactataacaggcgctaaacagatcccttgctcactgaagatcagaggtattcatgcgaaagaggaaaagagcctgcacgggtgggggcacgggtctaatggcgctggatataaatctcgaagtctcgccagatcctgtctgtcccactttaaatccaatcagccatatgcctcccggctcgggggacctacgtgcaaagtgtccaggggagtggcttactctactcacagaacaaatgcgccagggaaggatttccagggaataagcgcagctttcagcactgagaacggctttcactctgtgggacacgagcttgccgataaccatattacatccagggactgtaacggacatcttctgaattgttatggccgtaatgaaagtattgcatcaactccaccaggggaggataggaaatccccacgggtcctgataaagaccctgggtaaattggatggctgcctgcgggtggaattccataatggcggtaatccgagcaaagtgcctgccgaggactgcagtgagcctgtccagctgctccggtactcccccactctggcctccgagacatccccagttcctgaagctcggaggggatccagtgccgattcattgccatctcatagaccatctcccaccgactcccggctgcgcagtagcaagggatcttctctctcaagcgaatccagctggtatgactccccatggggtaacgccggtgagctgtctgaagccgaaggatcattccttgcacctggcatgcccgaccctagcttgcacgccagctttccccctggtgacgctaagaagccatttaaccaaagtagtagcctgtcttccctcagagagctttacaaagacgctaatctgggaagcctgagtccctccggtatacggctgagtgatgagtacatgggcacccacgcctccctatcgaatcgcgtgtcttttgccagcgatatcgacgtcccttcccgagtcgcccatggagacccaattcagtactcaagctttaccttgccctgccgaaaaccaaaagccttcgttgaggacactgctaagaaggacagcttaaaagctcgtatgcggcgtatatcagactggaccgggtctctgagccggaaaaagcgtaagctgcaagaaccgagatctaaggaaggcagcgactacttcgatagccgatccgacggactcaacacagatgttcagggtagctctcaggccagcgcctttttgtggtcgggaggcagcacgcagattctgtcccagcggagcgaaagcacacatgccatcgggagtgaccctcttcggcagaatatctacgagaattttatgcgagaactggaaatgagcagaactaacactgagaatatagaaacttcaaccgagacagcggaaagttcatcagagtctctgtcgtccctggaacagttggacctgctgtttgaaaaggaacagggggtggtccgcaaagctggatggctgttcttcaagcctttggttacagtgcaaaaggagagaaaactggagctggttgcgaggcgcaaatggaaacagtattgggtaacattgaaaggttgcaccctgcttttttacgagacttatgggaagaacagtatggaccaatccagcgccccacgttgcgccctgttcgctgaggactccattgtgcagtcagtaccagaacaccctaagaaggaaaacgtcttctgcttgtctaattctttcggggatgtgtatctgtttcaggctacatctcagaccgatcttgagaactgggtgactgccgtgcatagcgcctgcgcttctcttttcgccaagaaacatggcaaggaggataccctgaggttgctgaagaaccagacaaaaaatctgctgcagaaaatcgatatggacagcaagatgaaaaagatggctgaattgcaactgagcgttgtgtcagacccaaagaataggaaggcgattgaaaaccagatccagcagtgggaacagaaccttgaaaagttccatatggacctctttaggatgcgctgttatctggcctctctccagggtggggaactcccaaatcctaaatcgcttctcgccgcagctagccgccctagtaagctagccctgggcaggctgggcattctgagtgtttcgtctttccacgctctggtatgcagtcgggatgattccgcactgcggaaaagaaccttatctctaacccaacgcggacgaaacaagaaaggtatcttttcaagtcttaaggggttagatacattggctagaaaggggaaggagaagagaccctctatcactcaggtggatgaactgctacatatttacggctccaccgtggacggtgttccgagggataacgcctgggagattcaaacttacgtgcacttccaggacaaccatggagtcaccgtgggaattaagcctgagcatagagtggaggacattctgactctggcatgtaaaatgagacaactggaaccctctcattatggcctgcagctgcggaagttggtggacgataacgttgagtactgcatcccagctccctatgaatatatgcagcagcaagtgtacgatgagatagaggtttttccactgaatgtatatgacgtccaactcacaaaaactgggagcgtgtgcgattttgggtttgccgtcacagcccaggttgatgagcgacagcatctgtctcggattttcatttcagatgtccttcccgatggcttagcctacggggaaggtctgaggaaagggaacgagattatgacactcaatggggaggccgttagcgacttagaccttaagcagatggaggctctgttttctgaaaaatctgtcggtttgacattgatagcgagacctccagataccaaggccactctctgcacatcttggtccgacagcgacctgtttagcagggaccaaaagtctttactgcctccacctaatcagagccagcttctggaggagttccttgataattttaaaaagaacacagccaatgatttctcaaatgtacctgacatcactacaggcctcaagaggagtcagacagatggcacactggatcaggtgtctcacagagagaaaatggagcagaccttcaggtcggccgaacagattacagcgctgtgtaggagttttaacgactcccaggcaaacgggatggaagggccaagggaaaatcaggatccccctccaaggtctttagccaggcacttgtcagacgcagacaggttgaggaaggtgattcaggagctagttgatactgaaaaatcctatgtcaaggatcttagctgtctctttgagctgtatctggagccactgcaaaatgaaacgttcctgacacaggacgaaatggagtccctgtttgggagcctgcccgagatgctggagtttcagaaagtgttcctggagacgctcgaagacggaatttccgcttcttctgatttcaatacacttgaaacacccagccagttcagaaagcttctcttcagtctgggaggaagcttcttgtactatgcagatcactttaaactatacagcggattctgtgccaaccacataaaagtccagaaggtgctcgaaagagctaaaaccgataaggccttcaaggcttttcttgacgctcgtaaccccaccaagcaacacagcagcacccttgaatcatacctgatcaaacctgttcagcgggtgctgaagtatccactgctgctgaaagagctagtgagcctcacggaccaggagtcggaggaacattatcacttaacggaggcccttaaggccatggagaaggtggcctcccatataaacgaaatgcagaagatctacgaagactatgggacagtcttcgaccaactggtagcggagcagagcggcactgaaaaagaagttaccgaactgtctatgggcgaactcctcatgcactcaaccgtctcctggctgaatccctttctttctctgggcaaagcacgcaaagatcttgagctcaccgtattcgtgtttaaaagggctgttatcctggtgtacaaagagaactgttag

SEQ ID NO: 31178 - DNA, 45 bp, Artificial Sequence
  Description of Artificial Sequence: Synthetic coding sequence
atgaacgggacactggaccatcccgaccagccagacctcgattag

SEQ ID NO: 31179 - DNA, 519 bp, Artificial Sequence
  Description of Artificial Sequence: Synthetic coding sequence
atggttgccatggctgaagccgaagctggggttgccgtggaagtgcgcggactgcctcccgctgttcccgacgagttgttaactttgtacttcgagaacagaaggcgcagcgggggtggtcctgtgctgtcttggcagagacttggttgcggaggtgttcttaccttccgagagcctgctgacgcagagcgggtgctggctcaggctgatcatgagctgcatggcgctcagttgtctttaagaccggctcctccaagggctccagcaagacttctgctgcagggcctgcctcccggaaccactccccaacggttggagcagcacgtgcaagccctcctccgcgcaagcggacttccagtgcagccctgctgcgcccttgccagccccagacccgatcgcgctctcgttcagttgcctaaaccgttgagcgaggcggatgttcgcgtattggaggaacaggcccagaatctgggactggaaggcacactggtcagcctggctcgtgtaccacaagcttag

SEQ ID NO: 31180 - DNA, 27 bp, Artificial Sequence
  Description of Artificial Sequence: Synthetic coding sequence
atgttctggaagttcgatctccattag

SEQ ID NO: 31181 - DNA, 411 bp, Artificial Sequence
  Description of Artificial Sequence: Synthetic coding sequence
atggtggcaatggctgaggctgaagccggagtggccgttgaagtgaggggtctaccacccgcagtgccagacgaacttcttaccctgtatttcgagaatcgccgtcgctctgggggagggcctgtgttgtcctggcagaggttagggtgcgggggagtactcacattcagggaacctgccgacgccgaaagggtgcttgcacaggccgatcatgagttacacggagcacagttgagcctccgaccagcccctccccgtgcccctgcacgccttctcctgcagggcctgccccctggaacaactccccagaggctcgagcagcacgtgcaagccttgcttcgtgcgagcggtctccctgtgcagccatgttgtgctcttgcttcccccagaccagaccgggcactggtgtag

SEQ ID NO: 31182 - DNA, 5843 bp, Artificial Sequence
  Description of Artificial Sequence: Synthetic coding sequence
ggtcgtcctattgatcctagagaggggcctgggcgaccaccgttggacggaagggatcacttcggaagaccccctgtggatatcagagagaatcttgttaggcccggaatcgaccacctgggccgtagggatcacttcggattcaaccccgaaaaaccttggggtcaccggggagattttgacgaacgcgaacaccgtgtcctgccagtgtacggagggcctaagggccttcacgaggaaaggggtcgtttccgctccgggaactatcgttttgacccacgttccgggccttggaataggggattcggccaggaggtgcaccgcgattttgatgacagaaggcggccatgggaacggcagagagaccgggatgaccgcgactttgacttttgtcgtgaaatgaatggcaataggctgggacgcgaccgaatccaaaatacttgggtccctccccctcacgcacgtgtcttcgactattttgaaggcgctacaagccagcgcaagggcgataacgtgcctcaggttaacggagagaataccgagaggcacgcacagcctcccccaattcctgtgcagaacgacccagaactgtacgagaaactgacatcctcaaatgagatcaataaggagaagtctgacaccgtcgctgatatcgagtcagagcccgtggttgagtccacggagaccgaggggacacccctcacatctctgacagccgagacacgcagacaggtcaagatgggtaacagtgactcccagtataccctgcaaggttccaaaaaccactctaatacgattaccggagctaaacagatcccttgctcccttaagatcagaggtatccatgccaaagaagaaaaatctttacacggatggggccacggcagtaatggagcgggttacaagagtcgctcccttgcacgatcatgtctgagccactttaaatccaatcaaccctacgcatctaggctgggagggcctacctgtaaagtctcccgcggtgtggcctattccacacacagaaccaacgccccagggaaagacttccagggtatttcagcagccttcagtaccgaaaacggcttccatagcgttggacacgaactggccgataatcatattaccagccgggattgtaacggccatctgttaaattgttacggcaggaacgaatctatcgcctctactcctccaggtgaagatagaaaatcgccaagagtcctgattaaaacactgggcaagctcgatggctgtttacgagtggagttccacaacggtggcaatccttcaaaagtgcccgcagaagattgctccgaacctgtgcagttgctgcggtattcccctactcttgcgtctgagacttcccccgtgcccgaggcgagacgcggaagcagcgccgattcattgccatctcatcgaccttcccctacagatagccgtttgcgaagctctaaaggctcgtcgctgagctctgagagctcttggtatgactccccatggggaaacgccggtgaattatctgaagctgagggtagctttcttgctcctggtatgccagacccaagcctgcacgcttcctttcccccaggtgatgctaaaaaacctttcaaccagtcttcttctctgagctccctgagggagctgtacaaagatgccaacttggggtctctgagcccctcgggaattaggttgtctgatgagtacatgggcacgcatgcatccttaagtaatagagtgagctttgcttctgacatcgatgtaccctcacgggttgctcatggtgatcccattcagtacagctcattcaccctcccctgccgcaagcccaaagcatttgtggaggatactgcgaagaaggattcactcaaggcgaggatgagacgtatttctgattggaccggctctctttcgaggaagaaaaggaaactccaggagccacgttcaaaggagggttctgactacttcgactctcgctccgacggcttaaatacagacgtccagggctctagccaggcaagcgccttcttatggagcggaggcagcacgcagatcttgtctcagcggtctgaatccacccacgccatcgggtccgatcctctacgccaaaatatctacgagaattttatgcgggagctggagatgtcccgcacaaacaccgagaatatagaaactagcacggagactgctgagtctagcagcgagagtctctccagtctcgagcagttggaccttctctttgagaaggaacaaggagtggtcaggaaggccggttggctctttttcaagcctttggtgaccgtgcaaaaggagagaaaactggaactggttgcgagacggaagtggaaacaatactgggttacactgaaagggtgtacactgctcttctacgagacctacggaaagaatagcatggatcaatcttcagcgccacgttgtgccctcttcgcagaggattctatcgtgcaatctgtacccgagcacccgaaaaaggagaatgtattttgtcttagcaactcctttggtgacgtttatcttttccaggccacctcacaaactgatctggagaattgggttactgccgtacactcagcctgcgcatcattgtttgccaagaaacatggcaaggaagacactttgaggttgcttaaaaatcaaactaagaacttactccagaagatcgatatggatagcaagatgaaaaaaatggccgagttgcagttatccgttgtttccgatcccaaaaaccgaaaagccatcgaaaatcagattcagcaatgggagcagaacctggagaagttccatatggacctctttcgaatgcgttgttatctggcctcactgcaaggcggagagttgccaaatccaaaatccctgctggccgcagcaagtcggccatcaaagctagccctgggacgtcttggaattctcagcgtttcaagcttccatgcacttgtctgttcccgtgacgatagcgctctccggaagagaacgctgagcctcactcagagaggtaggaacaagaaagggatatttagctcactgaagggccttgataccctagcccgaaaaggtaaggagaagagaccgtcaatcacccaagtcgacgagttgctccatatctatggtagcactgtggacggagtgcctcgcgataatgcctgggagatccaaacttacgttcattttcaagacaatcacggagttacggtcggaataaagccggagcaccgcgtagaggatattcttacgctcgcctgcaagatgaggcaacttgagccttctcactacgggctgcaattgcgtaaattagtggacgacaacgttgagtattgtataccagccccatacgaatatatgcagcagcaggtttacgacgaaatagaagtttttccactcaatgtttatgacgtgcagctgactaagacagggtcggtctgtgactttggatttgctgtgacagcacaggtcgacgaaaggcaacatctaagccgcatctttatctctgatgtgctgcctgatgggttggcctacggtgaaggcctccggaagggaaacgagattatgacactgaatggtgaggcggtctcagacctggatcttaagcagatggaggcccttttcagcgagaagagcgtcggactaaccctcattgcacgaccaccagacacaaaagcaacgttgtgcacaagctggtctgactccgatctgtttagcagagaccaaaagtctttgctgccccctccgaatcagtcccagctgctggaggagttcctggataatttcaagaagaacacagctaatgacttcagtaatgtcccagacattaccaccggtctaaaacggagccaaaccgacggaacacttgaccaagtctcacaccgggaaaaaatggagcagacctttcggagcgctgagcagatcaccgccctgtgccggagcttcaatgatagccaagcgaatggaatggaaggaccacgtgagaaccaggaccccccaccaaggtccctggcgagacacctgagtgatgcagatcggctgcgaaaagtcatccaggagctggttgacaccgaaaaatcttatgtaaaggacctgtcgtgcctgtttgagctctacctggaaccgctccagaatgaaacttttctaacacaggacgaaatggaatctttattcgggtcactacctgaaatgctagaattccagaaggtcttccttgagacattggaggatgggatctctgcttctagcgatttcaatactctggagactcctagtcagttccggaagttactattctctcttggcggatccttcttgtactacgcggaccatttcaagctgtatagcggcttttgcgctaaccatataaaagttcagaaggtgctcgaacgggctaagaccgacaaagctttcaaagcatttcttgacgcacggaaccccacaaaacagcattcctctaccctcgaatcctacctaattaaaccagtccaacgagtactcaagtatccattgttgcttaaagagctggtgagtctgacagatcaggagtcagaagaacactatcatctgaccgaagcactgaaggcgatggagaaggtagcctcccacattaacgagatgcagaagatctatgaggactatggcacggtattcgaccagttggtggccgaacagagcggcacggaaaaagaagttaccgagctgtcaatgggggaactccttatgcactcgaccgtcagctggctgaacccttttctgtcactggggaaggcacgaaaggatctcgagcttacagtgttcgtatttaagagagccgtgattttggtgtataaagagaactgcaaattgaaaaagaagctgcccagcaattctagacccgcacataactctaccgatctggacccattcaaatttcgatggctgatacccatctcagccctccaagtgcgcttgggcaatccagccggaacggagaataactcaatatgggagttgattcatacaaagagcgaaatcgaaggacggccagaaacgattttccagctgtgttgttcagattcagagtccaaaacgaacatcgtgaaggttatccggagtatccttcgggaaaattttcggaggcatattaagtgcgagcttcctctcgaaaagacctgtaaggaccgcctcgtgcccctcaaaaatcgggtgccagtgtccgccaagttggccagcagccgatccctgaaggtgctcaaaaactcatcttccaacgaatggacaggggaaaccgggaaaggcacactcttggactctgacgaggggagtctttcctcagggacacagagctccgggtgccctacagccgaaggcaggcaggactctaagagtacctctcccggaaagtacccccatcctggcctggcagattttgccgataacctaattaaagagagcgatatcctctcggatgaagacgatgaccatcggcagaccgtcaaacagggaagccccacaaaagatatagagattcagttccaaagattgcggattagcgaagatcccgacgtccacccagaggccgaacagcaacctgggccagagtcaggggaaggacaaaagggcggagagcagccaaagttggtgcgaggccacttctgccccattaaacgcaaagccaattccactaaaagagacagagggacactcctgaaagcacagattaggcaccagtcattagacagccagagtgaaaacgccacaatcgatctgaatagtgtgctggagcgagaattttccgtgcagtctcttacaagcgtagtgtctgaggagtgcttttacgagaccgaatcccatggcaaatctta

SEQ ID NO: 31183 - DNA, 294 bp, Artificial Sequence
  Description of Artificial Sequence: Synthetic coding sequence
atggaggctgccgatgcttcacgttcaaacggaagctcccccgaggccagggacgctagaagcccatccgggccatctggctcactggagaacggcactaaagccgacggtaaggacgctaagaccacaaacggccacgggggagaggccgctgagggcaagtccctaggtagcgctctcaagcctggcgagggacgatccgctctgttcgcaggcaatgagtggagaagacctattatccagtttgtcgaatcaggcgacgacaagaattcaaactacttttccatggactag

SEQ ID NO: 31184 - DNA, 117 bp, Artificial Sequence
  Description of Artificial Sequence: Synthetic coding sequence
atggaggccgctgatgcaagtaggagtaatgggtcatcaccagaggcacgagacgcccgttctccttctggtccaagcgggagcttggaaaatgggactaaggctgatggtaagtag

SEQ ID NO: 31185 - DNA, 1455 bp, Artificial Sequence
  Description of Artificial Sequence: Synthetic coding sequence
atggccatcggaaaaaggctcgctacactccccacaaaggagcaaaagacacagagactcattagtgagcttagcttgttaaaccataaactgcccgctagagtgtggctccctactgctgggttcgaccatcatgtggtgcgagttcctcatacgcaggctgtagtccttaactctaaagataaagctccgtacctgatctatgtggaagtactagagtgcgaaaactttgatacaaccagtgtcccagccaggattccagagaatcgtatccggtccaccaggtcagttgaaaatttgcccgagtgcggaattactcatgagcagagggccggttccttttcaaccgtgccaaattatgacaatgacgatgaagcgtggagcgtcgacgatatcggagaacttcaggtggagctgccagaggtgcacactaatagctgtgacaacatcagccagttctctgttgatagcatcactagtcaggagagcaaagaaccagtctttatcgccgcaggcgacatacgacgacgcctgagcgaacaactggcccatacacccactgccttcaagagggatcctgaagacccctctgcagttgcattgaaggagccctggcaagagaaagtgcgaaggatcagggagggatccccctatggccacctccccaattggcgcctgctgagcgtgattgtcaagtgcggcgacgatctgagacaagagttactagcctttcaggtgctgaaacagttacagtccatttgggaacaagaacgtgtgccgctgtggattaagccctacaagattctcgtgatatcggccgacagcggcatgatcgaacctgtggtcaatgcggtgagtattcaccaggtgaaaaaacaaagccaactgagtctgttagattactttttacaggaacacggctcctataccacagaggcatttctatctgcgcaacgaaactttgtccagtcttgcgccggatactgtctcgtctgctacctgctgcaagtgaaggatcgacacaacgggaatattcttctggatgcagaagggcacatcatccatattgattttggatttattttgtcctcatcccccagaaatttaggctttgaaactagcgcttttaagctgacaactgagttcgtagatgtcatggggggactagacggggatatgttcaattattacaagatgctaatgctgcagggacttattgccgctcgcaagcatatggataaggtcgtccagatcgtggagattatgcagcaagggtcgcagctcccctgcttccatggaagcagtacgatcaggaacctcaaagaaaggttccacatgtctatgaccgaggagcagctgcagctcttagtggaacagatggtggatggatcgatgcgctctattaccacaaagttgtatgacggcttccagtatttaaccaatgggatcatgtag

SEQ ID NO: 31186 - DNA, 228 bp, Artificial Sequence
  Description of Artificial Sequence: Synthetic coding sequence
atggcaattccaatcacagtcttggactgcgatcttctcctctatggacggggacaccgcaccttggatagatttaaactggatgacgtaacagatgagtatctgatgtctatgtatgggttccccaggcagtttatatactacctggttgagctgctgggcgctaacttaagcaggccaacgcaaagatctcgtgccatctcccccgagacacaggtccttgcttag

SEQ ID NO: 31187 - DNA, 2754 bp, Artificial Sequence
  Description of Artificial Sequence: Synthetic coding sequence
atggacggggcagccggaccaggggacggccctgctcgggaggcccttcaatccctgtcccagaggctgagagtccaagagcaagagatggagctggtgaaggctgcgctggctgaggctctgcggctccttcggctccaggtccccccttcttctctgcaaggctctggaacccccgctcctccgggagactccctggctgcaccgccaggccttcctcccacttgtactccatctcttgtttcacgaggcactcagactgagactgaagttgagttgaaaagtagtcccggacccccaggactgtcaaacggacctcctgctccacagggagcgagtgaagagccctccgggacccaaagcgagggaggcggatcatcgagttccggtgccggatcacctggtccccctgggatcttgcggccactgcagcccccacagcgcgcagacacacccagaaggaattcgtcctcttcttcgagcccctctgaacgcccacgtcagaaactctccaggaaggctatttcctcagctaatttgctggttagatcaggcagtactgaaagtcgcggaggaaaggaccccctatcatctccaggagggcctgggtctcggcgttcgaactataatcttgaagggatttctgtgaagatgttcctgcgaggaaggccaattaccatgtacatcccaagcggaattcgcagtttggaggagttaccctcaggcccaccaccagagacccttagcctcgattgggtctatgggtacagggggagagacagcagatccaatctgtttgtcctcagatctggcgaggtcgtgtactttattgcatgcgtcgtagtgctgtataggcctgggggaggacccggaggtccgggaggaggagggcagcgccactacagggggcacactgattgcgtcaggtgtctcgccgtccaccccgatggtgtgcgggttgctagtggccagactgccggagtggacaaagatgggaagcctttacagccggtggtacacatttgggatagtgagacacttctgaagttgcaggagatcggcctcggggcttttgagcgaggagtgggcgcattggcgttctctgctgcagaccagggagctttcctgtgtgtggttgatgacagtaacgaacatatgctgtccgtgtgggattgctccagaggcatgaaactggccgagataaagagcaccaatgatagcgtactagctgttgggtttaaccctcgcgactctagctgtattgtgacctcaggtaaatctcacgtacatttttggaactggagtgggggagttggcgtgcccggaaatggtacattgactaggaaacagggagtgtttggcaagtataagaagccgaagttcattccatgcttcgtgttcctccccgacggcgacatcttaactggcgatagtgagggcaacatcttgacatggggacgtagtcccagtgattccaagacaccagggaggggcggagctaaggaaacttacgggatcgtcgcacaagctcacgcgcatgagggtagcatctttgcgctctgcctgcgcagggacgggacagtattgtccggtgggggaagggaccgaagactggtgcaatggggccctggcctggtggccttacaggaggctgaaatcccagaacattttggggctgtgcgagcgattgctgaaggcctcggctccgaactactagtggggaccaccaagaacgccctgctgaggggggatttggctcagggtttttcccccgtgattcagggtcacactgatgagctctggggcctgtgcacacaccctagtcagaacaggtttctgacatgcggccatgaccgacagctctgtctttgggacggagaaagccatgcgcttgcctggtcgattgacctgaaggagacaggtctgtgtgcagattttcatcccagcggtgccgtcgtggcagtggggctcaacaccggcaggtggctcgtgctggacacggaaacgagggaaatcgtgtctgacgtgattgacggtaatgagcagctgtcagtggtgaggtattccccggatggcttgtacttagctattggcagccacgacaacgtaatatatatctacagcgtaagcagcgatggagcaaaatcctcacgattcgggaggtgtatgggtcactcctccttcataacgcatctggactggtctaaggacgggaattttattatgtccaattctggggattacgagattctgtattgggacgtggccggtggctgcaaacagctgaagaatcgttacgagtcccgagacagggagtgggcgacatacacatgcgtactgggctttcacgtctatgtacctgttcgctcctgtcagggcgctgagcctcacgtgagaggacccaggcaaccccgtgatcagcggccaattcatgcgcgaaggctggctccacggttggcaggtagacagggccgacaacacctcccagtggcatccgccggacgttgggggaggggagcgggtgctaggcacgctctcagtaaccccttgcctgtgccccgactcctgcctaggagactgatagcagcctggcgggaccgattggcacggagaagaggcccagcccctccatgtccttccctggcacagagccctaccactcgcggaagattgttccccggactgaccagcaggcacagccgaagccggattttcctcgagggggcaaacggggcaccagctcacactgtctag

SEQ ID NO: 31188 - DNA, 321 bp, Artificial Sequence
  Description of Artificial Sequence: Synthetic coding sequence
atggtggccatggcggaggccgaggctggcgtggccgtcgaggttcgtggcctccccccagctgtccccgacgagctactgacactatactttgagaaccggcgtagatcaggtggtggccctgttctgagttggcagaggctgggctgtggaggcgttctgacttttagggagcccgcagatgccgagcgggtgttggcacaggccgatcacgagctgcatggcgcacagctgagtctccggcctgcccctccccgagcacctgcaagacttctgcttcaaggactgccgcctggcacaactccccagcgcctagaatag

SEQ ID NO: 31189 - DNA, 228 bp, Artificial Sequence
  Description of Artificial Sequence: Synthetic coding sequence
atgttctggaagttcgatctgcattcttcatcccacatcgacactcttctagagagagaggatgtcacattgaaggagctcatggatgaagaggatgttctccaagagtgcaaggctcaaaaccggaagctaatcgaattcctgttgaaggcagaatgccttgaagatctggtcagctttatcatcgaggagcctccccaggacatggatgagaagatccgttattag

SEQ ID NO: 31190 - DNA, 1275 bp, Artificial Sequence
  Description of Artificial Sequence: Synthetic coding sequence
atggatcagcctagtggcagatccttcatgcaggtgctctgtgagaagtactcgcctgagaacttcccttacagacggggtcccggaatgggtgttcatgttcccgcaacgccccagggttcacctatgaaggacaggctgaatctcccatccgtcctcgttcttaattcttgcggaattacatgcgcgggagacgagaaggaaatagcagccttttgtgcccatgttagtgaactagatctctccgacaacaagctggaggactggcacgaggtgtcaaagatcgtttctaacgtgccacagctggagtttcttaacctaagttcgaacccattgaaccttagcgttttggaacgaacatgcgcgggttcgttctccggagtacgcaagttggtgctgaacaactccaaggcttcttgggagaccgtccatatgatcctacaggaactgccggatttggaggagctgtttctgtgcttgaatgattacgaaactgttagttgccctagcatttgttgccactccctgaaactgcttcatattaccgataacaacctccaggactggacggaaatcagaaagctgggcgttatgttcccttctcttgacacgctcgtcctcgctaataatcatctgaacgcaatagaggagcccgacgacagccttgccagattgttcccaaatctgcgatccatcagtttacacaaatccggattacagagttgggaggatatcgataagctgaatagttttcctaagctcgaggaggtccgccttctggggatcccgctcttgcagccctacactacggaggagcggagaaaactggttattgctagactcccttctgttagcaaactgaacgggagcgtggtgacagacggcgagcgcgaagattccgagaggttcttcatcagatactacgtggacgtgcctcaagaggaagttcctttccgttaccacgagctcattactaagtatggaaagctggagcctctcgcagaggtggatctcagaccccaatcttcagccaaggtggaagtccattttaatgaccaggtggaggaaatgtcaatccgcttggaccaaactgtggccgaactgaagaagcagctgaaaaccctcgttcagcttcccacatccaacatgttgctgtattacttcgatcacgaggcccctttcgggcctgaagaaatgaaatactctagtcgagccctgcactcatttggcatacgagatggggacaagatctacgtggagtcgaaaaccaaatag

SEQ ID NO: 31191 - DNA, 288 bp, Artificial Sequence
  Description of Artificial Sequence: Synthetic coding sequence
atggaggcggcagacgcatcacgatccaacgggagctctccagaagccagggatgcgcgttctcctagtgggccatcaggatcgctggagaacggaaccaaagctgacggaaaagatgccaagacaaccaacggacacgggggtgaggctgcagagggcaagtctttaggtagcgccctgaaaccaggggaaggaagatctgccttgttcgcaggtaatgaatggcgacggccaattatccaatttgtggagagtggggatgataagaatagcaattattttagctag

SEQ ID NO: 31192 - DNA, 3144 bp, Artificial Sequence
  Description of Artificial Sequence: Synthetic coding sequence
atggccccacgcctgcagctggagaaggccgcatggcgatgggcagaaacagttcgccctgaagaggtgagccaggagcacatcgagactgcctacaggatctggctggagccctgtatccggggtgtgtgccggaggaactgtaagggaaacccgaactgcctcgtgggaatcggcgaacatatctggctcggcgagattgatgagaattctttccacaacattgatgatccaaactgcgagcggagaaagaagaattctttcgtcgggttgacaaacctgggtgccacctgttacgtcaatacattcctccaggtgtggtttcttaatttggaactgcgccaggccctctacctctgtccgagcacctgttctgactacatgctaggggatggcattcaggaggagaaagactacgagccacagaccatttgtgagcatctgcaatacctgtttgccctgctgcagaacagcaacagaagatatattgacccgtcggggtttgtcaaagctctcggattggatactggacagcagcaggatgcacaggagttcagcaagctgttcatgagtctgctcgaggacaccttgagcaagcaaaagaatcccgacgtgcgcaacatagttcagcaacagttttgtggcgagtacgcctacgtgacagtttgcaatcagtgcgggcgagagtcaaaactgctgtctaaattctatgaactagaattgaatatacaagggcacaaacagctgaccgattgcatttcagaatttctcaaggaagagaagctggagggtgataatagatacttctgcgagaattgccagtcaaaacaaaatgctacacggaagatccgcctcctgagcttgccatgcaccttgaatctgcagctaatgcgtttcgtcttcgatagacagacgggccacaagaagaaattgaatacctatataggatttagcgaaattctggatatggaaccctacgtcgagcacaaaggagggtcttacgtctatgagctctccgctgttctgattcacaggggggtctccgcatacagcgggcattacatcgcacatgtgaaagatccgcagtccggggagtggtacaagttcaacgacgaggatatcgaaaagatggaaggaaaaaagctgcaacttggaatcgaagaggacctagaaccttcgaagagtcagacacgtaagcccaaatgcggcaaaggcactcactgctcaagaaatgcatatatgctggtataccgactgcaaacccaagaaaaacccaataccacagtccaagttcccgcattccttcaggagctggtagatcgggataactcaaaattcgaggagtggtgcattgaaatggccgaaatgcggaagcaatctgtagataagggtaaggccaaacacgaggaggtcaaagagctgtatcaacgacttccggctggggcagagccctacgagtttgtcagccttgagtggctccagaaatggctcgatgagagcaccccaaccaagcccatcgataaccacgcttgtctctgttcccacgataagctgcacccagacaaaatatccatcatgaaacgcatctctgaatacgccgctgacatattttactcccgatacgggggaggccctagacttactgtgaaagccctgtgcaaagagtgcgtcgttgaacgctgtagaatcctgcgcctcaagaatcagctcaatgaggactataagaccgttaataatctgctgaaagccgcagtgaagggttcggatggcttttgggtcggtaaatcaagtctgaggagctggaggcaactggctctagaacagctagatgagcaagacggagatgcggaacaatccaatgggaaaatgaatggttctactctcaacaaagatgagtctaaggaggagcggaaggaagaggaagagcttaactttaacgaggacattctgtgcccacatgcagtcttcttttttagtaagtacatttttctaaactccggagagttgtgcatcagcgagaacgaaagacgcctagtgtccaaggaggcatggtctaaactacagcagtacttccccaaagcacctgagtttccctcttacaaggagtgctgtagccagtgtaagatactggaacgtgagggtgaggagaatgaggctctccataaaatgatcgccaatgagcagaagacttctctgcctaatctgttccaggataagaacaggccgtgtctttctaattggcctgaggatacagatgtgctgtacattgtgtcccagttcttcgtggaggaatggcggaaattcgtgcgaaagcccacccggtgtagccccgtttcttccgtgggcaactcagcactgctctgcccccacgggggactcatgtttactttcgcatccatgacaaaagaagacagtaagctcatcgccttaatttggccaagcgagtggcaaatgatccaaaagctgtttgtggtcgatcacgttatcaagatcacaagaatcgaggtgggggacgttaatccgagcgagacgcagtacatttccgagcctaaactgtgccctgaatgccgggaaggcttgctctgccaacagcaaagggacctgcgggaatatacacaggctaccatttacgtgcataaagtggttgacaacaagaaagttatgaaggacagtgcccctgaactgaatgtgagctcatctgaaaccgaggaagacaaagaggaggccaaacctgatggggagaaagatcctgactttaatcagtctaacggcggaacaaaaaggcagaaaatctcccaccaaaactatatcgcctaccagaagcaggtcattcgccgaagcatgcgtcaccgtaaggtcaggggcgaaaaagctctgttggtaagtgccaaccagactttaaaggagctcaagattcaaattatgcatgctttttccgtggccccatttgaccagaatctgtctatcgatgggaaaattctgtcagatgactgcgctactctcggcactcttggggtcatccccgaatctgtgatattattgaaggccgacgaacctattgctgactatgcggctatggatgacgtaatgcaggtgtgtatgcctgaggagggcttcaaggggacaggcttgctgggacactag

SEQ ID NO: 31193 - DNA, 1443 bp, Artificial Sequence
  Description of Artificial Sequence: Synthetic coding sequence
atggaaacggacttaaactcacaagacagaaaagatctggacaagtttatcaagttttttgcactgaagactgtgcaggttattgtccaggcccgacttggagaaaaaatctgcacacggagttcaagttccccaacagggagtgactggtttaacctggccatcaaagacattcccgaagtgacccatgaggctaaaaaagccctggctggacagctgccggcagtaggccgatccatgtgtgtggagatatcccttaaaacatccgagggtgactcaatggagctggagatctggtgcctggaaatgaatgagaaatgtgataaggaaatcaaggtgtcatatacagtgtacaatagactttctctgctgctaaagtcccttttagccatcacccgcgttacccctgcctataggctatcccggaaacaagggcatgaatatgtgattctgtaccgcatttacttcggagaggtccagctgtctggccttggtgaggggtttcaaacagttagagttggaacagtcgggactcccgtgggcacaatcactctcagttgtgcttacagaatcaacttagctttcatgtctactaggcaatttgagcggactccaccaatcatgggaattataatcgaccatttcgtggatagaccctatccttcctccagcccaatgcacccttgtaattacaggacagctggcgaagacactggagtaatataccccagtgtcgaagatagccaggaggtctgcacaacatctttcagtacgagtccgccttcgcagctgatggtgccaggtaaagaagggggagtgcctctggccccaaatcagcctgtccacggtacccaggcggatcaggagagactagccacctgcaccccttccgaccgcacacattgcgctgcaacaccaagctctagcgaagataccgagacagtgtctaactcttctgaaggaagggcaagtccacatgatgtgctggaaaccatcttcgtgagaaaggtgggggcttttgtgaataaaccgataaatcaagtcacactcacaagcctcgatatcccgtttgccatgttcgctccaaaaaacctcgagctggaggatacggaccctatggtgaacccacccgattctcccgaaactgagtctccgctgcagggtagtctacacagtgacggctcctcaggtggctccagtgggaacactcatgacgactttgtcatgattgattttaagcctgcgttcagcaaggatgacatcctccccatggacttagggactttttatcgagaattccaaaacccccctcaacttagcagtttgtcaatcgatatcggggcacagtcaatggcagaggatttggattccctacctgagaagctggccgtacacgagaagaatgtacgcgagttcgacgcattcgtggagacactacagtag

SEQ ID NO: 31194 - DNA, 2376 bp, Artificial Sequence
  Description of Artificial Sequence: Synthetic coding sequence
atgttttggaaattcgatctgcactcgtcgtcacacatcgatactctgctggagagggaggacgtgacattgaaagaattgatggacgaggaagatgtgctccaagagtgcaaagctcagaacagaaaattaattgagtttctgctgaaagccgagtgtttggaggacttggttagcttcatcatcgaggagcctcctcaagacatggacgagaaaatcaggtataagtacccaaacatctcttgcgagctgttaacgagcgatgtttcacaaatgaacgatcgcctcggcgaggacgagagtcttctgatgaagctgtactcattcctgcttaacgatagtcctctaaaccctctactggcaagcttcttctccaaagttctgagtatactgatttctagaaagccagaacagattgtcgacttcttgaagaagaaacatgacttcgtggacttaatcatcaaacatattgggacgtcggcaattatggacctcctcctgaggcttctcacctgtattgaaccaccacagccgaggcaggatgtgttgaactggttgaatgaagagaagataatccagaggttggtcgagatcgtgcatccttctcaggaggaggacaggcactctaacgcatcccagtctctgtgtgaaatcgttagactgagtagggaccagatgcttcagattcagaatagtacagaaccagatccgctactggccacgttggagaagcaggaaatcatcgagcaactgctgtcaaatatcttccacaaggagaaaaatgaatccgcaattgtcagcgctatccagatactgttgacattgcttgagactcggaggcccaccttcgaagggcacattgaaatctgcccacctggcatgtctcactccgcctgcagcgtgaacaagtcagtccttgaggctattagggggcgactgggcagtttccacgagctgctgctggagcccccaaagaatatgttcttcaaatatacatggaacaatttcctgcacacccaggtggagatctgcatcgccttaatactggctagccctttcgaaaacaccgaaaacgcaaccatcaccgatcaggactcgaccggggacaacctgttgctcaaacatttgttccaaaagtgccagcttatcgagagaattctggaagcgtgggagatgaacgagaagaagcaggccgagggtggaagaaggcacggatacatgggccacctgacacgcatcgcgaactgtatcgtccacagtaccgataaaggcccaaatagcgcgctcgtccagcaactgataaaggatctccctgatgaagtcagggagcgttgggagaccttctgcacgtcatcactgggtgaaacaaacaagaggaatacagtggacctcgccttcagcgactaccagatgcagcagatgaccagcaactttatcgaccagttcggcttcaacgacgagaagttcgccgaccaggacgatataggcaatgtcagctttgaccgcgtgagcgatatcaactttaccctgaacaccaacgagagcggcaatatagctctgttcgaagcctgttgtaaggagcggatccagcagttcgatgacggaggctctgacgaagaggacatatgggaggaaaagcatatcgccttcacacccgaaagccagcgcaggtcctctagtgggagtactgactccgaagagagcacagactcagaagaagaagacggtgccaaacaggatttattcgaaccatctagcgctaacaccgaagataaaatggaagtggatttatctgaaccaccgaactggagcgccaatttcgatgtgcccatggagactacacacggagctcccctggattccgttggatccgacgtttggagtaccgaggaaccgatgccaacaaaagaaactgggtgggcctccttctcagaatttacgagttcactttccacgaaagacagcttaagaagtaactccccagtggaaatggagaccagcacagagccaatggaccctctcacaccctctgcagccgctctagctgtgcaacccgaggcagcgggaagcgtagctatggaagcttcctccgacggtgaagaggacgcagagtccacagataaagtgaccgagaccgtaatgaacgggggaatgaaggagactctgagtctcaccgtcgatgccaagaccgaaacagctgtgttcaaaagcgaggagggtaaactgtccacgagccaggacgcagcctgcaaagatgctgaggagtgtccagaaaccgccgaagcaaaatgtgcggcacccagacccccatcgtcttctcccgagcaaagcggagtggaaattcccgctctgcctgggcaatggagccagcagtag

SEQ ID NO: 31195 - DNA, 1500 bp, Artificial Sequence
  Description of Artificial Sequence: Synthetic coding sequence
atgtttggcgatgcctcgacgagccttgtcgttcctgagaaggtaaagacacccatgaaaagctctaagacagacctacagggttcagctagccctagtaaggttgaaggagtccacacacccagacagaaaagatctactcctctgaaagaacgccagctttcaaaacccctttccgaacggaccaactcatccgactcagaacggagccccgacttaggacacagtacacagatccccaggaaagtcgtgtatgatcagctgaaccagatcctggttagcgatgcggcactccccgaaaacgttatcttagtgaatacaacagactggcaaggccagtacgttgccgaactgctgcaggatcagaggaaacctgttgtgtgtacctgcagtacggtggaggtgcaggcggtgctcagtgccctgcttacaagaatccagagatactgcaactgtaatagctccatgcccagaccagttaaagttgcagcggtcggcggtcagtcttacttatccagcattctcaggtttttcgtgaaatcgctcgccaacaagacctcggattggctaggctacatgagatttctcataatacctctcggttctcatcccgtggccaagtatcttggtagcgtggatagcaaatattcttcatccttcctggactccggctggcgggaccttttcagtagaagcgaacctccggtgtccgagcagttggacgtggccggacgtgtgatgcagtacgtgaatggggcagccacgactcatcagctgccagtggctgaagctatgctgacatgtcgccacaagtttcccgacgaagatagctatcaaaagttcattccattcataggtgttgtcaaggtaggtctggtcgaggattcaccttctacagcaggggatggcgacgattcacccgttgtgtcgctgacagtccctagcacgtcccctccatccagcagtggtctgagtagggacgccactgcaaccccaccgtcatctccgtcaatgagttctgcactcgccatagtgggttctccaaactcaccctatggcgacgtgattggcctccaggtcgactactggctggggcaccccggtgaacgacggagagaaggcgataagcgggacgccagttctaagaataccttaaagtccgtgtttaggtctgtccaggtatcgaggttgcctcacagtggggaggcacaactttcggggaccatggcaatgacagtcgttactaaggaaaaaaataaaaaagtacctactattttcctgtcgaagaagcccagggagaaagaggtggactctaaatctcaagtcattgagggaatttccaggttaatttgcagtgccaagcagcagcaaaccatgctaagagtctcgattgacggtgtagaatggagtgacatcaaattctttcagctggcagcccaatggcctacgcatgtgaagcacttcccagtgggcctgttcagcggatctaaggcaacatag

SEQ ID NO: 31196 - DNA, 435 bp, Artificial Sequence
  Description of Artificial Sequence: Synthetic coding sequence
atggtggcaatggccgaggcagaagctggcgtggccgtagaggtgaggggtctacccccagctgtccccgatgaactgcttacgctgtatttcgagaataggcgcagatccggcggaggccctgtattatcctggcaaaggctgggttgcggcggagtgctcacctttcgtgagccagcagacgctgaacgtgtcctggcccaggcagatcacgaacttcatggcgctcaattgagtctcaggccagccccacccagagcccctgccaggctcttgctgcagggactgccgcctggtacaactccacaaaggctcgagcagcatgtccaagccctgctgagagcatctggcttgcctgtacaaccttgttgcgccttggcctccccgagacccgatcgggcactggtgcagctgcctaaacccctgagtgagtag

SEQ ID NO: 31197 - DNA, 513 bp, Artificial Sequence
  Description of Artificial Sequence: Synthetic coding sequence
atggcctctgaggccgagaaaactttccatcggttcgctgccttcggggaatccagcagttctgggacagagatgaataacaaaaacttctccaagttgtgcaaggattgcggaattatggacgggaaaacagtgacatcaactgacgttgacatagtgttttccaaggtaaaggcaaaaaatgcccgtactattactttccagcaatttaaggaggccgtaaaagaactaggccagaaacgatttaagggaaagtctccggatgaagtgctggaaaatatctatgggcttatggagggtaaggacccagccaccaccggggctacgaaagccaccactgtcggcgcagtggataggctgacagacacttctaagtacaccgggactcataaagagcggttcgacgagtctgggaagggaaagggaatcgccggacgggaggaaatgactgacaacactggctacgtcagtggctataaaggttcaggcacgtatgacaagaaaacgaagtag

SEQ ID NO: 31198 - DNA, 270 bp, Artificial Sequence
  Description of Artificial Sequence: Synthetic coding sequence
atggtagccatggcagaggcagaagcgggagttgcggtggaggtcaggggattaccaccagcagtgccagacgaactccttactctctattttgagaaccggaggcgatccggtggaggacccgtgctaagctggcagaggctgggttgtggaggggtcctgacctttcgggagcctgccgatgctgagcgcgtactcgcacaggcagaccatgagctccacggggctcaactttctctgcgtcccgctcctcctcgggcacccgcatag

SEQ ID NO: 31199 - DNA, 1206 bp, Artificial Sequence
  Description of Artificial Sequence: Synthetic coding sequence
atgtgtgtggagatcagtctgaaaacctccgaaggagactccatggaactagagatctggtgccttgagatgaatgagaagtgcgataaggaaatcaaggtgtcgtatacagtatataacaggctgtcactgcttctgaagagcttactcgccatcactcgggtaacgcctgcctacagattatcccgcaaacaaggtcacgagtacgttatcctttaccggatctattttggcgaggtccagctttcgggactaggagaaggtttccaaacggttcgtgtcgggaccgtcggcacacctgtggggaccatcacactttcttgtgcatatagaattaatctggcatttatgtccacccggcagtttgaaaggacccctcccattatggggatcataattgatcactttgttgatagaccataccctagcagcagccccatgcacccttgcaattatcgtacagccggtgaggacaccggtgtaatatatcctagtgtcgaggacagccaggaggtctgcaccacaagcttcagcacctccccaccaagccagcttatggtccctgggaaagagggtggggtgcctcttgcgcctaaccagcctgtccatggaacacaggctgatcaggagcgcttagctacgtgtacaccgtcagatcgaacacattgtgccgctactccaagcagcagcgaggatactgagacagtctcaaactcgtcggagggtcgggcttcaccgcatgacgtgttggaaacaatattcgttaggaaggtcggcgcatttgtgaacaagcctatcaaccaagtgacgctcacgtccctcgacattcccttcgccatgtttgcacctaaaaatctcgagctcgaagacacggatcctatggtaaaccccccagactctccggaaactgagtcaccactccagggttcgctgcacagcgatggtagctctggtggctcttctggcaatacccacgacgattttgtcatgatagactttaagcccgcattctctaaagatgacatcctccctatggatctgggtacattctacagggaatttcagaatcccccacaactgagtagcctgagtattgatatcggagcacagtccatggccgaggacctggactctctgccagagaagctggccgtccatgaaaagaatgtgagggagttcgacgcattcgtggaaacactgcaatag

SEQ ID NO: 31200 - DNA, 2148 bp, Artificial Sequence
  Description of Artificial Sequence: Synthetic coding sequence
atgtcccaatctggggcagtttcatgttgccctggtgccacaaacgggtccctcggacgctctgacggtgtagctaaaatgagtcccaaggatttatttgagcagcggaaaaagtattccaatagcaatgtgataatgcatgagacgagccagtatcacgtgcagcatctggctactttcatcatggataaatctgaggcaataacaagcgtcgatgacgccatcagaaagctggtccagctctcttcaaaggagaagatttggactcaagagatgctattacaggtgaacgatcagtcactgagactcttagacattgaatcgcaggaggaattagaggattttcctttacccactgtccagcgctcacagacggtgttaaatcagttgcgatatccaagcgtcttgttgctggtatgtcaggactcagagcagagcaagcctgacgtgcacttctttcactgcgatgaggtagaagcagagctggtacatgaagatattgagagtgcacttgccgattgcaggcttggaaagaagatgaggccccagacgctgaaggggcaccaggaaaagatcaggcagcgtcagagcatccttccaccaccccaggggcctgcacccatcccctttcagcacaggggcggagactctcctgaagcaaagaatcgcgtcggccctcaagttccactaagtgagccaggctttcgccgacgagagtcacaagaagaacccagagcggtgttggcacagaagatcgaaaaggagacccagattctgaactgcgctctcgatgatatagaatggtttgtggccagactacaaaaggccgctgaagccttcaaacagctgaaccaacgcaaaaaaggcaaaaaaaaaggcaagaaagctcctgccgaaggtgtgctgaccctgcgagctaggcctccatctgagggagagtttattgactgttttcagaagattaaactggcaattaacctgctggcgaaactgcagaagcacattcagaacccgagcgctgcggaactggtccacttccttttcggaccactggacctcatcgttaacacctgctctggaccagacattgcccgaagcgtttcctgccctctcctgagcagggatgccgtggattttttgcgaggacaccttgtacccaaagagatgtctttgtgggaaagccttggagagagttggatgcggccacgcagtgagtggccacgagagccccaggtgcctctctacgttccaaagttccactcaggttgggaacctccagtcgacgtattgcaggaggcgccatgggaagtggagggcttggccagtgccccaatcgaggaagttagccctgttagtcgccagtccattcggaattctcagaaacattctcccaccagtgagcccacccctcccggtgacgccctgccgcctgtttccagcccacatactcaccggggataccagccaactccggctatggcgaaatatgtcaagattctctatgattttaccgcccgaaacgctaacgaattgtcagtcctgaaggatgaagtgctggaagttctggaggatggtaggcagtggtggaagctccggtccaggagtgggcaggccggatatgtgccatgtaatatccttggagaagccaggcctgaggatgcaggcgctccattcgaacaggccggacagaaatactgggggcctgcctcgccaacgcacaagctgcccccatcattcccagggaataaagatgagcttatgcaacacatggacgaagtcaacgatgagctcatcaggaagatctctaacatccgagctcaacctcagaggcacttccgcgtggagcgatcccagcctgtgagtcagcctctaacctatgagtccggcccagatgaggtcagagcatggctagaggctaaggctttctctccgagaatcgtcgaaaatctcgggatcctgacgggaccccaactgttttctttgaacaaggaggagctcaaaaaagtttgcggtgaagagggggtcagagtgtattcacagctgactatgcaaaaagctttcctggagaagcagcagtccgggagtgagctcgaggaactcatgaacaaattccactccatgaatcagcggaggggggaagatagctag

SEQ ID NO: 31201 - DNA, 336 bp, Artificial Sequence
  Description of Artificial Sequence: Synthetic coding sequence
atgaccggttctaattcacatatcacaatactgacccttaaagtgttacctcattttgagtcactggggaagcaggaaaaaatccctaataaaatgagcgccttccgaaaccactgtccccaccttgattccgtgggggagatcaccaaagaagatcttattcaaaagtccctgggaacctgccaggactgtaaggttcagggccctaacttgtgggcctgcctggagaaccggtgcagttatgtgggttgcggggagtcgcaggtggatcacagcactatacactctcaggagacaaaacactacctgactgttaacctcacaacactgaggtag

SEQ ID NO: 31202 - DNA, 228 bp, Artificial Sequence
  Description of Artificial Sequence: Synthetic coding sequence
atggcaggccaggaggaccccgtccagagggaaatacatcaggattgggccaacagagaatacattgaaatcattacctcctccataaagaaaatagcagatttcttgaatagctttgatatgtcttgcagatctagattggcaaccttgaatgagaagctgactgcgctcgagagaaggatcgagtacatcgaagcccgagtaacaaaaggggaaactcttacctag

SEQ ID NO: 31203 - DNA, 348 bp, Artificial Sequence
  Description of Artificial Sequence: Synthetic coding sequence
atgcgttatgtagcctcatacctcttggctgcccttggcggaaactcctctccgagtgctaaagatataaagaagattctggacagcgtggggattgaagccgacgatgatagactgaacaaagtgatctcagagctgaatggaaagaatatcgaggatgtgatcgcgcaaggtatcggcaagctcgcctctgtacctgccggaggagccgtggctgtgtctgcagctccaggatctgcagcccctgccgcaggcagcgcacccgcagccgctgaagagaaaaaagacgaaaagaaggaggaatcagaagagtccgacgatgatatggggttcgggctgttcgattag

SEQ ID NO: 31204 - DNA, 1077 bp, Artificial Sequence
  Description of Artificial Sequence: Synthetic coding sequence
atgccaggctgcgaattaccggttggaacttgtccggatatgtgtccagctgccgaaagagctcagcgggagcgggagcataggttacaccgcctcgaagtagttcccggatgtcgtcaagaccctcctcgtgctgatccccaacgggctgtgaaggaatattcaagaccagcagccggtaagccaaggccaccaccgtcccagcttaggcctcccagcgtgctcctagcaactgtgaggtaccttgctggggaggtcgctgagagcgctgacatagccagggcagaagtagcttcattcgtggcggatcgtctcagggcagtgctgctggatctcgctttacagggtgccggagatgcagaggcagctgttgtgctggaggcagcactggcgaccctcttgactgtggtagcgcgtttgggcccagatgccgcacgcggaccagccgaccctgtgcttctgcaggctcaggtgcaggaaggtttcggttccctgaggaggtgctacgcccgtggtgccggaccccatccacggcaacccgcttttcagggactgttcctgttatacaacttaggatctgtcgaagccctgcacgaggtgctgcagctgccagcagccctgagggcatgcccaccactgcgcaaagctcttgcagtggacgccgcatttcgagaaggaaacgcagcacgtctctttagacttctccagaccttgccttatctaccatcctgtgcagtgcagtgtcacgtgggccacgctagaagggaagcactggcaagattcgcgagggccttttccacgccaaagggtcagaccctgcctctaggcttcatggtgaacctgttggctcttgatgggcttcgggaggccagagacctctgtcaggctcatggactcccactggatggcgaagaacgagtagtgttcctgcgcggaagatatgttgaagagggcctccctcctgcgtctacatgcaaagtgctcgtggagagcaagctgagaggcagaactctggaggaggtagtcatggctgaggaagaggacgaaggcaccgatcggcctggctctccagcctag

SEQ ID NO: 31205 - DNA, 4047 bp, Artificial Sequence
  Description of Artificial Sequence: Synthetic coding sequence
atggccgatactgatctcttcatggagtgcgaagaggaggagctggaaccatggcagaagatcagcgatgtgattgaggattctgtcgttgaggactataattccgtggacaagaccacaaccgcgggaaatcccttggtgcagcagggaggacagccattgatactgacccaaaaccctgcccctggtctgggaacaatggtcacccagccggtgctccgtcccgtgcaggtgatgcaaaacgcaaatcacgttacttcaagcccagttgctagccagccaatttttattactactcaaggatttccagtccggaacgtgagaccagtgcaaaatgcaatgaaccaagttggcattgtgctgaacgtacaacagggccaaactgttcgccctattactctggtgcccgcaccaggaacacagtttgtcaagcccaccgtcggcgtcccacaggtgttcagtcaaatgactccggtgcgcccaggaagcaccatgcctgtgagacccaccactaatacatttactaccgtgatcccggctacccttaccatccgcagcacggtgcctcagagtcagagccagcagactaagtcaactccatccacatcgactacgcctacagccacacagccaacctctttaggccagctggccgtgcagtctccaggacagagtaaccagacgaccaatccaaaactggtaagcattgcgagttttgtaacagtcaaaaggcctggcgtgaccggagaaaattctaacgaggtggcaaagctggtaaatacactgaacacaattcctagtttaggacagtcacccggaccggtggtggtttctaataattctagcgcccatggctcacagagaaccagcggacctgagagcagcatgaaggtgacttcttctattccagtcttcgaccttcaggacggagggaggaagatatgtccgagatgtaacgcacagttccgagtgactgaggctttacggggacatatgtgctactgttgccccgagatggttgaataccagaaaaagggcaaaagtctggattctgaaccctccgttcctagcgccgctaagccgcctagccccgagaagacagcccctgtagctagtacaccgtcatctacaccaattccagcgctgtctcccccaaccaaagttccagaaccaaatgagaacgtgggggatgccgtccagaccaaactgatcatgctggtcgacgacttttactacggacgcgatgggggtaaagtggctcaattgacaaattttccaaaagtggcgaccagcttccggtgcccacactgtacaaaacgtctgaagaacaacattaggttcatgaaccatatgaaacatcacgtcgaactcgatcaacaaaacggggaagtggatggccacaccatctgtcagcattgctaccgccagtttagcacaccgtttcagctccagtgtcatttggagaacgttcattccccttacgagagtactaccaaatgtaaaatctgtgaatgggctttcgagagtgaaccgctgtttctgcagcacatgaaggacacacacaagcctggtgaaatgccctatgtgtgtcaagtttgccagtacagatcctccctttattcagaagtcgacgtgcacttcaggatgatacacgaggacacaagacatctgctgtgcccttactgtctgaaggtgttcaagaatggcaatgctttccagcagcattatatgcggcaccagaagcgaaacgtctatcactgcaataagtgtcgcctccagtttctttttgcaaaggacaaaattgagcacaagttgcagcaccataagacgtttcggaagccgaagcagctggaaggactaaagccgggaaccaaggtgacaattagggcatccagaggacagcctagaactgtgcccgtgtcttctaacgacactccgccttccgcactccaggaggcagcacccctcactagttccatggaccccctccccgtatttctctacccacccgtgcagcggtctattcaaaaaagggctgtccggaaaatgagtgtgatggggagacagacatgtctggaatgttcatttgagattcctgacttccccaaccactttcctacctacgtgcactgcagcctgtgccgctactctacttgttgctcaagggcatacgctaaccatatgatcaataaccacgtcccccgaaaaagtccaaaataccttgccctttttaagaattcagtgtcaggtatcaaacttgcgtgtacgtcgtgtacattcgtcacatccgttggagacgccatggctaaacacctggtctttaatccctctcaccggagttcatccatattaccaaggggcctgacctggatcgctcactcccgacatgggcagaccagagaccgggtacacgatcggaatgtgaaaaacatgtaccctcccccttcttttccaacaaacaaagccgctactgtgaaatcagcaggggcaacacccgcagaaccagaagagttattgactccactggctccagctcttcctagcccagccagcactgctaccccccctccaacacctactcacccccaagccttagctctaccgcctctggccacagagggcgctgagtgtttaaatgttgacgatcaggacgaagggtctcccgtcactcaggaacctgagctcgcctccggcggaggaggttcaggaggagtgggcaagaaggaacaactgagtgtcaagaaactgagagtggttctgttcgccctctgttgtaataccgagcaggcagcagagcatttcagaaacccccaacggagaatccggaggtggttgcgaagatttcaagcctcccaaggcgagaatttggaggggaagtacctgtctttcgaggccgaggaaaagcttgctgaatgggttctcacccagcgcgagcagcagctgcccgtgaacgaagaaaccctattccaaaaagctaccaaaattggacgaagcctggagggcggttttaaaatctcctatgaatgggccgtgagatttatgctaaggcaccatctgacccctcatgcaagacgtgccgtggcccacaccctgccgaaagacgtggccgaaaacgcgggacttttcatcgatttcgtccagagacagatccacaaccaagaccttcccctgtccatgatcgttgcaattgatgagatctccctgttcctcgacactgaagtgttgtccagcgatgacaggaaggagaacgccttgcagactgtgggaacgggggaaccatggtgcgatgtggtcttggccattcttgcggatggaaccgttctgcctaccttagtgttctatcggggacagatggatcaaccggcaaacatgccagactctatactcctggaggcaaaggaatctggctactctgacgacgaaataatggaactgtggtccaccagagtgtggcagaagcacaccgcttgccagcgcagcaagggaatgctggtaatggactgccatagaacccatttgagcgaggaggttctggcgatgttatccgctagctcaaccctcccagccgtagtgcctgccggttgctcctccaagattcaacctctcgacgtgtgtatcaagcgcaccgtgaagaattttttgcataaaaaatggaaagaacaagctagggagatggccgacactgcatgtgattctgatgtgctcctgcagttagtcctcgtctggctgggggaggtgcttggggttatcggagattgtcccgaactggtgcagagatccttccttgtcgcgtcagtcctccccggtcccgacgggaacattaatagccccactagaaacgccgacatgcaagaggagctaattgcctctctcgaggagcagctaaaattatccggagaacactccgagtcatccacaccacggccacgaagctcacctgaagaaactatcgaacctgaatccctccaccaactgtttgagggcgagtccgaaacagagtctttctacggattcgaagaagcagatttggacctaatggaaatatag

SEQ ID NO: 31206 - DNA, 561 bp, Artificial Sequence
  Description of Artificial Sequence: Synthetic coding sequence
atgttttggaaatttgacctccattcatcttcgcacatcgacacactactggagcgggaggatgttacgttaaaggagctgatggacgaagaagatgtgctgcaagagtgcaaggcccaaaaccgcaagttgattgagttcctcctgaaggccgagtgcttggaggatctggtttcttttatcattgaagaaccaccgcaagacatggatgagaagattcgctacaaatatcctaacatttcttgcgagttattgacatctgacgtctcccagatgaacgaccggctaggggaagatgaatctttgctgatgaagctctactcatttcttctgaacgacagcccgctcaatccgctgctggctagcttcttttcaaaggtgctatctattctgatatctcgcaagcccgagcagatcgtggacttcctgaagaaaaagcacgatttcgtagatctcatcataaagcatatcggcacttctgccataatggacctgcttctgagacttctgacatgtatagaaccaccccagccgagacaggatgtgcttaactggctgtag

SEQ ID NO: 31207 - DNA, 288 bp, Artificial Sequence
  Description of Artificial Sequence: Synthetic coding sequence
atgtctcagtctggggcagtgtcatgttgcccgggagccactaacggaagcctgggcaggtctgatggagtggccaagatgtcgccaaaggacctgtttgagcaacggaaaaaatacagcaacagcaatgtaattatgcacgagacaagtcagtaccatgtgcagcatctggccacattcatcatggacaagtctgaggcaattacctctgttgatgacgcaattagaaaactggtgcagctgtcttctaaggagaagatatggactcaagaaatgcttctacagtag

SEQ ID NO: 31208 - DNA, 1740 bp, Artificial Sequence
  Description of Artificial Sequence: Synthetic coding sequence
atggatgattccaaacaagaatctaccacctcaaaggaggaagaaaccaatatcatcagcagcatagtgccctctacccaggacatctaccaacggcagaattcaagcgatgtgcacaaaagcctgctgcccgcagtggacgagacgacttgcggacatacacactttcagcagatgattgacaaatatataaacgaagcgaacctcatcccggaaaagaccgacctccaagagctggaacatatctttccgaacttgcatcatcaactgtttaaacctctggaaccgcaccctgacttcgacctgagttcatcctcctcgggcatctcccccgacaatagagacttttaccagcggtccgatagttcgagtgaatcccactgtgccaccggcttgtccaaaagtacagtctactttacagccctccgacggactagcatgcatagttctcttaatacatctcccaaccagcagcctgacaccaacctggctcacgtaggcgcacattctttcgcaaccgaaaatattattggtggctcggaacagtgtttcgaacagctgcagccagaatactcatctcaggaggagagccagcatgcggacttgcctagcattttctctatcgaggccagagacagctcccagggaatgaagaaccagaactacccctccgaagagcacaccgagattctccagaataagaagaagattgttcactttcagctatccattgggaacctgtctagtgtctattcttcctcagatgaagccaatgtgtttgatcagctgaatgtgcagcacagcactccttgtggaagcaattccagtgagtgctccacaaaacatcagttggaaagcaggaaggagagcatggggttcgaagagttgagtaaacgaggggtggttacaatgctacagtcacaagggctgattgaagacaataagaacgagacctgccgagtgcttgacatcaacccacaggtggaagagactgatagtagattatgcgttcggaccgtggaaatgggaacttccatccaggcgccttactcactcaccactcagaatgagaaatattttgagaatagcgctgaaaccgacatcccgaagattacaaagaagctgtcgcaactgggcgaatctgaactgttcgcatcatcaggctctttctcgctgcagtcttctatccctgtgtgggagaccgagaccggccacggcatcatggaggaacccgagttaactctgattagcacaaccgacacttctattgccgagatggacttcgccaaccttacacttgaagaaaaaagtgaaaatgaagctaagtgcttcttccaggtgtccgaatttctcccactggtcagcgccacagaagcttcggactatccggctgttagcgagctgtcgatcgagaaacctcgcactgctagcactgccgaaactcctagacgtctgacacccgtgcctgggagcctgcaggaggcattcatcaaacggaaaaaatcctttatggagcggtcgcaccaaaggcagaaggaaatcaggaacaagattcacgtttcagaaaactctcagattaagaccgtaaaggaaaaaccgagcatcagcagctctgttagcaggttgaagggtgttaacaaggtcagggccagtttcccggaggatcggaagactacccaggctctgcgacatcagcgagggctccggctgtacaatcagctcgccgaagtcaagcagtag

SEQ ID NO: 31209 - DNA, 435 bp, Artificial Sequence
  Description of Artificial Sequence: Synthetic coding sequence
atggtggccatggcggaggcggaggcgggagttgcggtggaggttagaggccttccccctgcagtacccgatgagctgctgacgctgtatttcgaaaatagacgtcgtagcggcggaggccctgtgttgagttggcagagactggggtgcggaggagttttgaccttcagagaacccgctgatgctgagcgagtcctggcgcaggcggatcacgaactacacggagcccagctttcactccgacccgctcccccacgcgctcctgctagattactcctgcagggcctgccccctgggactaccccccagcgcctggaacaacatgtccaagcactgcttcgagccagcggcttgcctgttcaaccctgctgcgctttagcctctccacggccagaccgtgccctcgtccagctgcctaaacccctctctgaatag

SEQ ID NO: 31210 - DNA, 246 bp, Artificial Sequence
  Description of Artificial Sequence: Synthetic coding sequence
atggtggccatggcggaggccgaggctggggtggcagtcgaggtgcgtgggctccccccagccgtccccgacgaactgctcactctgtatttcgagaaccgtcggcgatctggaggcggtccagtcctcagctggcagcgactgggctgcggaggagtccttacttttagagagccagccgatgctgagcgagtgttagctcaggctgaccatgagctgcacggcgcacagctgtccttacgttag

SEQ ID NO: 31211 - DNA, 1539 bp, Artificial Sequence
  Description of Artificial Sequence: Synthetic coding sequence
atggccgctttcaaactggacttcctgcctgaaatgatggtcgaccactgcagccttaattcgagccccgtgagcaaaaagatgaatggtactcttgatcaccccgaccagccagatctcgatgccatcaagatgttcgtgggccaggtgccccgtacctggtcagaaaaagatctcagagaattatttgagcagtacggggcagtttacgagatcaatgtcttaagagaccgttcccaaaatccacctcagtctaaaggctgttgcttcgtcacattctacacccgcaaggccgctttggaggcacagaacgctcttcacaacatgaaggtgctgcctggtatgcatcaccccatccagatgaagccagctgactcagagaaaaataacgtggaagacaggaaactgttcatcgggatgatttccaaaaaatgcactgaaaatgatatcagggtgatgttctcgagcttcggtcagatcgaggaatgccggatcctgcggggtcccgatggcctgagccggggatgtgctttcgtgacctttaccacacgcgctatggcacagaccgcaattaaggcaatgcaccaggctcagactatggaagggtgctcgtccccaatggtggtcaagttcgctgatacccagaaagataaggagcaaaagcgtatggcacagcagctccagcagcagatgcagcagatctctgccgcatcagtctgggggaatcttgctggcctgaatacattgggaccccagtatctggctctgtatttacagctactccaacagacagcctcttctgggaacctgaatacactgtctagcctccacccgatgggcggtcttaacgccatgcaactgcagaatttagccgctttggccgcagcagctagtgctgcacagaacacaccttcaggaaccaacgcccttactacaagctcctcacctttgtcagtgctgacctcttctggatcttcccctagcagctccagttccaattcggtcaatccgatcgctagtctgggggctctacagactctggcaggtgcaaccgccggactgaatgtcgggtcattggcgggtatggccgctcttaacggcggacttgggtcctccggtctgtccaatgggactgggagtacgatggaggcactgacccaagcgtattccgggattcagcaatacgccgctgcagcactcccgactctctataaccagaatctgctgactcaacagtcaattggggcagctggttcgcagaaggagggtcctgaaggcgcaaacctctttatttaccatctccctcaagagttcggcgaccaggatctgttgcagatgttcatgccttttggcaacgtggtcagcgctaaggtgtttatagataagcagacaaacctatccaagtgctttggcttcgtttcatatgacaaccccgtctcagcacaggccgctatccagagcatgaatggcttccagataggcatgaaaagactaaaagttcagctgaagcgctcaaagaacgacagtaagccttactag

SEQ ID NO: 31212 - DNA, 1131 bp, Artificial Sequence
  Description of Artificial Sequence: Synthetic coding sequence
atgaaagacgtgccgggtttcctgcagcagagtcagaactccggcccagggcaaccagctgtttggcatcgcttggaggaactgtacacaaaaaagctgtggcaccagcttactctccaggtcctggatttcgtccaggacccatgcttcgctcagggagacggcctgattaaactgtacgagaactttatctctgaatttgaacaccgtgtcaaccccctgtcactagtggaaatcatcctgcacgtggttcgccagatgaccgaccccaatgtggcactgactttcctggaaaagactcgagaaaaagtgaaatcaagcgacgaggccgtgattctctgcaagaccgccatcggcgctctaaagttaaacatcggtgatttacaagtcacaaaagagactatcgaggacgtcgaagaaatgctgaataatctgccaggtgtgaccagcgtgcattccagattctacgacctcagcagtaagtactaccagaccatcgggaatcatgccagctactataaggacgccctgcggtttctgggctgcgtagatataaaggacctcccggtctccgagcaacaggaacgggctttcacattaggactggctgggctcctgggcgaaggagtctttaatttcggtgaactgctcatgcacccagtcctggaatcactaaggaacaccgacagacagtggctcatagacacgctatatgctttcaatagtggaaatgtggagcgttttcagacactcaagaccgcttggggtcagcagccggatcttgcagctaatgaagcccagctattacgcaaaatccagttgctgtgtctcatggaaatgacatttacgaggcccgctaaccacaggcagctgactttcgaggagattgccaaatcggccaagatcacggtaaacgaggtcgaattgctggttatgaaggccttgagcgtcggactggttaagggttctattgatgaagtggacaagcgggtgcatatgacctgggtccagccaagggtgcttgatctccaacagattaaaggcatgaaagaccgcctggagttctggtgtaccgacgtgaaatcaatggagatgcttgtcgaacatcaagctcatgacatactgacctag

SEQ ID NO: 31213 - DNA, 489 bp, Artificial Sequence
  Description of Artificial Sequence: Synthetic coding sequence
atgacaagtaaaaagctggtgaatagcgtcgccggatgcgctgacgatgcccttgcaggcctggtggcttgcaatcctaacctgcaactactgcagggtcaccgcgttgcactcagatctgacctcgattcattgaaaggacgcgttgccttgctgagcgggggaggcagtggccatgaaccagcccacgcagggtttatcgggaaaggtatgcttacaggcgtcattgctggcgctgtttttaccagccccgcagtgggcagtatcctggccgctatcagagctgttgcacaggcagggaccgtgggtacattactgatcgtcaaaaattataccggtgaccggctaaattttggcttagcccgagaacaggcgcgagctgagggcattcccgttgagatggtggtgattggtgacgattcggcctttaccgtcttgaaaaaagccggacgccgtggtctatgtggcacggtcctgatccacaaatag

SEQ ID NO: 31214 - DNA, 7853 bp, Artificial Sequence
  Description of Artificial Sequence: Synthetic coding sequence
atgctgaccgatagtggcggtggtggtaccagtttcgaggaggacctggattcagtagctccacgctctgcccctgccggtgcatcagagccacctccccctggcggtgtgggattgggaatccggactgttcgattatttggcgaggctggaccggcatccggggtcggctcctctggtgggggaggctcaggaagcggaaccgggggaggagatgcagccctcgatttcaagctggccgctgcggtcttacggaccggcggaggaggtggtgcaagcggaagcgacgaagacgaggtctccgaggtcgaatcttttatccttgatcaggaagatctcgacaatcctgtgctcaagactacttccgaaatctttctgtcctccacagccgagggagccgacctgagaacagtagatcccgagacccaggcacgtctagaggctctgttagaagcagctggaattggcaagttgtccacggccgatggaaaggcctttgccgatcccgaggtgctgaggcgcctgacgagcagcgtatcctgcgccctcgacgaggcagcagcagcactgactcgcatgaaagctgagaactctcacaatgccggacaggtcgacactcgctcgctcgcagaggcctgtagtgacggtgatgtgaatgccgttcgcaagctgctggatgagggcaggagtgtgaatgagcacactgaggagggagagtctttactttgcctcgcctgctcagcaggctactacgagctagctcaggtgttgctcgccatgcacgcaaatgtggaggacagagggaataagggtgacatcactccgctgatggctgcctcaagcgggggatatctggatatagtgaagctgctcctgctgcacgatgccgatgtcaatagtcagagcgccaccggaaatactgccctcacctatgcatgtgcaggcggattcgttgatattgtcaaggtcctgttaaatgaaggtgccaatatcgaggatcataatgaaaatggacacactccactgatggaagccgctagtgccggacatgtagaagtggctcgtgtgctcttagaccatggcgctggcataaacactcattcgaacgaatttaaggaatcagccctgacattggcctgttacaaagggcatttggatatggtccgtttccttttagaggccggagcagatcaggagcataaaaccgacgagatgcacacggccctgatggaagcctgcatggacgggcacgtcgaggtggccaggcttctccttgactcaggagctcaggtgaacatgcccgctgatagttttgagtcgcctctcactctggcagcatgtggcggtcatgttgaactggctgctctgcttatagagagaggtgctaatcttgaggaagtgaatgacgaaggctatacgccgctgatggaggccgctcgggaagggcatgaggaaatggtcgccctacttctggcccagggcgctaacataaatgcgcagactgaggaaactcaagagaccgccctcactctggcatgctgtggcggattctcggaagtggccgatttcttgattaaggcaggcgcagatattgaactagggtgttccactccactgatggaggccagccaagagggacacctggagttagtcaagtaccttctggcatccggcgcaaatgttcatgccaccaccgccactggcgataccgcgctgacgtacgcctgtgaaaacgggcacactgatgtcgccgatgtgttgctgcaggcaggagccgacctcgaacacgagagtgaaggaggtcgcacccctctcatgaaagcggctcgtgcagggcacctgtgtaccgtgcaatttctaatcagcaagggtgccaatgtaaacagggccacggccaataacgaccataccgtcgtcagcctggcgtgtgccggaggccatctcgcagtcgtcgaacttctgctagcacatggggcagatccaactcacaggctgaaagacgggtctaccatgctgatcgaagccgcaaaagggggtcatacaaatgtggtgagctatcttctggactaccccaacaacgtgttgtccgtcccaaccactgatgtgagccagttgcctccaccttcacaggaccagtctcaggttccaagggtacccacccatactttggcaatggtggtgccaccccaggagcctgaccgtacatcccaggaaaattcaccggcactactgggggtccagaaggggacctcaaagcagaaatcctctagtctgcaggtagcggatcaggatcttctgccttccttccacccttaccagccgcttgagtgtattgtggaggaaactgaaggtaaactgaacgaactaggtcagaggatctccgccatagagaaggcgcagctaaagtctctggaattgattcagggtgaaccattaaataaggataagatcgaggagctcaagaagaatagagaagagcaggtccaaaaaaagaagaaaatcctgaaggagttacagaaagtcgagcgacagttacaaatgaagactcagcagcaatttaccaaggagtatctcgagaccaaaggccagaaggataccgtcagcctgcaccagcagtgttcacatcgcggagtgttcccagagggcgagggagacggatctctgcctgaggaccatttttccgagctgcctcaggtcgacacgatcctgtttaaagacaacgatgtggacgatgagcaacagagtccacccagcgcggagcagatcgattttgtgccggtacagcccctttccagcccacagtgcaacttcagctccgatttaggatccaacggcaccaatagccttgaactgcagaaggtgtcaggcaaccaacagatagtggggcaaccacagatagcgattacaggccacgaccaggggctgctggtccaggaaccagacgggttaatggtagctacaccagcacagactttaacagacactctggatgatttaatagcagcagtgagtacaagggtgcctacaggatcaaactcctctagtcagacgacagaatgccttacacccgaaagctgttcccagacaactagtaatgtggcctcccagagcatgccaccggtttacccaagcgttgacattgacgctcatacggagtcgaatcacgatacagccctgacacttgcctgcgccggagggcacgaagagctagtctcagtgctgattgctagagatgccaagattgaacaccgggataaaaagggcttcacacctctgatattggccgcaacggcgggacacgtgggggttgttgagatcctgttggataaaggcggagatatcgaggcccagagtgagcgcacaaaggataccccattgagcctggcttgcagcggtgggagacaagaggttgttgatctgttgctcgccaggggggcaaacaaagagcaccgaaatgtgagcgattacacccccctgagtctcgctgcttccgggggatatgtgaacatcataaagattttactgaacgccggagccgagattaattctcggacaggcagtaagttagggatatcaccactcatgctggctgccatgaacggccatgtgccagcagtaaagctgctcctggatatgggctctgacataaatgcccaaattgaaacaaacagaaacacagccctcaccttagcctgtttccaggggagggctgaagtggtgagcctgttgttggataggaaagctaatgtggaacatagagcaaaaaccggcctaaccccccttatggaggctgcatccgggggatatgctgaggtgggacgagtccttctcgacaagggtgctgatgttaatgcgccaccggtaccttcatccagggataccgctctcaccattgcagctgacaaaggacattataaattctgcgagctcctgatacacagaggcgcacacatagatgtcaggaacaaaaaaggcaatactcccctctggctagccagcaacgggggtcatttcgatgtggttcagttgctggtgcaggcgggtgctgatgtagatgcggcagataatagaaagatcaccccgctcatgagtgcctttcgcaaggggcacgtgaaggtcgttcagtatctcgtcaaagaggtgaaccagtttcccagcgacatcgaatgtatgcgttatattgctaccattactgataaagagttgctgaagaaatgtcaccagtgtgttgagactattgtcaaagcaaaggaccaacaagccgctgaggccaataagaacgcatccatcttattgaaagaattggatttggagaagtcacgcgaagagtcgcgtaagcaagcccttgccgcaaaaagggaaaagagaaaggagaagaggaaaaaaaagaaggaggaacaaaaaagaaagcaggaggaagatgaggagaataaacctaaagaaaacagcgaactccctgaggacgaggatgaggaggagaacgatgaggatgtggaacaggaagtgcctatcgaaccgccatccgccaccaccacaactacgatcgggatcagtgccactagcgcgaccttcaccaatgtatttgggaagaaaagggccaacgtggtgactacaccttccacaaacagaaagaacaaaaaaaataaaactaaggagacccccccaaccgcccacttaatcctcccagaacagcatatgtcactcgctcagcagaaagccgataagaataaaatcaatggagagcctagaggcggtggtgctggcggaaactcagacagcgataatctggacagcactgattgcaattccgagagttcttctggtggaaaatcccaggagctgaattttgtcatggatgtgaactccagcaaataccctagcctgctcctacatagtcaggaggagaagactagtaccgccaccagtaagacacaaacgcgactcgagggggaggtgactcctaacagtctaagtaccagctacaagaccgtgtctttgcccctaagcagcccaaatatcaagctcaatctgacatctcccaagcggggacagaagcgcgaagaaggttggaaggaggtagtgcgtcgttctaaaaagttgagcgtccccgcttccgtggtgtcacggattatgggcagggggggatgcaacatcacggccattcaggatgtcacaggagcccatatcgacgtggacaaacaaaaagacaagaatggtgagagaatgatcacaattcgtggcggaacggagtccaccaggtacgcagtccaactcataaatgctctgatacaagatccagcgaaggaactcgaagatctgattcctaagaatcacattcggacgcctgctagcactaagtctatccatgccaatttctcctccggagtgggcacaaccgcagcgagctctaaaaacgcttttccattgggcgcacccaccctggtgactagccaggccacaacgctctctacgtttcaacctgccaacaagctgaataaaaacgtgcctaccaatgtcagatcttccttccctgttagtttaccgttggcgtacccacacccccacttcgcactgcttgctgcacaaacaatgcaacaaatccggcacccacgtttgcctatggctcagtttgggggtactttcagcccctcccccaatacatgggggcctttcccagtgaggcccgtgaaccccggaaacacaaactcgagtccaaaacacaacaatactagccgcctgcccaatcagaacgggacagtcttaccctcggaaagtgctggtctggctacagcctcttgcccaattacagtatccagcgtagttgctgcttctcaacagttgtgcgtgacaaacacccgaacgccgagttccgtgcgaaaacagctgttcgcttgcgtgcccaagacctcaccacctgctacagtcatttcctcagtgacatctacctgttcctctctgccgagcgtctcaagcgcacccatcaccagcggacaggcaccaacaacctttttacctgcgagcacatcacaggcacagctctctagccaaaaaatggagtcttttagtgcggttccgcctactaaggaaaaagttagtacccaagatcaacccatggccaacctgtgcactcctagttccactgccaattcgtgttcaagtagcgcatcaaataccccgggtgctcccgaaacacatccaagtagctctcctactccaaccagcagcaacacacaagaggaggctcagccgagtagcgtttctgacttatctcccatgtccatgcctttcgcatcaaacagcgaacccgctcctttaacactgacatccccaagaatggtggccgcagacaaccaagacacatctaacctgccacaactcgctgtgcccgctccacgggtctcccatcgcatgcagccacgaggttcattctacagtatggttccaaatgcaactatacaccaggacccccagtctatattcgtgaccaatccagttacactgacccctcctcagggaccccctgccgctgtccagttatctagtgctgtcaatattatgaatggtagccagatgcatatcaatcctgccaacaaaagtttacccccaacgtttggtccagcaaccctattcaatcacttctcttccctgttcgattcttcacaggttcccgcaaaccagggatggggggatggcccattaagttccagggtggctactgacgcatcattcaccgttcagtcagcctttctcggaaactctgtgctggggcatctggaaaacatgcatccagacaattccaaggccccaggctttcgccctccctcccagcgggtgtccactagcccagttggtcttccctctattgatccttccggaagttcgccgtctagcagcagcgctcccctggcaagcttctctgggataccgggaacacgggtcttcctgcaggggccagcaccagtgggaacaccttcatttaatcggcagcatttctcacctcacccatggacttctgcttctaacagctcaacctccgcacctccgaccctcggccagcccaagggagtttctgcctctcaggatcgaaagattccccctcctattggcaccgaaagactcgcacgcattcggcaggggggttccgtcgcccaagcccctgcgggaacctccttcgtggcccctgtcggacactccgggatctggtctttcggtgtgaacgccgtctcagaggggctgagcggttggtcccagtctgtgatgggcaatcatcccatgcatcagcaattgtcagatcccagtaccttctcccagcatcagcccatggagagagatgactctggaatggtcgctccatcaaacatctttcatcagcctatggcatcgggattcgtggacttcagtaaggggctccctattagtatgtatggcggaacaatcatccccagccatcctcagctggctgacgtccccggaggtcccctgtttaatggccttcataaccccgatccagcttggaatccgatgatcaaggtgattcagaactcaacagaatgtaccgatgcccagcaggccagcctcctgcctagtgttcccgctttaaaaggagagataccatctccacagttgacccggcctaaaaagagaattggcagaccaatggttgcaagtcctaatcaacgacatcaggaccaccttcgtcctaaggtacctgctggggttcaagagctcacccactgcccagatacacccctgctccctccatctgactctagaggtcacaactcatccaatagcccatcattacaggctggaggtgccgaaggggctggagacagaggtcgagatactcgata

SEQ ID NO: 31215 - DNA, 753 bp, Artificial Sequence
  Description of Artificial Sequence: Synthetic coding sequence
atgggggatatcccagcggttggactctcctcatggaaggctagccctggaaaggtcaccgaggcagtgaaagaagcgatagatgctgggtatcgccactttgactgtgcttatttttatcataacgagagggaggtaggggctgggatccggtgcaagatcaaggagggcgctgtgagaagggaagacttgtttatagccacaaaactgtggtgtacctgccacaagaaaagcttggttgagacagcttgtcggaagagcttgaaggccttaaagctgaactacctggatctgtacctcatccattggccaatggggtttaagcctccccacccagagtggataatgtcctgttctgagctgtctttctgtctgtcacaccccagagtacaagacttacccctggacgaatctaatatggtcatcccttctgataccgattttctggacacttgggaagccatggaggatttggtgattacaggactggtgaaaaatatcggggttagcaatttcaatcatgagcaactcgaaagactcttgaacaaaccagggctcagatttaaaccgctcactaaccagattcttattaggttccagatccaaaggaacgtcattgttatacccggaagtatcactccttcgcacataaaggagaacattcaggtcttcgactttgagttgacccaacacgatatggacaacattctgtctttaaataggaatctgagactggctatgtttcctatgtag

SEQ ID NO: 31216 - DNA, 525 bp, Artificial Sequence
  Description of Artificial Sequence: Synthetic coding sequence
atgctgacggagaatggccaggtgctcagctgtggcagtaactcctttgggcaactcggcgtcccccacggccctcggagatgtgttgttcctcaggcaattgaactgcataaagagaaagtcgtttgcattgctgccggattacgtcacgctgtcgccgcaaccgcatcaggaattgtgttccaatggggaactgggctagcctcgtgcggcagaagactctgtcccggacaaaccttgcctctctttttcaccgccaaggagccatcccgtgtgaccggactagagaacagtaaggctatgtgtgtgctggctggaagcgatcattcagccagcttgaccgatgctggggaggtgtacgtgtggggatccaacaagcacgggcagttagccaacgaggctgcattcctaccggtgccccagaagattgaggcacattgctttcagaacgagaaggtgacagcgatatggagtgggtggacgcatctggtggcgcagactggacttctatggctgcgggcatag

SEQ ID NO: 31217 - DNA, 228 bp, Artificial Sequence
  Description of Artificial Sequence: Synthetic coding sequence
atgaaccgtagacggaagttcctcctcgcctcggttctcgccctgcagaactcctctttcatctatcccagttgtcagaagtgcttttcgcgtatcatccttgttagcaaaaggtctaactgcccgaaatgtggaagtacaggagaaagcggcaacgctaactacaggtataagcttagcctgaaggtggcggagtcaaataaactttttgtgatcaccgttttctag

SEQ ID NO: 31218 - DNA, 252 bp, Artificial Sequence
  Description of Artificial Sequence: Synthetic coding sequence
atggttgccatggctgaggcggaggccggtgtggccgtggaggtcaggggactgccgcctgcagtaccagatgagctattgaccttatactttgagaataggcgtcgaagcggtggaggcccagtcttaagctggcagaggctgggatgtggaggagtgcttaccttcagagagccagctgatgccgaaagggtcctagcgcaggctgaccatgagctccatggcgcacagttatctcttcgcccagcttag

SEQ ID NO: 31219 - DNA, 528 bp, Artificial Sequence
  Description of Artificial Sequence: Synthetic coding sequence
atgctgagcgaggaagaaaaggaggaactgaaagccgagcttgtgcaactcgaggatgaaattacaaccctcaggcaggtgctgagtgctaaggagaggcaccttgtggagattaagcagaaactgggcatgaacttgatgaacgagctcaagcagaatttctccaaaagctggcatgatatgcagaccacgactgcatataagaaaacgcacgaaaccctgagtcacgccggacagaaagccaccgctgctttctccaacgtgggaactgcgatctctaaaaagttcggcgacatgagctattccattcgacactccatctcaatgccggcaatgagaaacagtcctacattcaaatctttcgaggaacgggtcgaaactacggtaactagtctcaagaccaaagttggcggaactaatccaaatggagggagttttgaggaagtcctgagtagtacagcccatgcatcagcacagtccttagccggtgggagccgacggacaaaggaggaagaactgcagtgctag

SEQ ID NO: 31220 - DNA, 231 bp, Artificial Sequence
  Description of Artificial Sequence: Synthetic coding sequence
atgaatcgtcggagaaaatttctgctggcttctgtactggccctccagaacagctccttcatctacccatcatgccagaaatgcttcagtcgcattatcctggtgtccaaacgatccaactgccccaaatgcggatccaccggagagagtgggaacgcaaattatagatataagctgagcctaaaagtcgccgagtccaacaagctgtttgtgatcacagtgtttggctag

SEQ ID NO: 31221 - DNA, 456 bp, Artificial Sequence
  Description of Artificial Sequence: Synthetic coding sequence
atgtcaatccccttttccaatacccattataggatcccacaggggtttgggaatttgctggagggtctgacccgtgagatcctccgcgagcagcctgataatatcccagccttcgctgcagcttattttgagtcactactggaaaaaagagagaagactaacttcgaccctgccgagtgggggtcaaaggtggaggaccggttttataacaaccatgcgtttgaggagcaggaaccccctgagaaatcagaccccaaacaggaggagtcacaaatcagcggtaaggaagaagagacatccgttactatcctagactcctccgaggaggacaaggaaaaggaggaagttgcagctgtgaaaatacaagcagcctttagaggacatatcgccagggaggaggctaaaaagatgaaaactaatagcctgcaaaatgaggaaaaggaagagaataagtag

SEQ ID NO: 31222 - DNA, 270 bp, Artificial Sequence
  Description of Artificial Sequence: Synthetic coding sequence
atggaagcagcagacgcctccagaagtaatggttcttctccagaggccagagacgccagatccccaagcggaccttctgggagtctggagaatggaactaaagctgacggaaaagatgcaaagactaccaatggccatgggggtgaagctgccgagggaaaatccttgggctccgctctgaaacccggagaagggaggagtgctcttttcgcgggaaacgaatggcggagacccataatccagttcgttgagtcgggcgacgacaaatag

SEQ ID NO: 31223 - DNA, 1542 bp, Artificial Sequence
  Description of Artificial Sequence: Synthetic coding sequence
atggaggtgggcattaccattcagcacgcttacgaaaagcagcatccatggatagatctgacttccatcggattcagttacgtgatcgacttcaacactatgggccagattaacaggcagacacagaggcagcgtcgggtgcggcgacgcttagacctgatttacccaatggtgaccggcacgctgccaaaagcacagtcctggcctgtgtcaccaggacccgcaacatcccctccgatgagcccctgcagctgcccgcagtgcgtgctcgtgatgtccgtaaaggccgcagtggtgaacgggtctacaggacccttacagctgcctgtcacacgaaaaaacatgccaccaccaggcgtggtgaagttacctcctttgccaggaagtggagccaagccactggattccaccgggacgatcagaggcccactgaaaacggccccaagccaagtcatccgcaggcaggctagctccatgcctaccggaacgacgatggggtcacccgcttcccctccgggacccaattctaaaacagggagagtggcccttgcaactctgaacaggaccaatctgcagagactggcgatcgcgcagtcacgggttctaatagcaagcggggttccaacagtgccagtcaaaaatctgaatggtagttccccggttaaccccgctctggctggaatcaccgggattctgatgtcagcagctggcttgcccgtctgcctgactagacccccaaagcttgtattgcatccgcctccagtgtccaagtctgaaattaaatccatccccggtgttagcaatacaagccgtaagacaacaaaaaagcaagccaaaaaggggaagaccccagaagaagtgttgaagaaatacctccagaaagtgagacacccacctgacgaggactgcaccatttgcatggaaaggctcaccgctccgtccggatacaagggacctcagcccacagttaaaccagatctggtcggtaaactgtctagatgtggacacgtgtaccatatctattgtctggtggctatgtataataacggaaataaggatggatctctccagtgtcctacctgtaagacaatttatggagttaagaccggaacgcagccccctgggaagatggagtaccacctgattccacactcactcccaggccaccctgactgcaagaccattcggatcatttacagtatcccccctgggatccagggacctgagcatcctaaccctggaaagtcatttagcgccagaggattcccccgacactgctacctacccgatagtgaaaaaggtcgcaaggtcttgaagttactgctggtggcctgggaccgcaggctgatcttcgctatcggaactagtagcaccaccggcgagtctgacaccgtgatttggaatgaagtgcatcacaaaaccgaattcggaagtaacctcaccggccatggctaccccgacgctaactatcttgataatgttctggcagagttagccgctcagggcatatctgaggattcgacggctcaggagaaggactag

SEQ ID NO: 31224 - DNA, 414 bp, Artificial Sequence
  Description of Artificial Sequence: Synthetic coding sequence
atgagctccgtgcagtcacaacaggagcaactgtcccagtccgacccttcaccatccccgaactcttgttcgagtttcgaactcatcgatatggatgcgggatccctgtatgaacctgtgagtccacattggttctactgcaagataatcgacagtaaggagacctggattccgtttaattctgaggacagccaacagctcgaggaggcctattcctccggcaaagggtgcaatgggcgtgtggtgccaaccgatgggggtagatacgatgtgcatctgggtgagaggatgcggtacgccgtctactgggatgaactggcaagcgaagtacgcaggtgtacgtggttttataagggagacaaggataataaatatgtcccctactccgagtctttctcccaggtactggagtag

SEQ ID NO: 31225 - DNA, 120 bp, Artificial Sequence
  Description of Artificial Sequence: Synthetic coding sequence
atgttttggaaatttgacttgcactcctcaagccacattgacacactcctagagcgggaggacgtgactctgaaggaactgatggatgaggaggacgtgcttcaagagtgcaaagcttag

SEQ ID NO: 31226 - DNA, 2157 bp, Artificial Sequence
  Description of Artificial Sequence: Synthetic coding sequence
atgcttatgaccttggagatgacagaattgactgaccctcaccatactatgggagattataaagttgcccaccctcaggatccccaccatccttcagaaaaaccagtgattcattgtcataaatgcggggagccctgcaaaggagaagtgctgagggtgcaaactaagcactttcacattaaatgtttcacatgtaaagtatgcggatgcgacttagcacaaggcggattttttatcaagaacggcgagtatctttgtactctcgactaccaaaggatgtatggaacccggtgccatgggtgtggcgaatttgtggagggagaagtggtcacagccctcggtaagacctaccatccgaattgtttcgcttgtacgatctgtaaaagaccatttccaccaggcgacagagtcacgtttaacggccgagattgtctctgtcagctgtgtgcccagccaatgagctcctccccaaaggagacgaccttttcctctaattgcgccggatgcggcagagacattaaaaacggacaggccttgttagccctggataagcagtggcatctaggctgttttaagtgtaaaagctgtgggaaagtgttgaccggtgagtatatatctaaagatggtgctccctattgtgagaaggactaccaaggcctgtttggagtaaaatgtgaggcttgtcaccaattcatcactggcaaggtgctcgaagctggtgataagcattaccatccatcatgcgctaggtgttctagatgtaatcagatgttcactgagggggaagagatgtatctgcagggttcaaccgtgtggcaccctgactgcaagcagagcaccaagaccgaagagaagctgcggcctactcgaaccagctctgagagcatctattccagaccgggaagttctatcccagggagtccaggacacacaatctatgcgaaggttgataacgagattctggactacaaagacttagcagcgatccccaaggtgaaagcaatctacgatattgaacgaccggatctgatcacgtacgaaccattctatacatcggggtatgatgataagcaggaacggcagagtctgggagaatccccacggactctgtcacctactccctctgccgagggctatcaggatgtccgggaccgtatgattcaccgctcgacaagccagggcagcattaacagtccagtttactcaagacattcttacactccaacgacatcccgctccccccagcactttcatcgacccggtaatgagccgtcatccggtcgtaatagtccactcccctatagaccagatagtcgaccactgacccctacctacgctcaagcacctaagcattttcatgtgcctgatcaagggatcaacatctaccgcaaacccccaatctataagcagcatgctgctctggcggctcagagcaaatcatctgaagatatcattaaattcagcaaattccctgccgctcaggcgccagacccctctgagacccccaagatagaaactgaccactggccagggcctcccagctttgccgtggtggggcctgatatgaagcggcgtagcagtgggagagaagaggacgatgaggagctgctccggaggagacagttgcaggaagagcagcttatgaaactgaattctggactgggccagctcatcctgaaggaagaaatggagaaagagtctcgggaacggtcatctcttctcgcctcaagatacgatagtccgattaactcagccagtcacattccttcaagcaagactgcaagccttcccggttacgggaggaacgggctccatcgacccgtgtcaactgatttcgctcagtacaatagttacggggatgtctctggaggggtgcgcgactttcagaccctgcctgacggtcacatgcccgcaatgcgtatggatcgaggcgtaagcatgccaaacatgctcgagcctaaaattttcccttatgagatgctgatggtaacaaaccgaggcaggaacaaaatcctacgcgaggttgaccgcacccggttggagaggcatctcgctcccgaagtcttccgagaaatttttggtatgagtatccaggagttcgaccgtctgccgttatggagaagaaatgatatgaaaaagaaggccaagcttttttag

SEQ ID NO: 31227 - DNA, 2148 bp, Artificial Sequence
  Description of Artificial Sequence: Synthetic coding sequence
atgtctcaatccggtgccgttagctgctgccctggtgcgactaacgggtcactgggccgatctgatggagtggccaagatgtccccgaaggatctcttcgagcagagaaagaagtactccaatagtaacgtgatcatgcacgaaacaagtcagtatcatgtccaacaccttgctaccttcattatggacaagagtgaggccatcacgagtgttgacgacgctattaggaagttagttcagctgtcctccaaagagaagatctggacccaggagatgctgctgcaggtcaatgatcagtccctacgcttgctggatattgagtcacaagaagagctggaagactttccgctgccgaccgtacagcgcagccagactgtgctgaatcagcttcgctatcctagcgtgctgcttttggtctgtcaggatagcgaacagagcaagccagacgtccatttttttcactgcgacgaagtggaggcagagctggtacacgaggacattgaatcagctctggccgattgccgactgggaaaaaaaatgcgacctcaaaccctgaagggccaccaggagaagatacggcagcggcagtccattctgccacctccacaggggcctgctcccatacctttccagcaccgcggtggggattcccccgaggccaaaaacagggtgggaccccaagttccgttgtctgagcctgggttcagacgacgcgagtcacaggaagagccgagggctgtgctggctcagaaaatcgagaaagagacccagatcttaaactgcgcactggatgacattgagtggtttgtggcaaggctccagaaggccgctgaggcgtttaagcagctgaaccagcgtaaaaaagggaagaagaaggggaaaaaggccccagccgaaggagtactcactctccgggctaggcccccaagcgagggagagttcatcgactgctttcagaaaattaaactggcaattaacctgctggcaaaactccagaaacacatccagaatcccagcgccgcagagctggtgcattttctctttgggcctctggatctgattgttaacacatgctcaggccctgacatcgctagatccgtgagctgtcccctgctgtcccgggatgccgttgactttcttagggggcatctcgtgcccaaggagatgtcactctgggagtcccttggagaatcctggatgcgaccccgtagcgaatggcccagggaaccacaggtacccctatacgtaccaaaattccactcaggctgggaaccccctgtcgatgtcctgcaagaggccccatgggaagtcgaaggcctggcctcagctccaattgaagaagtgtctcccgttagcagacaatccatacgtaactcccagaaacatagccctacaagtgagccaacccctcccggtgatgccctaccaccagtatcctccccccacacccaccgcggatatcaaccgacgcctgcaatggccaaatatgtgaagattttatatgacttcaccgcacgaaatgctaatgaattaagtgtccttaaagatgaggtcctggaggtgctggaagacggcagacagtggtggaagttgcggtccagaagcggacaagcaggatatgttccatgcaatatactgggcgaggctcgtccagaggacgctggagctcccttcgaacaggccggtcagaagtactggggtccagcaagcccaacccataaactgccgccttctttccctggcaataaggacgagctcatgcaacatatggatgaggtgaacgacgaactgataagaaaaatcagcaatatccgagcccaacctcagaggcatttccgcgtggaaaggagccagccggtcagtcagccactgacatacgagtcaggacctgatgaagtcagagcttggctagaggccaaggccttcagcccaagaatcgtcgagaacctgggcatcctcaccggccctcagctgttcagccttaacaaggaagaactgaaaaaagtgtgcggcgaagagggggtgagagtatatagccagctgaccatgcaaaaggcattcttggaaaaacagcagtctggaagtgagctcgaagagctaatgaacaagttccactctatgaaccaacgacgaggagaggattcatag

SEQ ID NO: 31228 - DNA, 360 bp, Artificial Sequence
  Description of Artificial Sequence: Synthetic coding sequence
atggagacagatctgaactcccaagatagaaaggacttggacaagttcattaagttttttgcacttaaaacggtgcaggtgattgtgcaggccaggctgggagaaaagatctgcactcggagctcttccagccccacaggctctgactggttcaacctggccattaaggatatccctgaagtgactcatgaggctaagaaagctctggcaggccaactgcccgcagtaggccgaagcatgtgtgtcgagatctctctgaagacatctgaaggtgatagcatggagcttgaaatttggtgtctagagatgaatgaaaagtgtgataaagaaatcaaggtgagttacactgtgtacaactag

SEQ ID NO: 31229 - DNA, 420 bp, Artificial Sequence
  Description of Artificial Sequence: Synthetic coding sequence
atggccgataccgatctgtttatggagtgcgaggaggaagagcttgagccttggcagaaaatctcagacgtcatcgaagactctgtcgtcgaggattacaatagtgtagacaagacaaccactgtgagcgtgagtcagcagccagtgtccgcaccagtccctatagcggcacacgctagcgtagcgggtcacctgtctacatcgactactgtctcgtccagcggagcccagaactctgacagcaccaagaaaaccctagtaacactcatcgccaacaataatgccggaaacccactggtgcagcaagggggtcaaccattaattctgactcaaaatccagcaccaggcttggggacaatggtgacacaacccgtgctaagaccagttcaggtgatgcagaacgccaatcacgtgacatag

SEQ ID NO: 31230 - DNA, 492 bp, Artificial Sequence
  Description of Artificial Sequence: Synthetic coding sequence
atgcacgacaaaggcatcactaccgccgcagtgtgcgtgtatcccgctcgcgtctgcgacgccgtgaaagccttaaaagcagccggatgtaacatcccggtcgcgagtgtagcagccggattccctgctggtcagacacatctcaagacccggctcgaggagattcgattagctgttgaggacggtgcgactgagatcgacgtggttatcaatcggtcgcttgtcctgaccggacagtgggaggccctgtacgacgaaattaggcaattccgaaaggcctgcggtgaggcccatttgaaaacaatcttggctaccggtgaactgggcaccttgaccaatgtatacaaagcgagtatgattgcaatgatggcaggctcggattttattaagacatccacaggcaaggaaacggttaatgcaactttccccgtcgccatagtgatgctccgggctattcgggatttcttctggaagacgggcaacaaagtttag

SEQ ID NO: 31231 - DNA, 456 bp, Artificial Sequence
  Description of Artificial Sequence: Synthetic coding sequence
atggctgataccgacctgtttatggagtgtgaagaagaagagctggagccttggcagaagatctctgacgtgattgaggacagcgttgtggaggattacaattccgtggataaaactactacggtctcagtgtcacagcaaccggtaagcgctccagttccaatcgccgctcacgcctccgtcgcgggacacctatccaccagtactacagtcagctcatcaggagcgcagaacagcgacagcaccaagaaaacactcgtgaccctaatcgcgaataataacgcaggaaaccctctggtgcagcaggggggtcagcctttgatcttgacgcagaatccagctcctggattgggaaccatggtgacgcaacccgtcttgaggccagtgcaggttatgcagaacgcaaatcatgtaacgtccagtcccgtagcgagccagccgattttcatcacctag

SEQ ID NO: 31232 - DNA, 252 bp, Artificial Sequence
  Description of Artificial Sequence: Synthetic coding sequence
atgtctcagtccggggcagtgagttgctgtcccggtgctacgaacggctcactgggcagatccgacggggtggccaaaatgtcccccaaggacctatttgaacagcggaaaaagtactccaactccaatgtgataatgcacgagacttcacagtatcatgtgcagcatttagccacatttatcatggataaaagcgaggcgataacaagcgtcgatgatgccatccgcaagttagtccaactttcctcttag

SEQ ID NO: 31233 - DNA, 366 bp, Artificial Sequence
  Description of Artificial Sequence: Synthetic coding sequence
atggctggccgtcccctgaggatcggggatcagttagttttggaagaggattatgacgaaacctacatcccatctgagcaagaaattctggagtttgcgcgagaaatcggaatagatcccattaaagagccggaactgatgtggctagctagagaggggatcgttgcccctttgccaggggagtggaagccctgccaggatatcactggggacatctactattttaattttgccaacgggcagtccatgtgggatcatccttgtgacgagcattatagaagcctggtgatccaggaacgggcaaaactatctacaagcggcgcaatcaaaaaaaaaaagaaaaagaaggaaaagaaggacaagtag

SEQ ID NO: 31234 - DNA, 2997 bp, Artificial Sequence
  Description of Artificial Sequence: Synthetic coding sequence
atgaatcgccgacgcaaattcctccttgcctctgtcctggccctgcaaaacagctcattcatctacccttcttgccaaaaatgtttttcacgaattatcctggtctccaagcgatctaactgtcctaaatgtgggtccacgggcgagagtggtaacgcaaactaccgatacaagctgagtctcaaggtggctgaaagcaacaaactgttcgtgatcactgtattcgggagctgccttgacactttcttcggcctcaccgccaccggcttgcatcgttacattcaagaccctaacaagatccccgaaaccctcgacaatgatacaacacagaatctgttaaccaaggccgttgaaacatgttttgtgggacagtccttcatctttggagtcacaaacttcgagaaccagccaggccagggatccgacgcatccaactttctgcagcagtgctcagatcataaacgcaaggcaaaagcgctcgtagcgtgccaaatcgtcctgcccgaccccggtatagccggttttaccgtcatcgattatttccaccagctcctgcaaacgtttaattttagaaaactccagtgcgactcccaggctccaaataatcatttactggctcttgaccactccaattcagacttgtcttcaatatacacaagtgattcaacgtctgacttcttcaagagttgctcgaaagacacattcagtaagttctggcagccaagtctcgagtttacctgcatcgtcagccagctgacggacaatgatgatttttccgctagtgagcaatcaaaggcgttcgggacgctccagcagaaccgcaagtctatttccatcgctgaggccactggttcatcatcttgccacgaccctattcaggactcctggtcgctggtctcgtacatggataaaaagtctactgcagaaaagctggggaaggagctcggcttgcaggctaaggaactgagcgctgtccatagctcccaccacgagatcggtgtcaatgactctaacctgttctcactagaaatgagagagcctctggaatcaagtaataccaagagcttccactcagctgtggagataaagaaccgatctcagcacgagctgccctgttttcagcatcatgggatcgacacccccaccagtctccagaagcggagcgcgtgttgtcctcccagtctgcttaggcttgaggagaccgcaagctcttcccaggatggagacccccagatctgggacgacttgccgttctcagaatccctaaacaagttcctcgcagtcttggaaagtgagatcgccgtcacacaggcagatgtcagctcccggaagcaccacgtcgataatgatatcgacaagttccatgctgaccattcacggctttctgttacccctcagagaactaccggcgcactacacacacctccaatagccctgcgtagcagccaggtgatcgtcaaggcaaactgctccaaggatgacttcctattcaactgtaagggcaacctcagcccctcggtagagaaagagagtcagcccgataataaagtcgaagccgtgagcgtcaaccacaatggacgcgatatgtctgaatacttcctgccaaacccatacttgagcgctttgtcatcctcttcgaaggacctagagaccattgtgactttaaagaagacgatcagaataagcccgcaccgtgaatctgaccattcatcactgaacaacaagtaccttaacggctgtggggagatctctgtttcagaaatgaacgagaaattaaccaccctttgttatcgtaaatacaatgacgtctccgacctgtgtaagttggagaacaaacaatactgcaggtggagtaagaaccaagatgacagcttcaccatctgccgcaagctgacatatccactggagactctctgcaatagtcccaacagatcaacaaataccctgaaggaaatgccctgggggcatataaataacaatgtcacccagagttattcaatcgggtatgaagggagctacgatgcatcagccgatctgtttgacgacatcgccaaggaaatggatatagctacggagataaccaaaaagtcccaggacattctgttgaaatggggtaccagtctagccgagtcacatccatcagaatctgacttttctctgaggagtttgagtgaggacttcatccagcccagtcagaaactttcacttcaatcacttagtgattccaggcactcccggacctgcagcccgactccccatttccagtccgactcagaatacaatttcgagaactctcaagactttgtgccttgttcccagtctacccctatctccggctttcatcagactcggattcatggaatcaatcgggctttcaagaagccagtgttctattcagatttggatggtaactatgagaagatcaggatttttccagagaacgataagcagcaggcgtccccttcttgccctaaaaacatcaaaactccttcgcagaaaatcagatctcccatagtatctggggtgagtcagcccgatgtcttcaaccactacccatttgccgaatgccatgagaccgattctgatgaatgggtaccacctacgactcagaagatctttccttcagacatgctgggtttccagggtattgggctcggaaagtgcctggcggcataccatttccctgaccaacaggagttgcctcggaaaaaactgaagcacatacgacaggggaccaacaagggactgattaaaaagaagctgaaaaacatgctggccgcagtggtaaccaagaaaaaaactcacaaatacaactgcaagtcaagcgggtggatcagtaagtgccccgatatccaggtgttggccgctccccaactccacccaattctgggcccagactcatgtagtgaagtgaagtgctgccttcccttttctgagaaaggccctcccagcgtatgcgagaccagaagcgcttggagtccggagttgttctcctag

SEQ ID NO: 31235 - DNA, 504 bp, Artificial Sequence
  Description of Artificial Sequence: Synthetic coding sequence
atgggaactaccgctcccggacctatccatttattggagctgtgcgatcagaagctcatggaattcctgtgcaatatggataataaagacctggtgtggctggaagagattcaagaggaggctgagcggatgttcacccgggagtttagcaaggagcccgagctcatgccaaagactccctcccagaaaaataggcggaaaaagagacgaatcagctatgtccaggatgaaaacagagatccgatcagaaggagactctcgagaaggaagagccgatccagtcagctgagtagtcggaggctgcgatccaaagattccgtggaaaagctcgcaactgttgtgggggaaaacggaagtgtgctcagacgtgtgactagagctgccgcagccgcagctgctgctacgatggccttggccgctcctagctcaccgacccctgaaagccccacgatgctgacaaagaagcctgaggataaccacacccaatgccagttagtgccctag

SEQ ID NO: 31236 - DNA, 615 bp, Artificial Sequence
  Description of Artificial Sequence: Synthetic coding sequence
atggaggcacaggctcaggggctactggagaccgagcccctacagggcacagatgaggacgccgtggcgtctgcagacttctcctctatgctctccgaagaggagaaggaggaactgaaggcagaactggtgcagctagaggatgagatcaccacactccggcaagtgctgagtgccaaggaacggcatctcgtggagataaagcaaaagttaggaatgaatctaatgaatgaattgaagcagaactttagcaagtcatggcacgatatgcaaacgactacagcttataaaaagacacatgagactcttagccacgccggtcagaaggcaacagcagcctttagtaatgtcggaaccgctatctctaagaaatttggagatatgagttattcaatccgccattcgatctctatgccagcaatgcgaaattcccccacttttaaatcgtttgaagagagggtcgagaccacagttacaagcctgaaaaccaaagtgggcggtactaacccgaacggcggaagttttgaagaggtgctgagctccaccgcccatgccagcgcccagtccctggctgggggttctcgtagaactaaagaagaagagctccagtgctag

SEQ ID NO: 31237 - DNA, 1023 bp, Artificial Sequence
  Description of Artificial Sequence: Synthetic coding sequence
atggccgctgctcgggaccctccagaggtgagcctgcgagaagccactcagcgcaagttacgacgattttccgaactgagagggaaacttgttgccagaggagagttctgggatatcgtggcaattacagctgccgacgagaagcaggagttggcctataaccagcagctgagcgaaaagctgaagagaaaggagcttcccctgggagtgcaataccacgtctttgttgaccccgcaggtgccaagattggtaatggaggaagcaccttatgtgctttgcagtgtctggagaagctgtacggcgacaaatggaattctttcaccattctgttgatccacagtgggggttattcacagcgcctgcccaacgcctccgcacttgggaaaatctttacagctctcccattggatatccccgaatgttccgggaagacttcatgcattattcagagtatactggacagccggtgtagcgtggctcccggatccgtcgtggaatactctcgactcggaccagatgtctctgttggagaaaattgcatcatctctggaagctatattttgaccaaagcggcactcccagctcactccttcgtttgttccctgagcctgaaaatgaatcgatgcctgaaatatgccacgatggcattcggcgtgcaggataacctgaaaaaaagtgtcaagaccctctcagatatcaagctcctccagtttttcggggtgtgcttcctctcatgcttggacgtgtggaacctgaaagttacggaagagctcttcagcgggaacaagacttgtttatctctgtggaccgcacgtattttccctgtgtgttcttcactgagtgattcagttattacaagtctgaaaatgctgaacgcagtcaaaaataaatctgccttctctttgaactcctacaaattactgtctattgaggagatgttgatttacaaagacgtcgaggatatgatcacctaccgtgaacagatatttcttgaaatttcactgaagagctcacttatgtag

SEQ ID NO: 31238 - DNA, 873 bp, Artificial Sequence
  Description of Artificial Sequence: Synthetic coding sequence
atggccgaattgaccgctttagagagtttgatcgagatgggcttcccaaggggacgagcagaaaaggctctggccttgacaggaaatcaggggatagaagctgcaatggactggctgatggagcatgaagatgaccctgatgtggacgaaccattggaaacacctctggggcacatcctgggccgtgagcctacctcctccgagcagggtggtctggagggctccgggtctgccgcaggcgaaggcaagccagccctgtctgaagaagaacgacaggaacagacaaaaaggatgctggagttagtggctcagaagcagagagagagagaggaaagggaggagagagaggccctggagagggaaagacagaggcgccgacaggggcaagagctcagtgctgccagacaaagactgcaggaagacgaaatgcggagagctgcggaagagaggcggagggaaaaggctgaggagctagctgctcgtcaaagggtgcgagaaaagattgagcgagacaaggccgaaagggctaagaagtatgggggaagcgtggggagtcagcccccaccagtggcacccgaacccggtccagtcccctcaagtccttcacaggagcctcctaccaagagggaatatgaccaatgtaggatacaggtgaggttgcccgatggtacttccctcacccagacgtttagggctcgggagcagttagccgctgtccggctgtacgtggaattgcaccgtggagaagagctgggaggcggtcaggaccctgttcaactcctgagtggttttcccagaagggccttcagtgaggccgatatggagcggcctctgcaggaacttggactggtaccgtcggcagttttgatctag

SEQ ID NO: 31239 - DNA, 309 bp, Artificial Sequence
  Description of Artificial Sequence: Synthetic coding sequence
atgctcagtgaagaggaaaaggaggaactcaaggccgagctggtacagttagaagacgaaatcaccaccctacgccaggtgttatcggccaaggaacgccatctggtcgaaatcaagcaaaagttggggatgaacctgatgaatgagctcaaacagaacttcagcaaaagctggcatgatatgcagacaactactgcctacaagaaaactcatgagaccttgtcccatgcgggtcaaaaggccactgccgcttttagcaatgtggggaccgctatttctaaaaagtttggggacatgcgtcggaagtag

SEQ ID NO: 31240 - DNA, 279 bp, Artificial Sequence
  Description of Artificial Sequence: Synthetic coding sequence
atgctgtctgaggaggaaaaagaagaattaaaagccgagctggtgcagttagaagacgaaataactactctcagacaagtcctaagcgccaaagagagacacctggttgaaatcaagcagaagctgggcatgaatctgatgaatgagctgaaacagaatttttctaagtcatggcacgatatgcagacgacaacagcctataaaaagacacatgaaacactatcccacgccggacaaaaagccacagcagcattttcaaacgtcgggacagccatttag

SEQ ID NO: 31241 - DNA, 3735 bp, Artificial Sequence
  Description of Artificial Sequence: Synthetic coding sequence
atgctcatcaaggaatatcacatactgctgcccatgagtttggatgaataccaggtcgcacaactttatatgatccagaagaagagcagagaagagtcatctggcgaaggaagcggtgtggaaatcttagccaacagaccgtacactgacggtcctggtggcagcgggcagtatacccacaaagtgtatcacgttggatcacacatccccggatggtttcgtgctttgttgcccaaagcagcattgcaggtagaggaggaaagctggaatgcttacccgtacacacggactcgctacacatgcccatttgtcgaaaagttctcgatcgagattgagacatactaccttcccgacgggggtcagcagcccaatgtttttaacctctccggggctgaacggcgtcagagaatcctcgacacgattgacatcgtgagggacgctgttgcgccaggcgagtacaaggccgaggaagatccaaggctgtatcattcggtgaagaccggtcgaggtcccctctctgacgactgggccagaactgccgcacagaccggcccactgatgtgcgcgtacaaattatgtaaggttgaattccggtactggggaatgcaggccaagatagaacagttcatacacgacgtgggcctaaggagggtaatgttaagagctcataggcaggcatggtgctggcaagacgagtggaccgagctcagcatggctgatattagggctctggaagaggagactgccagaatgttggcccagaggatggctaaatgcaacaccggttctgaaggatccgaggctcaacccccagggaaaccctctacggaggcccgttccgccgcttcaaatacgggaacaccagatgggccagaggcgcctcctgggccagatgcatcgcccgacgcatcctttggcaagcagtggagctcttcatctagatcttcttactccagtcaacacggcggtgcggtttccccacagagtctttccgagtggagaatgcagaacatcgcacgcgatagcgagaacagtagtgaagaagagtttttcgatgctcacgagggattcagcgacagcgaggaggtgttcccaaaggagatgacgaaatggaatagcaatgatttcatcgacgcatttgctagtcctgtcgaggctgaaggtactccagagccgggtgcagaggcagcgaagggaatagaagatggtgcacaggcccctagagacagtgaagggctcgatggagccggtgagctgggagccgaggcttgtgccgtccatgctctctttctgattctccattcggggaatatcctagactcaggtcccggtgacgctaactccaaacaggcagacgtgcaaaccttgagctcagcctttgaggccgtcactagaattcacttccccgaggccttgggccacgtggccctcaggttagttccatgtcccccaatctgtgctgcagcttatgccttggtgagcaacctgtctccgtactcccacgacggagacagccttagtcgcagccaggatcacatccctctggctgctcttcccctgctggctacttctagtagtcggtatcagggcgcagtcgctacggtcattgcgcgtactaatcaagcatattctgcgttcttacgctccccagagggcgctgggttctgcggtcaggttgccctcataggcgacggcgttggcggtattctaggcttcgacgctctgtgtcacagcgccaacgccggaacaggctctagaggttcctcccggaggggctccatgaataacgaactactatcacccgaatttggtcccgtgcgcgatcccctggccgacggggtcgaaggcttggggagggggagcccggaaccaagcgctttgccaccacagagaattcccagtgacatggcctcccctgaaccagaaggatcacagaattccctgcaggccgctccggcaaccacaagctcatgggaacccaggagagcctcaacggccttttgtccaccagcagccagtagcgaggccccagacgggccttctagcactgctcgcctcgatttcaaagtttccggctttttcctttttggctctcctctaggattagtcctcgcattaaggaaaaccgtgatgcccgcactcgaggccgcacaaatgcggcctgcctgcgagcaaatttacaatctttttcacgcggctgacccgtgcgcttctagactggagcccctgctagctcctaagtttcaggcaatcgcgccactgactgtgcctagatatcagaaattcccacttggtgacgggtcttctctgctacttgcagatacactgcagacacactcttcgctcttcttggaggagctagaaatgctggtccccagtacgcctactagcaccagtggggcattctggaaaggaagtgagctcgccaccgacccaccagcccagcctgctgccccaagcaccaccagcgaagtcgtgaaaatactggaacggtggtggggcaccaaacgaatcgattattccctgtattgccccgaagccctcacggctttccctaccgtgacccttccacacttattccacgcatcttattgggagagcgccgatgtggttgcattcatcctgcgtcaggtcattgagaaagagaggcctcaattggccgagtgcgaggagccctcaatctacagccctgccttccccagggagaagtggcaacgtaagcgcacccaggtcaagattcgcaacgttaccagcaatcatcgggcttcagataccgtggtttgcgagggcaggccacaggttctgagcggcaggtttatgtacggacccttggatgtcgtgacactgaccggtgagaaggtggacgtatatatcatgactcagcccctatccggaaaatggatccacttcggcactgaggtcaccaacagctccggtaggctgaccttccccgttcccccagagagggcactgggaatcggcgtctacccagtgcgcatggttgtcagaggtgatcatacctacgcagaatgctgtcttacagtcgtcgccaggggcactgaggccgtggttttctcaatcgacggctcttttaccgctagcgtgtccatcatgggatcagacccaaaagttcgggctggagctgtggacgtggtgcggcactggcaggactcaggatatttgatcgtgtacgtcactggcaggccggacatgcagaagcatcgggtggttgcttggctgtcgcagcataactttccacacggcgtggtaagcttctgtgacgggctgactcacgacccactccgccagaaggctatgtttctgcaatccttagtgcaggaggtggaactaaatattgtagccggatacgggtcaccaaaagacgtggccgtatatgcagccctgggcctgtccccttctcagacctacatcgtggggcgagccgttagaaaactgcaggcacagtgtcaattcctctccgacggctatgttgcccatctgggccagctggaagcgggaagccactcccatgcgtcctctggaccaccgcgagccgcattgggtaagagcagctatggagtggccgctcccgtagactttctccggaagcagtcccagctgctaaggagccgaggacctagccaggccgagagggagggccctggtaccccaccgaccactctagcaaggggaaaggcgaggtccatatcccttaaactggatagtgaagagtag

SEQ ID NO: 31242 - DNA, 2676 bp, Artificial Sequence
  Description of Artificial Sequence: Synthetic coding sequence
atggaccagcccgaagctccatgttccagcacaggacccagacttgcggtggcccgagagctgttgcttgccgcattagaagaactgtcccaagaacagctcaagaggtttcgccacaaactacgcgacgttggcccagacggacgatctatcccctggggccgactggagagggcagatgctgtggacctggccgagcagctcgcccaattttacgggccagaacccgctttggaggtggcacgaaaaaccttgaagcgcgctgacgctcgtgacgttgctgcacagctgcaagagcggcgactgcagagacttggacttgggtcaggcaccctcttgagtgtctctgagtacaagaaaaagtatcgagaacacgtactgcagctgcatgcccgagtcaaggagcgtaacgcgaggtcggtcaaaatcactaagcggttcacgaaacttctgatagcccctgagtcagccgctcccgaagaggccatgggacccgctgaggaacccgaacctggacgcgctagacgatccgatacgcatacatttaatcggttgtttcggagggacgaggaggggaggcgtcctcttactgtcgtgctgcagggcccagcaggaatcgggaagaccatggcagccaaaaagatcctgtatgattgggcggcaggaaagctctatcaaggacaagttgattttgcatttttcatgccgtgcggggagctgctcgaaagacccggaacaagaagtctggccgacctgattttggaccaatgtcccgatcggggagccccagtgccgcagatgctagctcagccgcagcgcttgctattcattctggatggagctgatgagcttcctgcactgggcggaccggaagcagctccttgtaccgatcccttcgaggccgcttctggggcacgtgtgctcggaggcttgttgtctaaagctctgctacccactgcattgctgttagtcacgacgcgcgctgcagctccgggaagactccaggggagactttgttcaccgcagtgtgctgaggtgaggggatttagcgacaaggacaagaagaagtacttttataaatacttccgcgatgaacgtcgggcagagagggcgtaccgctttgtgaaagaaaatgagacactgtttgccctttgttttgtgccctttgtctgctggatcgtctgtactgttctgcggcagcagctggagttgggacgggacttgtctcgcacttctaaaaccactacttctgtgtacctgctctttattacatctgttctctcctcagctccagtcgccgacggcccaaggctgcagggggacttacggaatctttgtcggttggctcgggagggtgtgttgggccgtagggcccaatttgctgaaaaggaattggagcagctcgagttacgagggtccaaggttcagacattgtttctatctaagaaagaactgcccggagttctcgagaccgaggtcacctatcagttcattgatcaatcattccaggaattcctggccgctctttcttatctgctggaagatggaggagtgcctaggaccgccgcaggcggagtcggcactctgctgcgcggagacgctcagccccactctcacctggttcttaccacacgattcctctttgggctgctcagtgcagagcgaatgcgcgacattgagaggcacttcggttgtatggtgtccgagagggtaaagcaagaagcgttgaggtgggtccaggggcaaggacagggatgccccggagtagccccagaagtcactgagggagcaaagggcttggaggacacagaggagccagaggaggaagaggaaggcgaggaacccaattaccccctggaattactgtactgcctttatgaaacacaggaagacgctttcgtcaggcaggccctgtgccggtttccagaactcgcgttgcaacgcgtacgcttctgcaggatggacgtcgccgtcctgagctattgcgtgcgctgctgccccgctggacaagcgctgcggcttatctcatgccggttggttgccgcacaggagaaaaagaaaaaatctttagggaaaaggctccaggcctccctgggcggaggatcctcccaggggacaacaaaacagctgcctgcctcactccttcaccccttatttcaggcaatgactgacccattgtgccatctaagctctctgactctgagtcactgtaagctgccagacgcagtatgcagagacttaagcgaagccctgcgggctgctcctgcacttaccgagcttggcctgctccacaaccgattatctgaagccggtctgcggatgctctcagagggactcgcgtggccgcagtgtcgcgtgcagaccgtgagggtacaactcccggaccctcaaaggggtcttcagtacttagtcggcatgctgagacaaagccctgctctgacaacattggatttgtctgggtgccaactgccagcacccatggtcacatatctgtgcgcggtgctgcagcaccaggggtgcggactgcagacactaagtttggcctcggttgagctctctgagcagtcactgcaggagctccaagccgtaaagagggcgaaaccggaccttgtgatcacgcaccctgcactagatggtcatccccagcctccaaaggagctaatcagcactttctag

SEQ ID NO: 31243 - DNA, 240 bp, Artificial Sequence
  Description of Artificial Sequence: Synthetic coding sequence
atgtctcagagcggagccgtatcttgctgcccgggagcaactaacggatcattgggcagatctgatggagtcgcaaagatgagccccaaggacctgttcgagcagcgaaagaagtactccaattccaacgttataatgcatgagacatcgcagtatcatgtccagcatctcgcaaccttcataatggataagagcgaggcaatcaccagtgtagacgatgccatccgaaaactggtctag

SEQ ID NO: 31244 - DNA, 543 bp, Artificial Sequence
  Description of Artificial Sequence: Synthetic coding sequence
atgggagataaaaagagtcccactcggcctaagagacagcccaagccatccagtgacgagggctattgggattgcagtgtctgtacatttcggaactccgccgaggcctttaagtgtatgatgtgtgatgtgaggaaaggaactagtaccaggaaaccgagaccagtgagtcagctggtcgcccagcaggtcacccaacagttcgtgcctcctactcagagcaaaaaagagaaaaaggacaaggtagaaaaagagaaaagcgaaaaagagactacatccaagaagaacagccataagaaaaccagacctcggctgaagaacgtggatcgctctagcgcccaacacctggaagttaccgttggggatctcactgtgataatcacagactttaaagagaaaaccaagagtccacccgcttcctccgccgcaagcgccgatcagcattcgcagagcggttcctcgtctgacaatacggagcgcggtatgtctcggtccagctcccccagaggcgaggcctcaagcctgaatggcgaatcacactag

SEQ ID NO: 31245 - DNA, 2196 bp, Artificial Sequence
  Description of Artificial Sequence: Synthetic coding sequence
atgggcagtggcgaggaaccaggccagtctggcgcatcactgaggactggccctatggtccagggcagaggaatcatgaccaccgggtctggccaagaacctggccaatctggcaccagcctccgaaccgggccaatgggcagcctgggccaagccgaacaggtctccagtatgcccatgggatcactggagcacgagggactggtcagcctccgcccagtgggcttacaagaacaggaggggccaatgtcacttgggcctgtgggctctgccggtccggtagagacatccaaagggctactgggacaggaaggcctagtggaaatcgccatggactctccggagcaagaaggcctcgtcggtcccatggaaattaccatgggatccttggaaaaggccggacctgtgtcaccgggatgtgtcaaactggctggccaggagggtctcgtggagatggtgctccttatggaaccaggagctatgcgtttcttgcagctataccacgaagacttgctggctggcctgggggacgtggcccttcttcctctggagggtccggatatgaccgggtttcgcctctgtggcgctcaagcatcatgtcaggccgctgaggaattcctccgctcactgctaggatccatcagctgtcacgtcctctgcctcgagcaccccggttccgcaaggttcttgttgggacccgagggccagcatctgctgcagggtttagaggcacagttccagtgtgtattcggaactgagcgcttagcaaccgctacgcttgataccgggctagaggaggtcgatccaaccgaagccttaccggtgctgcctggaaacgcccacacattatggacgccagattctaccgggggagatcaggaagacgtgtccttggaagaagtgcgagagctcctggccacgctggagggcttggatttggacggagaagattggctgccacgcgagctggaagaagagggccctcaggagcaacccgaggaagaagttactcccggacatgaggaggaggagcccgtcgccccatccactgtcgcgcctcgttggctcgaagaggaagctgcccttcagttggccctacacaggtccctggaaccgcaggggcaggttgcagaacaggaagaagccgctgccctgagacaggcccttacattgtcactcctcgagcaacctcctttggaagccgaggaacctcctgacggtggaacagatggcaaggcccagctggtggtacattcggcctttgagcaggacgtagaggaactggatcgcgcactccgggcagccctggaggtgcatgtgcaggaggaaactgtaggcccatggaggcgcaccctgcccgcagaattgcgcgctaggttggagcggtgccacggtgtgtcagtcgcccttagaggagattgcaccatactgcgcggattcggtgcgcaccctgcaagagctgccagacacctggttgccttattggcgggtccctgggaccagagcctggccttccctctagccgcatctggccctactcttgcaggacagacgctgaaaggcccttggaacaacttggagcggctggccgaaaataccggtgagtttcaagaagtggtccgtgccttttatgacacccttgacgctgccagatctagcattcgggtcgtcagggtggaacgtgtgtcccacccccttttgcaacagcagtatgagctgtacagggaacgcctgctgcagagatgtgagcgaaggcctgttgagcaggttttatatcatggtactaccgccccagcagtcccggacatctgcgcccacggtttcaataggagcttttgcgggaggaatgcgaccgtgtacgggaaaggcgtttattttgcccgaagggcctccctcagtgtccaggatcgatatagccctcctaacgcggacggacacaaagcagtgttcgtagcacgcgtcctcaccggcgactacgggcagggcagacgcggtctaagagccccacctttgcgcggacccggacacgtgctgttgagatacgactcggccgtcgattgtatatgtcagccatcaatatttgtcatctttcacgacactcaggcactacccacccacctgatcacgtgtgagcatgtccccagagctagtccagacgacccctccggcctgcccggtcgatcccctgatacatag

SEQ ID NO: 31246 - DNA, 1083 bp, Artificial Sequence
  Description of Artificial Sequence: Synthetic coding sequence
atgcaggtttacgagggactcgacatcataacaaacaaggtgtccgcacaggagcagcggatctgtcggcaccacatgattagcttcgtcgaccccctggtaaccaattataccgtggtggattttcggaatagggccactgcattgatatatttgcccgaaaccaagtttctgctgctgtgggaggagccaatcattaccctcaacctttgcagtggcaaattcctgtctatcccccgatctttgcaggtgttcgaggaaaccggaatctcacactctgagttcctgcatcgacaacatactgaagaggggggaggccctctcggcggaccactgaaattctccaatccttgtattctgtggctacatgctgatcaagccgtgctcgacgaaaggctggacaaacgggtcgacgatatgttagcggcagggcttctggaagaactgcgggacttccaccgcaggtacaaccagaagaacgtgtccgaaaactcccaggattatcagcatgggatttttcagtcgatagggttcaaggagttccacgagtacctgatcacagaagggaaatgtaccctcgaaaccagtaatcaacttcttaaaaaggggattgaagcccttaagcaagtgacaaagaggtatgcccgaaaacagaacaggtgggtgaaaaatcgctttttgtcaagacctggacccatcgtcccccctgtgtatgggttagaggtgtctgacgtatccaagtgggaggagtccgtgttagaacctgcactggaaatagtacagtctttcattcagggccataagcctaccgccactcccattaagatgccctataatgaggctgaaaataagagatcttaccacctatgcgatctctgcgacagaatcatcatcggagaccgggagtgggcagctcacattaagtcaaagagccatctgaatcagctgaaaaagaggcggagactggatagtgacgccgtgaacacaatagagtctcagagtgtatccccagaccataacaaggagccaaaggagaaaggatcaccaggacagaacgatcaggagcttaagtgttccgtctag

SEQ ID NO: 31247 - DNA, 828 bp, Artificial Sequence
  Description of Artificial Sequence: Synthetic coding sequence
atgtccgctgaagtgaaggtgactggtcagaaccaggagcagtttttgttgctggccaagagcgccaagggcgctgccctggcaactctaatccaccaggtgctggaagcaccaggcgtctatgtgttcggtgagctcctggatatgccaaatgtccgagagctggccgagagcgatttcgccagtacctttcgcctcctgaccgttttcgcatatggaacttacgccgattacctggccgaagctagaaatctcccgcctctcaccgaagcgcaaaagaacaaactgaggcaccttagcgtcgtgactctggctgcgaaagttaagtgcattccatacgccgttttgcttgaggctctcgcccttcgcaacgttcgacagctcgaagaccttgtcatcgaggccgtatacgcggatgtgctgcgaggaagtcttgatcagagaaaccaacgcctggaagtggactattccatcggaagagatatccaaaggcaggatctgtctgctatcgctagaaccctgcaggaatggtgcgtcgggtgcgaagtcgtcctttctggcattgaggaacaggtcagcagagcaaatcagcacaaagagcagcaactggggttgaaacaacagatcgaatctgaggtggctaatctcaaaaagaccatcaaagtcacaaccgcagccgcagccgcagccacatcgcaagacccggagcagcatttaacagagctgcgcgaaccagcccctggaacaaatcagcgccagcccagcaaaaaagcctctaagggcaaagggctcagaggtagtgccaaaatctggagtaaatccaattag

SEQ ID NO: 31248 - DNA, 1692 bp, Artificial Sequence
  Description of Artificial Sequence: Synthetic coding sequence
atggagaccgcgaaacagaaggccctcgaggtcgctaatagactttaccaaaaggatctgcgcgcaccagacgtggtcattggcgctgacaccatcgtgacagtcggaggactcatcctggaaaaacccgtggacaagcaggacgcctaccgtatgttatcccggctgagtgggagagagcactcagtgttcaccggggtcgcaatagttcattgcagttctaaggatcaccagttggatactagggtaagcgaattttatgaggagaccaaagtgaaattcagcgagctgagtgaagagctgctttgggagtatgtgcattcgggggaaccgatggataaggcaggtggctatggcattcaggcgttaggaggaatgcttgtcgagtcagtgcatggtgacttcctcaatgtggtgggctttccactaaaccacttctgcaagcaactggttaagctttattatccacccaggcccgaggacctgagacgtagcgtcaaacatgactccatcccagctgctgataccttcgaagacctgtcagatgtggagggaggtggctctgaacctacacagcgggatgcaggttcaagggatgaaaaggccgaggccggtgaggccggacaggccacggcagaggccgagtgccatcggactagggaaaccctccccccttttccgacccggctgctggagctcatcgaaggattcatgctgtcaaaggggctattgaccgcatgtaaactcaaggtctttgatctgctcaaggatgaagccccacaaaaggcagctgacatcgcctcgaaggtggacgcttcggcctgtgggatggagcgtctactggacatctgcgctgctatgggtctcttggagaagacggagcagggttacagtaacaccgagacggccaacgtttaccttgctagcgatggcgagtactctctacatggctttattatgcacaataacgatcttacctggaacctgttcacttaccttgagtttgccatacgagagggaactaaccagcaccacagggcactgggaaaaaaggcagaagatctctttcaagatgcatactaccagagccccgaaacccgcctgaggttcatgagagcaatgcacgggatgactaagctgactgcttgccaggtggcgacagcctttaacctgtcccggttctcttccgcctgcgacgtgggaggatgtacgggagctctcgcaagagaattggccagagagtacccaaggatgcaggtgacagtatttgatctccccgacatcatcgaacttgccgcacatttccaacctccaggcccacaagctgtgcagattcattttgccgcaggtgacttcttccgggaccccctgccctccgcagagctctatgtgctgtgcaggattctccatgattggccagacgataaagtgcacaaactcctgtcacgggtggcagaatcctgcaaaccgggagccggactcctgttagtcgagacactccttgacgaagaaaagcgggtggcacaacgggctctcatgcagtcactgaacatgctggtacagaccgaggggaaagagcgcagcctcggggaataccagtgcctgctagaactccacggtttccaccaggtccaggttgtgcatctgggtggggtgttggatgctatcttggcaaccaaggtcgccccttag

SEQ ID NO: 31249 - DNA, 828 bp, Artificial Sequence
  Description of Artificial Sequence: Synthetic coding sequence
atgagcgcagaggtgaaagttacaggtcagaaccaggaacagttcttactgcttgcaaagtctgctaaaggcgcagcactcgctaccctgatccaccaggtgctcgaggcgccaggcgtgtacgtcttcggggagctgctggatatgccaaatgtgagggaacttgccgagagcgattttgcctcaactttcagactcctgacagtgtttgcgtacgggacctatgccgattacctggccgaagcaagaaacctgccacctctcaccgaggctcagaagaacaaactgaggcacctgtccgtggtgactctggctgctaaagtgaagtgcatcccctatgctgttctgctcgaggcactggccctacgaaatgtgagacagctggaggatttggtgatcgaggctgtgtatgcggatgtgctgcggggttccctggaccaacgaaaccaaagactcgaggttgactattccatcggccgtgacatccagcgtcaggacttgagcgctatagcacgcaccctgcaggagtggtgtgttggctgtgaggtggtgctctccggcatagaggaacaggtaagtagggctaatcagcataaagaacaacagctcggcctaaaacaacagatcgaatcagaagttgctaacctgaaaaagaccatcaaagtgaccaccgccgctgcagccgcagccacttctcaagaccccgagcagcacctgacggaactgcgagagcccgcacccggaacaaaccaacgtcagccctccaagaaagctagcaaagggaagggcctcagggggtccgccaagatttggtctaaaagcaactag

SEQ ID NO: 31250 - DNA, 999 bp, Artificial Sequence
  Description of Artificial Sequence: Synthetic coding sequence
atggaatatcttggcggtgggtcagcgcttgacctgctgaaaccgggaccgttggaagaaacttatattgctactatcttgagggagatcttaaaggggctcgattaccttcactccgagagaaaaatccacagagacataaaggccgcaaatgttctgctgtccgaacaaggggatgtcaagcttgcagactttggagtcgctgggcagttgacagacactcagataaaacgaaacacgtttgtgggaacccccttctggatggccccagaagtgatcaagcagtcagcctacgactttaaggccgatatctggagcctgggcatcaccgcgatcgaattggcaaaaggcgaacccccaaactctgacctacatccaatgcgggtgctatttttaattccgaagaatagcccccctactttagagggacaacatagtaaaccgttcaaagagttcgtagaggcgtgccttaacaaggatcctcgatttcgcccaacagccaaggaactgttgaaacacaagtttatcacccggtatactaagaaaacctcctttctgacggaactcatagaccgctacaaacggtggaagagcgaggggcacggtgaagaatctagttctgaggattcagacatcgatggggaggccgaggatggcgagcagggaccaatctggacctttcctccaaccatacgcccttctccacatagcaaattacacaagggaactgctctgcactcgagtcagaagcctgccgagcctgtcaagcgccagccaaggagtcagtgtttgagcactctggtcaggcctgtgttcggcgagctgaaagagaagcataagcagagcggcggaagcgttggtgcgcttgaagaactggagaacgcattttctctggccgaagagtcctgtcccggtatatccgataagcttatggtgcatttggtcgagagagttcaacgcttctcacataacagaaaccacctgaccagcacccggtag

SEQ ID NO: 31251 - DNA, 279 bp, Artificial Sequence
  Description of Artificial Sequence: Synthetic coding sequence
atgaatttcacaccaactcatacccccgtgtgccgaaaaaggacagttgtctccaagaggggcgtcgccgtgtcaggtccaactaagagacgcggtatggccgactcgctcgagtcaaccccattgccctcccctgaggaccggcttgctaagctgcacccttctaaagaacttctagaatattatcagaagaaaatggcggagtgcgaggccgaaaatgaggacctcctgaagaaactggaactgtacaaggaagcatgtgaagggcagcacaagtag

SEQ ID NO: 31252 - DNA, 429 bp, Artificial Sequence
  Description of Artificial Sequence: Synthetic coding sequence
atggctcagaaagagaactcctatccatggccttacgggaggcagacagctccaagtggtctgagtaccctcccacagagagtcctgagaaaagaacccgtgacccccagcgcactggtcttgatgtctcgtagcaacgtacagcccacagccgctcctgggcagaaagttatggaaaattccagcggtacacctgacatcctgacgcggagacacttcacaatcgatgatttcgaaattggacggccacttgggaaagggaaatttgggaatgtctacctggccagggagaagaaaagccacttcattgtggccctgaaagtgctgtttaaatctcagatagaaaaggagggagtggagcaccagttgaggagagagattgaaatacaggcacaccttcaaagttggagaagctggcagatgctgtag

SEQ ID NO: 31253 - DNA, 501 bp, Artificial Sequence
  Description of Artificial Sequence: Synthetic coding sequence
atggatcaagaggatagcgagagcaagactgtgtccgagcatggggaacgagactggatgacagctaagaagttctggaagcctggcgattcactcgccccaccggaggtggattttgacagactactggcgtctttgcaggatctgtctgagctcgtcgtcgaaggggacacccaggtgacacctgtccccggtggtgccagactgcggacgctggagccgatccctcttaagctttaccgcaacggaattatgatgtttgacggaccttttcagccattctatgacccctccacacagaggtgcttgagggacatcctagatgggttcttcccctccgagctgcagcggttgtatccgaatggagttcccttcaaagtgatcagctgtagcagtaaccatacattcggtgacttcgaaggaagtggagatactcagcccccacagactcccccaatactccgcggttctagatgtactccctggggcactccagtgtag

SEQ ID NO: 31254 - DNA, 1473 bp, Artificial Sequence
  Description of Artificial Sequence: Synthetic coding sequence
atgcagtctcttgatgatgctactaaacaactcgatttcacaagaaaaacgctcgctgagaagaagcaggagctagataagctccgcaacgagtgggcctcacatacagcagcactgaccaacaagcattcccaagagctgaccaatgagaaagaaaaagctctccaagctcaggtgcaatatcagcaacaacatgagcaacagaagaaggacctggaaattctgcatcagcaaaatatacaccagctacaaaacaggctgtctgaactagaggctgccaataaggatctgaccgaaagaaagtacaagggcgattctactatccgagagttgaaggcgaagctaagcggcgtagaagaagaactgcaaagaactaaacaggaagttctcagtctgaggcgagagaacagcacactcgatgtagagtgccacgagaaggaaaagcacgtcaaccagcttcagacaaaagtggccgtcttagaacaggagataaaagataaagaccagctggtgctcagaaccaaagaggcatttgatacaatccaggagcagaaggtggtgctggaggaaaacggcgagaagaatcaggttcagttagggaagttagaagccactataaaaagtctgagcgcggagctgctcaaagctaatgaaatcattaaaaagctacagggagacctgaagaccctcatgggaaagttaaagttgaagaacacagtgacgattcagcaagaaaagctgttagcggaaaaagaggagaaactgcagaaagagcagaaggagttgcaggatgtggggcagagcctgcgaatcaaggaacaagaggtgtgtaaactacaggagcagttagaagctactgtgaaaaaattggaggagtccaagcagctgttaaaaaataatgaaaagctgattacctggctgaacaaagaattgaacgaaaaccagctggtgagaaagcaggacgtcctcggaccatccaccactccccctgcccatagtagctcaaataccattcgcagtggcatatcccctaacctgaacgtcgtggatggcagactgacctacccaacatgcggaataggctacccggtctcttctgcgttcgcctttcagaacacctttccccactctatttccgcgaaaaacacttctcaccctgggtctgggacaaaagtgcagtttaacttgcagtttacgaagccaaatgcaagcctgggcgatgtccagtccggcgcaacaatctccatgccttgttcaacagacaaagagaacggggagaatgtgggactggagagcaagtatttgaagaaacgggaggactccatccccctgcggggtctgagccagaatctgttttctaatagcgatcaccagagggatggaactttaggagcactgcatacaagcagcaagccaaccgccctgcccagcgcttcttcggcgtacttccccggacagctgcccaactcgtag

SEQ ID NO: 31255 - DNA, 3015 bp, Artificial Sequence
  Description of Artificial Sequence: Synthetic coding sequence
atgctccgaacagctggtcgggatggcctttgccgccttagcacttacttggaggagctggaggcagtagagctgaagaaatttaaactctacctgggcacggcaaccgaactcggagagggaaaaattccgtgggggtccatggagaaagcaggcccactggagatggcccaactccttatcacacattttggcccagaggaagcatggaggctcgcactatctacctttgagcgaattaataggaaagatctttgggagaggggccaaagagaagacctagtgagggacacgccacccggaggaccgagctcgctggggaatcagtccacttgcctacttgaagtcagcctcgtgacaccccgaaaggatccccaggagacctacagggattacgttaggaggaagttccggctgatggaggatcgcaacgcacgtctcggcgagtgcgtgaatctgtcgcataggtatactaggcttctcctcgtcaaagaacactctaaccccatgcaagtgcagcaacagctcctggacacaggtagggggcatgctcggaccgtagggcatcaagcatcacctatcaaaatcgaaacgctgttcgagcccgacgaggaacgacctgagcctccaagaacggtggtgatgcagggagccgcaggcatcggcaaaagcatgctcgcccataaggtgatgctggattgggccgacggtaagttgtttcagggcaggttcgactacctgttttacattaattgccgtgagatgaatcagtccgctactgagtgtagcatgcaggacctgatcttttcttgctggcctgagccttctgcccctctgcaggagttgataagagtaccagaacgcctgttattcattattgacgggttcgacgaactaaagcccagtttccacgatccccaaggtccttggtgcctttgttgggaggagaaacggcctaccgagctgttgctaaacagcctcattcgtaagaagttgctacctgagctttcgctgctgataaccactcgtcccactgcactcgaaaagctgcaccgcctcctagagcaccctagacacgttgagatccttggcttctctgaggccgagcggaaagagtacttctacaagtatttccacaacgctgagcaggccggtcaagtcttcaattatgtgcgggataatgaacctctgttcaccatgtgcttcgtgccactcgtgtgctgggtcgtgtgtacatgtttacagcagcaattagaaggagggggtttactgaggcagaccagcagaacaaccaccgcagtttatatgctgtatctgctttctctgatgcaaccaaagcccggagcccctcggttacagccccctccgaaccagcggggtctgtgctctctcgctgccgatggactgtggaaccagaagattctgtttgaagaacaggatcttcgtaaacacggactcgatggagaggatgtgtcggcctttcttaacatgaacatcttccagaaggacatcaattgcgaaaggtattacagctttatccacctgtcctttcaagagttctttgctgccatgtattacatcctggatgaaggcgaagggggtgccggtccagatcaggatgtgacgcggctcctgacggaatacgccttttccgagaggagtttcctggctttgacctcgcggtttctctttggactcctgaacgaagagactcgctctcacctggagaagagtctgtgctggaaggtttctccacacataaagatggacctgctgcagtggatccagagcaaagctcagtccgacggctccacccttcagcaggggtcccttgaattctttagctgcctctatgagattcaggaagaggagtttatacagcaagccttgtcacatttccaggtcattgttgtgtctaacatcgcatcaaagatggagcacatggtgagcagcttttgcctgaaaagatgtcggtctgcccaggtcttgcacctatatggggcaacttactcagctgacggcgaagaccgcgcaaggtgttccgcaggcgctcacacactccttgttcagctccccgagcgaaccgtactcctggatgcatattccgaacacctggccgcagccttgtgcaccaaccctaatctaattgaactgtctctctatcgtaacgcactgggctcccgaggtgttaagctgctctgtcagggtcttaggcaccccaattgcaaactgcaaaaccttcggctcaagcgctgcaggatatccagttccgcgtgtgaggatctgagcgccgcattaatcgcaaataagaatcttactcggatggatctgagtgggaatggcgttgggttccctggcatgatgctgctgtgcgaggggctcaggcatccccagtgccgcctgcagatgattcagttacggaaatgccagctggaaagcggggcttgccaggagatggcatccgtgctggggaccaatccacatttagtcgagctcgaccttacaggtaacgcattagaagatctgggtttgcgcttgctctgccagggactgcggcatcccgtctgtcgcctgaggaccctctggctcaaaatatgtcgactgactgccgcagcatgtgacgagctcgctagtaccctaagtgttaatcagtcattgagagaattggacttatctctgaacgagctgggcgacctgggtgtgctgctattgtgcgaaggactgcggcatccaacgtgcaagcttcagacactccgcctggggatctgcaggctaggatccgcagcttgcgagggcctgtccgtggtactacaggccaatcacaatctccgggaactggacctcagttttaatgacctcggcgactggggcctatggttgctggctgagggattacagcacccggcttgccggcttcaaaagctgtggttgttcggaatggatttgaataagatgactcactcaaggctggccgcactcagagtgaccaaaccgtacctggatattggttgttag

SEQ ID NO: 31256 - DNA, 2517 bp, Artificial Sequence
  Description of Artificial Sequence: Synthetic coding sequence
atgactggggcagagattgaaccttccgctcaggcaaaacctgagaagaaagccggagaggaagttatagctgggccagaaagggagaatgacgtccccctggtcgttcggcctaaagtgagaactcaggctacaacaggcgctcgccctaagactgagacaaaatcagtgccagccgcaagacccaagaccgaggcccaggccatgagcggagcgagacccaaaactgaggttcaggtgatggggggagctcggccaaagacggaggctcagggtattaccggggcaaggcccaagaccgacgcccgtgccgtgggtggagccagaagtaagactgacgctaaagctattcctggcgctaggccaaaagacgaagcacaggcctgggcccagtctgagtttggaaccgaggctgtttctcaggcggaaggggtctcacagaccaacgccgtagcgtggccactggctacagccgaatctggctccgtaaccaagagcaagggcctgagcatggatcgagaattagtcaacgtggacgccgagacgtttcccggtactcagggacaaaaaggcattcaaccttggttcgggcctggggaagagacgaacatgggaagttggtgctactctcggcctcgcgcacgggaggaggcaagtaacgagtccggattttggagtgccgatgagacaagcacagctagcagcttttggacgggggaagagacttcggtgaggtcttggcctcgagaagaatctaatactcgtagccggcaccgggcaaaacaccaaactaatcccagatcccgccctcggtcaaaacaggaagcatatgtggactcgtggtctgggagtgaggatgaggcgagcaatccattcagcttttgggtcggggagaacacaaataatctttttcggcctcgcgttagggaggaagctaatatcaggtctaagctgcggacgaatcgggaggattgcttcgaatcagaatccgaggacgaattctataagcagtcctgggttctaccaggagaagaggcaaatagtcgtttccgccatagggacaaagaggacccaaataccgccctaaaactgcgcgcacaaaaagacgttgactccgaccgggtcaagcaagagcccagattcgaagaagaggtcatcatcggttcctggttctgggccgagaaagaagcatccctcgaggggggtgcttctgctatctgtgagagcgagcctggcaccgaggaaggggctattgggggatccgcctattgggcagaggaaaagtcaagcttgggagccgtagccagagaggaggcgaagcccgaaagcgaggaggaggccatctttgggtcctggttctgggacagagatgaagcctgtttcgaccttaatccgtgtcccgtgtacaaagtctctgatcgcttccgcgatgcagcggaggaattgaacgcatcctctcgccctcagacttgggatgaagtgaccgtggaatttaagccagggctattccatggtgttggattcagaagcacctccccttttgggatccccgaggaggcctcagagatgcttgaggcaaaacctaaaaatttagaactatcacccgagggtgaggagcaggaatcgttattgcagcctgaccagccttcaccagagttcacatttcagtatgacccaagttatcggtctgtccgagagattcgagaacacctgcgtgccagggagtccgcagagagtgaatcgtggagctgctcttgcattcagtgcgagctgaaaattgggagcgaggagttcgaggagtttctgctcttgatggacaaaatccgggacccttttatacacgaaatctccaaaatagccatgggcatgcgcagcgcatcacagttcacgcgcgactttattcgggattccggtgtcgttagcctgattgagacgctgctgaattacccgagctccagggtaagaacgtctttcctagaaaacatgatccatatggcccctccttatccgaatctgaatatgatcgagaccttcatttgccaggtctgcgaggaaactctggcccactctgtagatagccttgagcagttaaccgggatccgcatgcttaggcatctcacaatgacgatcgattaccacactttaattgccaactacatgtctggcttcctcagtctgcttactactgccaatgcccgaactaaatttcacgttctgaagatgttgctcaacctcagcgaaaaccccgcagtggcaaaaaagcttttctcagctaaggccctctcaatcttcgtcggactatttaatatcgaagaaactaacgacaacatccaaatcgtgattaaaatgttccagaacataagcaatatcattaagagtggcaagatgagtctcattgatgacgacttcagtctggagcccctgatttctgctttccgtgagtttgaggaactggcaaaacaactccaagctcagattgacaaccagaacgacccagaggttgggcaacagtcatag

SEQ ID NO: 31257 - DNA, 165 bp, Artificial Sequence
  Description of Artificial Sequence: Synthetic coding sequence
atgggcaactcagacagtcaatacactctgcagggatctaagaaccactcaaatacaatcactggggctaaacagattccgtgtagcttaaagatccgcggaatacacgcaaaggaggagaaatcactacacggctggggccatggcagtaatggtgccggttag

SEQ ID NO: 31258 - DNA, 1269 bp, Artificial Sequence
  Description of Artificial Sequence: Synthetic coding sequence
atggccagtctgtcccgtgcgcttagggtcgctgccgcacatcccaggcagagtccaactagaggaatggggccttgcaatttgagctccgcggctgggcctaccgccgaaaaaagcgtgccgtaccagagaactctcaaggaggggcagggaacaagcgttgtggctcagggaccgtcacgaccactaccctcaacagccaacgtggttgttattggaggcggatcacttggttgccagacgctatatcatttagctaaactggggatgtctggggcagtacttctcgaaagggagcgcctgaccagcggaaccacttggcacactgctggtttgctgtggcagctcaggccctcagatgtcgaggttgagctgcttgcccacacgaggcgcgtggtcagtagggaactagaagaggaaacaggtctccataccggttggattcagaatggcggacttttcatcgcctctaatagacagcgtcttgatgaatacaagagactgatgagtctcggcaaggcctatggtgtggaatctcatgttctgtcaccagctgagactaaaaccctctatccgttgatgaacgtcgacgatctctatgggaccctttatgtgccacatgacggcactatggatccagccggtacatgtacaactttggcacgggcagccagcgccaggggcgctcaggttattgaaaattgccctgtgactggtattcgagtgtggactgatgacttcggcgttagacgggtcgcaggggttgaaacacagcatggaagcatccaaaccccctgcgtggttaactgcgctggtgtttgggcgagcgccgtcgggagaatggctggcgttaaggtgccactggtcgctatgcatcatgcgtatgtcgtgaccgagaggatcgaagggatacaaaacatgccaaacgttcgtgaccacgacgccagcgtttatcttagactccagggagacgccctctccgtgggcggttatgaagccaaccctatcttttgggaagaagtgtcagataagtttgcctttggtttgtttgatttggactgggaggttttcactcagcatatcgagggtgctatcaaccgcgttcccgtcctggaaaagaccggcatcaaatcaacagtgtgtggcccagaatccttcacacctgatcacaaacccctaatgggtgaagcacccgagctgagaggcttcttcctcggctgtgggtttaactccgccggagaatcagggcaagcactactggcaccttag

SEQ ID NO: 31259 - DNA, 327 bp, Artificial Sequence
  Description of Artificial Sequence: Synthetic coding sequence
atgagtatgcttaagccaagtggactgaaggctccaacaaagatacttaagccgggttcaacggccttgaagacaccaacagctgtggtggccccagtggagaaaacaatctccagcgaaaaagcttctagtacacccagttccgaaactcaggaggaattcgtggacgacttccgagtcggtgagcgtgtctgggtcaacggtaacaaaccgggtttcatacagttcctgggggagacacagtttgccccaggccaatgggctggcattgttttggacgagccaattggaaagaatgatggatctgttgctggcgtcagatactag

SEQ ID NO: 31260 - DNA, 2148 bp, Artificial Sequence
  Description of Artificial Sequence: Synthetic coding sequence
atgaagcgtggtaggcttccttcaagctctgaggacagcgatgacaatgggtccctgtccactacttggagccagaattctcgttcacagcatcgaagatctagttgttcaagacacgaagatcgaaaaccgtctgaggtcttccgtaccgatctgattactgccatgaagcttcacgacagttaccaactgaatccagatgagtactacgtgttagctgatccctggaggcaggagtgggaaaaaggagttcaggtccctgtgtcgccgggaaccattcctcagcctgtggctcgggtggtgagcgaagagaaatctctgatgtttattcggcctaaaaaatacatcgtgtcttctgggtctgagccacctgaacttgggtatgtcgatattaggaccctcgcagattccgtgtgtagatacgacttgaacgatatggacgccgcttggttggagctgacaaatgaggagtttaaagaaatgggaatgcctgagctggatgaatatacaatggaacgtgtgttggaggagtttgagcagagatgctatgataacatgaatcacgccatcgagaccgaagagggactgggcatcgaatacgacgaggatgttgtgtgtgacgtgtgccagagccctgacggcgaggacggaaatgaaatggtgttctgcgataaatgtaatatctgcgtacatcaggcctgttacggtatccttaaggttcctgagggttcttggctctgtcgcacttgtgccctgggggtccagccgaagtgcctcctctgtcctaaaaagggaggggcaatgaaacccactcgctcaggaacaaaatgggtccatgtctcttgcgccctgtggatcccggaggtttcgattggatcccccgaaaagatggagccaataactaaggtgagccatattccgagcagccgctgggcactcgtttgctctttatgtaacgagaaatttggggcttccatccagtgttcagtcaagaactgcaggaccgccttccacgtgacctgtgcctttgatagagggctggagatgaaaaccattctggcggagaacgacgaagtgaaatttaagtcctattgtccaaagcatagtagccatcggaaaccggaagagagcctcggtaaaggggcagcacaggagaatggagctcccgagtgttctccacgtaatcctcttgagccgttcgccagcctggagcagaacagagaggaggctcatagggtcagcgtgagaaagcaaaagttgcagcagctagaggacgagttttacaccttcgtgaatttattggatgtcgctcgggcactgcgtctccctgaggaggtggttgattttctctaccagtattggaaactcaaaaggaaagtgaattttaacaagcccctcatcactcccaaaaaagatgaggaggacaacttggccaagcgtgagcaggatgtactttttcggcgactccagctgttcacccacctgaggcaagatttggagcgcgtacgtaatttgacttacatggtgactcggagagagaagattaaacgatccgtctgtaaggttcaggaacagatattcaatctgtataccaagctgttggaacaggaacgtgtgtcaggcgtgccaagtagttgctcatcttccagtcttgaaaacatgctgctctttaattccccttcagtggggccagatgcccctaagatagaggatcttaagtggcattccgccttttttcgaaaacagatggggacaagcctggtgcattccctcaagaaaccacacaagcgcgaccctctacaaaattcacctggctcggaaggcaagacgctattaaagcagccagacctgtgtggaaggagagaaggcatggtagttcccgaaagctttctaggcctggagaagacctttgccgaggctagacttataagtgctcagcagaagaatggcgtggtaatgcccgaccacggcaagcggagggataatcgattccactgcgatctgatcaaaggggatctcaaagataagagtttcaagcaatcacacaaacccctgagaagcactgacgtctctcagagacatctagacaatacgcgggctgccgctatatggcggttccgtgtgatctggcaaggcccagcagcgtag

SEQ ID NO: 31261 - DNA, 162 bp, Artificial Sequence
  Description of Artificial Sequence: Synthetic coding sequence
atgggacgcaggtctacctcttcaactaaaagcggtaaattcatgaacccgacagatcaggctcggaaggaggccaggaagcgggaactgaaaaaaaacaaaaaacaaagaatgatggtgagggctgccgtgctcaaaatgaaggatcctaagcagatctag

SEQ ID NO: 31262 - DNA, 1035 bp, Artificial Sequence
  Description of Artificial Sequence: Synthetic coding sequence
atgacaacacggtctgtcttggacgtcgaaacgtttgtggccgatattctgaaaggagagaacttgtcaaaaaaggccaaggagaaacgggagagcctcattaaaaaaatcaaagatgttaaaagcatctacttacaggagtttcaggataaaggcgacgcagaggacggcgaagagtacgacgaccctttcgcaggccctccggacactatctctttggccagtgagcgttatgataaagacgatgaggctccgagcgacggagcccagttcccccctatcgcagcccaagacttaccctttgtcctcaaggctggttatctggaaaagcgccgaaaggaccattcctttctgggtttcgaatggcagaagagatggtgtgctctgtcaaagacagtcttctactactatggatctgacaaggacaaacagcagaagggtgaatttgcaattgatggttactccgtcagaatgaacaataccttgcggaaggatgggaaaaaggactgctgcttcgagattagcgcaccagataagaggatttaccaatttaccgccgcttcccccaaggacgcagaggaatgggtgcagcagctgaaatttgttctccaggacatggagtctgatattattcctgaagattacgatgagcgcggagaactgtacgacgacgtagatcaccccctacccattagtaatccgctgacctcaagccaacccattgatgacgaaatatatgaggaactccccgaggaggaagaggatagtgcccctgtcaaagtggaagaacaacgcaagatgtcacaggacagtgtccatcacaccagtggcgacaagtccactgattacgccaacttctaccagggcctgtgggactgtaccggggcattcagcgacgagttatcctttaaaaggggcgacgtgatatacatcctgtctaaagagtataaccggtatggctggtgggtgggggaaatgaagggcgcaattgggcttgtaccaaaggcctacatcatggaaatgtatgatatctag

SEQ ID NO: 31263 - DNA, 2868 bp, Artificial Sequence
  Description of Artificial Sequence: Synthetic coding sequence
atggaggtcggatctgaagaagagaaatgggaaaaactcgacgccgaatttgatcacttcgtagtcgacatgaaaccctttgtcttgaaactcccccataggacagagaggcaacgctgcgccttgtggattagaaagctgtgtgagccatccggtaccggtgcagggattatggggaggaagaataggaacctctatgccaaactgttgctacacatgttaaaacggggagctctggaaggcccttttactcacaggccagagcccggaacgttgaagatacttccgtcctatatgtctatctactttgacgaacctaatcccgctcgcgctaaggggtcttctcctgaggggctccccgcatgggtcctcggggagcttgagactagcgagcataaactgaacgagtcctggaagttatcaagcggcgaggacaacacgctcgtacaatcacccaccgacgtgtatagtcgtgaacagtacaccggcaaactgagagttcgttctcactccctctcacccacacacagagaagacggccagaatataacaccgaaaatttgtgaggtgtactccaaaaagtctcccgtgagcctcgatgacagcgacatcgaggcgcgactgaacagctggaacttgggtatcgagaatcctagatatctccgccagaagcccatacctgtgtccctcatgacacccaagtttagtttgaggaaaagtagctcatttcacgatgaccattttctctccagaattcgagagaaagaactggacatgaaaactaaaatgatggaggctaaattccatgaggaaaagctgaagctccaacagaaacacgacgccgacgttcagaagattctggaaagaaagaataatgagattgaagagctcaaaaccctgtaccgatcaaaacagcacgaaacagaagagactatccgaaagcttgagaagaaagtgcagacactaatacgggactgtcaggtgattcgagaaacaaaagaggaccagatcgctgaactgaagaagatttgcgagcagagcactgaatcactgaataatgactgggagaagaaactgcacaatgccgtggccgaaatggagcaagaaaaattcgatctccagaaacaacacacagagaacatccaagagctgttggaggacacaaatgtgcggcttaataagatggagtcggagtacatggctcagacccaaagtactaaccacatgatcaaagagctggaagctagagttcagcaactcacaggcgaggcggagaactcaaatctccagcgacaaaaactgattcaggaaaaggctgagctggaacgttgctaccagatcacctgctctgagttacaagaagtgaaagcacgaaggaacaccctccacaaagaaaaagatcatctggtaaacgattacgaacagaacatgaagttgcttcagacgaaatacgatgccgacatcaacctgcttaaacaggaacacgcactgagcgcaagcaaggcatcttccatgattgaggagctcgaacagaatgtgtgccagttaaaacagcagttgcaagagtcagagctccagcggaaacagcaactgagggatcaggaaaataagttccagatggagaagagccatctgaagcatatctatgaaaaaaaggctcacgacctgcagagcgaactggacaagggaaaggaggacactcagaaaaaaatacacaaattcgaagaagccctcaaagagaaagaagaacagctcactcgtgtcaccgaagtgcagcgattacaggcccaacaggcagatgctgcactggaggagttcaagcgtcaggttgaacttaatagtgagaaggtgtatgcagagatgaaagagcagatggaaaaagtcgaggcggatcttacccggtccaaaagtcttagggagaagcaatcaaaggagtttctgtggcaactggaggatattagacaacgctacgaacagcaaatcgtggaattaaaactggagcacgaacaggagaaaacccacctcctgcaacagcataacgcggagaaggactcgctcgtgcgtgatcatgaacgcgagatcgaaaacctggagaagcagttgcgggctgcaaacatggagcatgagaatcaaattcaggagttcaaaaagcgcgatgcacaggttattgctgatatggaagcccaggtgcataagctgcgggaggaactgatcaatgtgaattctcagcgcaaacagcagcttgtcgagttaggtctgctccgagaagaagaaaaacagcgggctacgcgcgaacatgagatcgtggtgaacaagctaaaagctgaatctgagaaaatgaagattgagctgaagaaaactcatgccgctgagaccgaaatgactctggaaaaggcgaactccaagctgaaacagatcgaaaaagagtatactcagaagctcgctaagagtagtcagataatcgccgagctgcagactaccattagctccctcaaggaggaaaattcccaacaacaactggccgcagaacgaagacttcaggatgtccgccaaaagtttgaagacgagaaaaaacagctgattagggataatgatcaggccataaaggtcctgcaggacgaactagagaacagatccaatcaggtaagatgcgcagaaaagaagctccagcataaagaactagaatctcaagaacagataacatatattaggcaggagtacgagacaaaactcaaggggcttatgccagcatcactgcggcaggagctggaagacacaatctcttcgctcaagtcacaggtgaattttctgcagaagagggcatcaatactccaggaagagctcaccacatatcaggggagaagatag

SEQ ID NO: 31264 - DNA, 834 bp, Artificial Sequence
  Description of Artificial Sequence: Synthetic coding sequence
atgttatcccaaaaggaggtagctgttgctgatgccaaaaaatccctcgagcttaatccgaacaattcaaccgcaatgctgaggaaaggcatctgcgagtaccatgaaaaaaactatgccgcagcgctagagacatttacagagggacaaaagctggattccgctgacgcaaacttctcggtatggatcaaacggtgccaggaggcccaaaacggatccgaatccgaggtctggacccaccagagtaaaatcaagtacgactggtatcagactgagtcacaagtggttatcacgctcatgataaagaacgttcagaagaacgatgtcaacgtagaattttctgagaaggagctctctgccttagtcaaattaccatctggagaggactacaacttgaagctggaacttctgcatccgataattccagagcagtccacttttaaagtgctttcaactaagattgaaattaaacttaagaaacctgaggctgtacgttgggagaagctagagggtcagggcgacgtcccgactcctaagcagttcgtggctgacgtgaagaacctgtatccatcctctagtccttacacgcgcaactgggataagctggtcggtgagatcaaggaggaggagaagaatgagaagctggaaggggatgccgctttaaaccggctgttccagcaaatctacagtgatggatctgacgaggtgaaacgggcaatgaacaaaagcttcatggaatctggcggtacagttctgagcaccaactggtcagacgttgggaagagaaaggtggagatcaatccacccgatgatatggaatggaagaagtactag

SEQ ID NO: 31265 - DNA, 807 bp, Artificial Sequence
  Description of Artificial Sequence: Synthetic coding sequence
atggggagtgccaagagtgtgcctgtgaccccagcgagaccacctccacataataaacacctggcccgtgtggctgatcccagatcgccctcggcaggaatcctccgaacacccatccaggtggagagctctccccagcccggattacccgctggtgaacaattggaggggctgaaacacgcgcaggattcggatcctcgcagtccaacccttgggatcgccaggactcccatgaagaccagctctggtgatcctcctagtcctctcgtaaaacagttgtctgaggttttcgagaccgaagatagtaaatcaaacctgccacctgaacctgtactcccacctgaagcccctctgagctccgagctcgatctacctctgggcactcagctttctgtggaggagcagatgcctccttggaatcagacagagttcccctccaaacaggtctttagcaaggaagaagctcgtcaaccaacggagacaccagtggcctctcaatcttctgacaagccctcccgtgaccccgaaacacccagaagtagcgggtctatgaggaaccgctggaaaccgaactcaagcaaagtcctgggcagatctcctctgaccattctacaggacgacaattccccagggacattgaccctccgccagggcaaaaggccttcccccttaagcgaaaacgtgtccgagttaaaagagggagcgatcttgggaactggtcgactccttaaaacaggcggaagggcctgggaacagggccaagaccacgacaaggaaaatcagcacttcccactggtcgagtcctag

SEQ ID NO: 31266 - DNA, 1140 bp, Artificial Sequence
  Description of Artificial Sequence: Synthetic coding sequence
atggtttttaagctgaagacaaaagaggagcagcactcgatgctgggatcaggctttaaggcagagaggctccgcgttaacttgcgactggtgatcaatcggcttaagctgttggaaaaaaaaaagacagagctggctcaaaaagccagaaaagaaatcgccgattacctcgccgctgggaaagatgagagagctaggattcgggtcgagcatatcatacgcgaggactatcttgtggaggcaatggaaattttagaactgtactgtgacctgctcctagctcggttcggactcatccaaagtatgaaggaactcgacagtggactggcagagtctgtaagtacactgatctgggcagccccacgcctgcaaagtgaggtggcagagctgaagatcgtggcagaccagctgtgcgctaaatacagtaaggaatatgggaaactgtgtcgcacaaaccaaatcgggactgttaacgatcgactcatgcataaactgagtgtcgaggccccacccaaaatattagtggaaaggtatctcatagaaatcgccaaaaattacaatgtgccttacgaaccagattccgtggttatggccgaggccccacccggagtcgaaacagacctcattgacgtgggatttaccgacgatgtcaaaaaggggggtcctggcaggggtggttcagggggattcactgccccagtggggggaccagacggcactgtgcccatgcccatgcccatgccgatgccgatgccaagtgctaatacaccgttcagttatcctctgcccaagggtccatcggacttcaatgggctgccaatgggcacctaccaggcctttcctaacattcacccaccccagattccggctactcccccatcctatgagtctgtcgacgacattaatgcagataaaaacatatcttcagctcagatcgtgggtccaggtcctaagcctgaggcctcggccaaattaccctcaaggccagccgacaactatgacaacttcgtactgccagagctgcctagcgtgcctgatactcttccaaccgcttcggcaggggcaagtaccagcgcatccgaagacatagatttcgatgatctgtctcgcagattcgaggaactgaaaaagaagacctag

SEQ ID NO: 31267 - DNA, 903 bp, Artificial Sequence
  Description of Artificial Sequence: Synthetic coding sequence
atggctcgccctctgtctactccctcctccagccagatgcaggctcgcaagaaacaccggggaattattgagaagagacgaagagatcggatcaatagctccctcagcgaattaagacgccttgttcctaccgcctttgagaagcaaggatcatcaaagctggagaaggcagaagttctccagatgactgtagaccatctgaagatgttgcatgccaccggcggaactggtttcttcgatgcccgagcgttggcggtcgatttccgcagcatcggttttcgcgaatgccttactgaggtcatcaggtatctgggggtcctggaaggccctagctcccgtgcggatccagtgcgcatcaggctgcttagtcaccttaactcgtacgcagctgagatggaaccctctcctacccctacgggcccactggccttccctgcctggccctggagtttcttccactcctgtccagggctgcccgcactcagtaatcagctcgctattctcggtagggtcccaagtcccgtgttgcctggcgtttcgtctccagcctatccgatcccagccctccgaaccgctccactgagaagagctacgggcatcatccttcctgcccgtcgcaacgtgctgcctagccggggtgccagctcgactcgcagagccagaccactggagagacccgctaccccggtgccggtcgctccgagtagccgggctgccaggagttcccatatcgcccctctgcttcagagctctagcccaacaccgcctggacccactggttccgctgcctatgtggccgttccaacacccaactcttcctctcctggcccagctgggcgtcccgctggagccatgctgtaccacagttgggtttctgagatcaccgagataggagcattctag

SEQ ID NO: 31268 - DNA, 318 bp, Artificial Sequence
  Description of Artificial Sequence: Synthetic coding sequence
atgtccgttgtccccccaaatcggtcacaaaccggatggccccgtggcgtgacacagttcggcaacaaatacatccagcagacaaaaccgctgactctcgagcgcacaataaacttatatcccctgaccaactatacgttcggaacaaaagagcccctgtatgagaaagactcctccgtggcagccagatttcagcgcatgcgcgaagagttcgacaagattgggatgcggcgtacagtcgaaggcgtgctgatcgtccatgagcatcgcctaccccatgtgctgctcctaagtcgttttaatttcatctacaactag

SEQ ID NO: 31269 - DNA, 588 bp, Artificial Sequence
  Description of Artificial Sequence: Synthetic coding sequence
atgggcaacagcgactcgcagtacaccctgcaaggtagcaagaatcacagcaatactataacgggagccaaacagattccctgttctctcaaaatcagagggattcacgccaaggaagaaaaatccctgcatggatgggggcacggttcaaacggcgctgggtacaagtccagaagcctagcccgtagttgcctctctcactttaagtcaaatcagccctacgcaagtcgattgggcggtcctacatgtaaggtctcacgaggggtggcctattcaacccataggactaatgcccctggaaaagactttcagggaatttctgccgcattctccacagaaaacgggttccacagcgtgggacatgaactggccgacaaccatataaccagccgcgattgcaacggccacctcctgaactgctatggccgtaacgagagcattgcatccacccccccaggggaggatcgcaaaagccctcgcgttctgattaaaacactggggaagttagacggatgtctgcgcgttgagttccacaatggagggaatccaagcaaggtgccggctgaagattgctctgagccagtgtag

SEQ ID NO: 31270 - DNA, 1581 bp, Artificial Sequence
  Description of Artificial Sequence: Synthetic coding sequence
atggtgcccggagaggagaaccagctggtaccaaaagaggatgtgttctggcgctgtaggcagaacatcttcgacgaaatgaagaagaagttcctgcagatcgagaatgccgctgaagagcccagggtgttgtgtatcatccaggacaccacgaattcaaaaacagtcaatgaaaggatcaccctcaatttaccagccagtacgcccgtgagaaaactctttgaggatgtggcgaacaaggttggatacatcaatggcactttcgacttggtgtggggcaatggcatcaacacagccgacatggcacctctggaccacactagcgataagtccttacttgatgctaactttgagccagggaagaagaacttcctccaccttacagataaggatggcgaacagccccagatcttactcgaggattcttccgccggtgaggatagcgtccacgacaggttcattgggccactgcccagggaaggtagcggcggttcaacatctgactatgtgtcccagagctatagttacagtagtattctaaataagtctgagactggctacgtgggattggtcaaccaggctatgacttgttacctgaacagccttctgcagacgttgttcatgacgccggaattcagaaatgccctgtacaagtgggagtttgaggaatctgaggaagatccagtgacatcaatcccctatcaactgcagagacttttcgtgctccttcagacatccaagaaaagagccatagagaccactgatgtgacccggagctttggatgggatagctcagaggcctggcagcagcacgatgtccaggaactctgcagggtcatgtttgatgccctcgagcagaagtggaaacagacggaacaagccgaccttatcaatgagctctaccagggaaaattaaaagactacgtcaggtgtctggagtgcggctatgaggggtggagaatagacacctacctggatatacccttggtgatacgcccatacggctcctctcaagccttcgcaagcgtcgaagaagcactacatgctttcattcagcccgagatactcgacgggccaaatcagtacttctgcgagcggtgtaagaagaagtgcgacgccaggaaaggcctaaggttcctacattttccctatctgcttacgctccagctgaaacgttttgacttcgattacaccacaatgcataggatcaaactgaatgacaggatgaccttccctgaagaactggatatgtccaccttcatcgacgtcgaagatgaaaagtcaccacaaaccgaatcttgtaccgacagtggggctgaaaatgagggcagctgccattccgatcagatgtccaacgatttctctaatgatgacggcgtggatgagggtatctgtctggagacaaactctggcacagagaaaattagcaaaagtggattggaaaaaaattcattaatctacgaactgttttcggttatggtgcacagcggaagcgccgctggagggcattattatgcttgtatcaagtcctcggtgatgagctcgggtaccgcctctatgatcaacatgtcagcaggatag

SEQ ID NO: 31271 - DNA, 963 bp, Artificial Sequence
  Description of Artificial Sequence: Synthetic coding sequence
atgggcaaggaacaggagctgttggaagcagccagaactggtcacctcccagcagttgagaagctcttatcgggcaagcgactttcgtctggctttggcggtggcggaggcggaggatctggtggcggtggcggaggttcaggaggaggtggtggagggctgggctctagttcccaccccctcagttccttgctgagtatgtggaggggaccgaatgtgaactgtgttgacagtactggctataccccactgcaccacgctgcactgaatggccacaaagacgtagttgaggtgctgctccggaacgacgccctaaccaatgtggctgactcaaaaggctgttaccccctccaccttgccgcatggaagggagacgcccagatcgtgcggctcttgatccaccagggtccctcccatacaagagtcaacgaacaaaacaatgacaacgagaccgccttgcactgcgctgcccaatacggacacacagaggtggtgaaagtgcttcttgaagagctgacggacccaacgatgcgcaataacaagttcgagacccctctggatctggctgctctgtatggcaggctggaggtggtcaaaatgcttctgaacgctcatccaaaccttctgtcttgcaacactaagaagcacacaccactgcacctggcagcacgtaacggacataaggcggtagtccaggtcctcctggacgctggcatggatagcaactatcaaacagagatgggaagcgctcttcatgaagcggcactctttggcaaaaccgacgtggtgcagatactgctggccgcagggactgatgtgaacatcaaggacaatcacggactcacagcactcgatactgtgcgcgagctgcccagtcaaaaaagccagcagatagccgctctgattgaggatcttgacacactgcagttctacttcattagctgcccctttcagggcctgtag

SEQ ID NO: 31272 - DNA, 660 bp, Artificial Sequence
  Description of Artificial Sequence: Synthetic coding sequence
atggtgattcataaaaatccacctgatacccctacggagtcccagttcactagatttctgtgcagttcaccgctcgaggctgaaaccccccctaatggcccagattgtggttatggctcatttcaccagcagtattggttagatgggaagatcatcgccgtgggtgtcattgatatcctgcccaactgtgtttcatccgtatacctgtactacgacccagattattcttttctttccctgggggtgtattcagctctgagggaaatcgcttttacgcgccaattacacgagaaaacatcacagctctcctactactacatgggcttctacattcacagctgccctaaaatgaaatataagggacaataccgtccatccgacctactgtgtcccgagacctatgtgtgggtccccattgagcaatgtttgccttctctggagaattctaagtactgcagatttaaccaggacccagaagctgtggatgaagataggtccacagagccagatcgactgcaggtctttcacaagcgcgcaattatgccttacggagtgtacaagaagcagcaaaaggacccctctgaggaggctgccgtccttcagtatgcatccctagtcggtcagaaatgcagtgagaggatgcttttgtttcggaattag

SEQ ID NO: 31273 - DNA, 1791 bp, Artificial Sequence
  Description of Artificial Sequence: Synthetic coding sequence
atgcagcagaaagaactcggtacatttgctcaaagctcaattgctctccaccaccagtacaatccgaagttccagacacttttccaaccgtgcaacttaatgggagcaatgcaactgattgaggacttcagtactcatgtgtcaatagattgctctccacataaaacagtgaagaagacggctaatgagtttccatgtctccccaagcaggtggcctggattttggctacgagtaaggttttcatgtatccagaactgctccctgtatgtagtctgaaggcaaaaaacccacaagataaaatactttttacaaaagcagaggataataaatacttgctgacttgtaagaccgcacgacagttgactgtgagaattaagaatctaaatatgaatcgagcaccagacaacattatcaaattctacaagaaaacaaaacagttgcccgttctgggaaagtgttgcgaagagattcaaccacaccagtggaagccaccaatcgagcgtgaagaacaccgtctgcctttttggctaaaggcatctctcccatcaatccaggaggagctacggcatatggccgatggggctcgagaagtggggaacatgacaggaacgacagagattaatagcgaccaggggctggagaaagataatagtgagctcggctcagagacccggtaccctttactcctccccaagggagtggttctgaagctgaaaccggtagcagatcggttccccaaaaaagcctggcgacagaagagatcctcagttctgaagccactcttgatacaaccctcacccagtttacagccttccttcaacccgggaaaaacaccagcgcaatcaacccactcagaggcccctcccagcaagatggtgttgcgtatacctcaccccatccagccggcaaccgttcttcaaacggttcccggtgtgccacccctcggggtgagcggaggcgaaagttttgagtcacctgctgcgctgccagcaatgccacccgaggctagaacttcctttccgctgagcgagtcgcagactttgctgagtagcgcacccgtgccgaaagtcatgatgccttccccagcctctagcatgtttcgcaagccttacgtgaggcgcaggccttctaagcgccgaggagcacgagctttccggtgtattaagcccgctcccgtgattcatcccgcatctgtaattttcacggtgccagccaccacggtaaagatcgttagcctgggcggtggatgcaatatgattcagccagttaacgcggcagtggcccagtcgccacagaccatcccaatcgcaacccttctggtcaaccccacatcctttccctgccccctgaatcagcccctcgttgcgagttctgtaagccctctgattgtctcgggaaattcagtgaatttacccatcccttcaacgcctgaggacaaggcccacatgaatgtcgatatcgcctgtgctgtggccgatggcgaaaatgccttccagggcctggagcccaaattggagccacaggagctgagtcccctgtctgccaccgtgtttcccaaagtcgaacatagtcctggtcccccacccgtggacaaacagtgccaggaaggcctgtcagaaaactccgcctaccgatggacagtggttaagactgaggaaggacggcaagcactagagcccctccctcagggaatccaggagtccttaaataactcaagtccaggagacctggaggaggtggtcaagatggagccagaagacgccaccgaggagatctccggctttctttag

SEQ ID NO: 31274 - DNA, 912 bp, Artificial Sequence
  Description of Artificial Sequence: Synthetic coding sequence
atggctgataagtcaaaattcatcgagtacattgacgaagctctggagaaaagcaaggaaacagctctgtcgcacttattctttacataccaaggcatcccttaccccatcacgatgtgcacctccgagacctttcaggctctggacacatttgaggcgaggcacgacgacattgtgctggctagttacccaaagtgcggctctaactggatcctgcacattgtatcagagctcatctatgctgtgtcaaagaaaaaatataaatacccggaatttcccgtcttagaatgtggcgatagcgaaaaatatcagagaatgaagggatttccatcacccaggattctggctacccaccttcactatgacaaactgccagggtcgatatttgagaacaaggccaaaatactggtgatcttccggaatcctaaagacaccgccgtgtccttcttgcactttcataatgacgtgcctgacatcccgtcctacggatcttgggatgaatttttcagacaatttatgaaaggtcaggtgtcctggggtcggtattttgactttgctatcaactggaacaagcatctagacggggacaatgtgaagtttattttgtacgaggacctgaaggagaacctggcggctgggataaaacagatcgccgaattcctcggcttctttttgacaggtgagcagatccagacaatctctgtacaaagcacttttcaggcaatgcgagccaagtcccaagacacgcatggagcagtcggtcctttcctgttcagaaaaggggaagtgggggattggaagaacctcttctcagaaatccaaaaccaggaaatggatgagaaatttaaggaatgcctggcagggacttccctaggtgcgaaactgaaatacgaatcttactgccagggctag

SEQ ID NO: 31275 - DNA, 366 bp, Artificial Sequence
  Description of Artificial Sequence: Synthetic coding sequence
atgggagtccctgagatcccaggggaaaagctggtgaccgaacgaaacaagaagcgcttagagaaagagaagcacgagaaaggcgctcagaaaactgactgtcagaagaacctgggcacggtgggggcagtggcactggattgcaaaggaaacgttgcttatgctacgagtactggcggaatagttaacaaaatggttggcagggttggcgattccccttgcctgggacggaccaaaggctgtctgctgccgctgcccttgttttcaagacctcaggcattcctcacattgtattcgctgccattgtccgtcagttgttgcgttccttttctgcttctcgtgcaactacaggacgtgtgggaatag

SEQ ID NO: 31276 - DNA, 579 bp, Artificial Sequence
  Description of Artificial Sequence: Synthetic coding sequence
atgactcttgggtctaaaagccagcagcctccagaggatatcaaggctctgtcatggaacagacaagcccagcacattctttctagcgcccacccttctggcaaagctgtagtgtgggacctacgtaagaacgagcccattattaaagtgtccgaccattccaatcgcatgcactgctcagggctcgcctggcaccctgacattgcgacccagctagtgttgtgttccgaggacgatcgcctcccagtaatccagctgtgggacctcaggtttgcctccagtcccctgaaggtgctcgagtcccactcgcggggaatactgtccgtctcttggtcgcaggctgatgctgagctcctgctaacatctgcgaaagacagtcagatcctctgtcgaaacttaggttcctccgaggtagtgtataaactacccacgcaaagcagctggtgcttcgatgtacagtggtgtccccgagacccgtctgtgttcagtgctgcaagttttaacggttggatttcattgtatagcgtgatgggtaggagttgggaggtgcaacatatgcgacaagcggacaaggtatag

SEQ ID NO: 31277 - DNA, 621 bp, Artificial Sequence
  Description of Artificial Sequence: Synthetic coding sequence
atgaaggacgtagacaacctaaaatcaatcaaagaagaatgggtctgcgaaactggaagcgataatcagccgctgggcaataatcagcagagcaattgtgagtattttgtcgactccttatttgaagaagcccagaaagtctcttctaagtgtgtctctcccgctgagcagaaaaagcaagtagacgtgaacattaaactgtggaagaatggctttaccgtgaatgatgattttaggtcgtactcagatggagcgtctcaacagttcttgaacagcattaaaaaaggcgagcttccttctgaactccagggaatattcgacaaggaagaagtggatgtaaaagtggaagacaaaaagaacgagatctgcctctcaacaaaacctgtcttccagcccttttctggacaggggcaccgacttggtcgagtgtctcacatcaaagattttatcgaaaagtaccaggggagccagaggagcccccctttctcactggccacagccctgcccgtgctcaggctgttagatgaaacactgaccttggaggaagccgatctacaaaacgccgtgatcatccagcggctccagaagactgctagttttagggagctgtcggagcactag

SEQ ID NO: 31278 - DNA, 1359 bp, Artificial Sequence
  Description of Artificial Sequence: Synthetic coding sequence
atgcgcggttgtagctatggcctatgccggaggggactcctgttctgcgttattctggacgatcagagcggaaaaaaaagcgtcaacgacaagaacctcaagaaaaccgtcgaagacgaagatcaagattcagaagaagaaaaagacaacgactcctacattaaggagcgctcagatattccttccggtacatccaagcatcttcagaagaaggcaaagaaacaggccaagaaacaagccaaaaaccagagaagacagcagaagatccaggggaaagtcctgcacttaaatgatatatgtaccatcgatcatccagaggattcagagtacgaggccgaaatgtctttgcaaggagaagtgaatattaagagcaaccatatctcgcaggagggggtaatgcataaggaatactgtgtcaaccagaaagacctgaatggtcaagctaaaatgattgagtcagtaacggacaatcagaagagcacagaagaagttgatatgaagaacatcaatatggataacgacttagaggtactcacctcttccccgacccgaaacctgaatggagcctatctgactgaggggagcaacggggaagttgatatcagcaacgggttcaagaacctcaatctgaatgcagctctgcacccagatgagatcaacattgagatcttaaacgactctcatactccaggcactaaggtttacgaggtggtgaacgaagaccctgagacagccttttgtacactggccaaccgggaggtgtttaacacggatgaatgcagtattcagcattgtctgtaccagtttacgaggaatgagaagctgcgcgatgcgaacaagttgctctgcgaggtttgcacaaggaggcagtgcaatggtccaaaggctaatattaaaggtgagcgtaaacacgtttatacgaatgccaagaaacagatgttgatttcgctagctcctccagtcctgacactccaccttaaacgtttccaacaggccggtttcaatctccgtaaagttaacaagcatattaagttccctgagatcctcgatttggccccattttgtaccctcaagtgcaagaacgtggccgaagagaatacacgggtgctgtacagtctgtatggggtcgtggagcactccggaactatgaggtccggccactatacggcttatgcaaaggctaggaccgctaactcacacttgtcaaatctggttcttcacggcgacatcccccaggactttgagatggagagcaaaggtcaatggttccacatttccgatacacacgtccaagcagtcccaacaaccaaggttcttaacagccaggcctatctcctattctacgagcgcatcttgtag

SEQ ID NO: 31279 - DNA, 450 bp, Artificial Sequence
  Description of Artificial Sequence: Synthetic coding sequence
atggagcgcattgagggggctagcgtgggaaggtgcgctgccagtccatacctgcggccattgacgctgcactaccgccagaatggtgctcagaaatcttgggatttcatgaaaacccacgacagtgtgaccgtgctcctcttcaattcaagccgccgttccttggtcctggtaaagcagtttcgacctgctgtttacgcaggcgaggtggagaggcgattccctggctcactggctgcagtggatcaggacggcccacgggagctacagcctgctcttcccggaagcgctggagtgactgtggaactctgtgcaggactagtggaccagcccggactgagcctggaagaggtggcttgtaaggaggcctgggaagagtgcgggtatcacttagcccctagcgatctgcgtagggtggccacctattgggatgccacgatgggctcctag

SEQ ID NO: 31280 - DNA, 489 bp, Artificial Sequence
  Description of Artificial Sequence: Synthetic coding sequence
atgaactcgaacgcctctgaacacactggaatgcttcgcacatgttggtctcattcccactgggacccattctcctccgggagcgtgaccgccatgtgggcaacacacagtcctactagcaaagcctgggcgggaatccaaggccgagggagatgggctctggggtttccctggagaggacagggtgtactgcacgtgatcgcttcacagaaggccgctgtcaccgaagccgtggatttgcgaacgggcgcagcaagccaggcaatgtcagaagcttttgtaagaagcggcatgttttacctgcgccctgcattcgtgctgctctgctacaaatggggaaagctcaggcattcagaagtttcgaatttacttggagtagcctggcccgttagtgaagaagcttgtatggggacgtggggctctctggcagttgcagtcacattacccgctcaggggctggggacttgggggagagacgaaggagagtag

SEQ ID NO: 31281 - DNA, 1320 bp, Artificial Sequence
  Description of Artificial Sequence: Synthetic coding sequence
atggtcccgagccgggaggccctcttggggcctggaacaactgcaatccgctgccccaaaaagctgcagaaccagaactataaagggcatggcctgtccaaggggaaagagcgtgaacaacgggcttcaataagattcaagaccactttaatgaataccctcatggacgtattgcggcacaggcctggatgggtagaagttaaagacgaaggcgaatgggatttctattggtgcgacgtctcctggttgcgggaaaactttgaccacacttacatggatgagcatgtccgcatttctcacttccgcaatcattatgagctgaccaggaaaaattatatggtgaagaatctgaagcgattccgcaaacagctggagagggaggccggaaagctggaagctgctaaatgtgactttttcccaaaaacgtttgaaatgccatgcgagtaccatttgtttgttgaagagtttcggaagaatccaggtataacctggatcatgaagcccgttgccagaagtcaggggaaaggtattttcttgtttcggcgacttaaagacatcgtcgactggaggaaggatactaggagctcagacgaccagaaggatgatattccagtggaaaattacgtggctcagagatatattgaaaatccctatctcatcgggggacgtaagtttgacttgagagtttacgtcctcgttatgtcagtcttcgcagaatgccttctctggtctggccacaggcgccaggacgtccatcttacaaacgtggccgtgcagaagacttctcccgattaccatccaaaaaaagggtgcaaatggaccctgcaaagattccggcagtacctggcatctaagcacggcccagaagctgttgaaaccctattccgcgacatagataacatttttgttaaatccttgcaatcagtacagaaggtgatcataagtgacaagcactgcttcgagctgtacggatacgacatcctgatagatcaggatttaaagccgtggctactcgaggtcaacgcctctccatcgctgaccgcatctagccaggaggactacgaactcaagacctgccttttagaggacaccctgcatgtggtcgatatggaggcacgattaactggccgagagaagcgggtcggtgggttcgaccttatgtggaatgatgggccagtttcgcgagaagaaggagccccagacctgtcagggatgggcaacttcgtaaccaacactcacctgggctgcgtcaatgacaggaaaaaacaactgcgacagctcttttgttcgctgcaggtccaaaaaaaggcctccagctag

SEQ ID NO: 31282 - DNA, 867 bp, Artificial Sequence
  Description of Artificial Sequence: Synthetic coding sequence
atggccaaatggggcgaaggggaccctcggtggattgtggaggaaagggcggatgccacgaatgttaacaattggcattggaccgaaagggacgcgagtaactggagcacggacaaattgaaaactctgttcctggcagtgcaagtgcagaatgaggagggcaaatgcgaagtaaccgaggttagcaagctggatggggaggcttctatcaacaataggaagggtaagctgatattcttctatgagtggagtgtgaagctcaattggaccggcacgtctaagagtggagtgcagtataaggggcacgtggagatcccaaacctgagcgatgaaaattctgttgacgaggttgagatttctgtctccctcgccaaggacgagcccgacaccaacttggtggcactcatgaaggaggagggcgttaaactgctgagggaggcaatggggatctacatttcaaccttgaagactgagttcacgcagggcatgatcttgccaaccatgaacggggagtctgtcgacccagtgggacagcccgcactcaagacagaagaaagaaaagctaagcctgctccatcaaagacccaggctcgaccggtcggagtaaaaatacccacgtgcaaaatcacgctgaaggaaacgttccttacctctcccgaggagctctaccgcgtgtttacaacacaggagctggttcaggcattcactcacgcccctgctacactcgaggccgaccgcggagggaagtttcatatggttgacggaaacgtgtccggcgagttcacggacctcgtgcccgaaaagcatatcgtgatgaagtggagatttaagtcatggcccgaaggctcgcattgtcattccggatag

SEQ ID NO: 31283 - DNA, 1053 bp, Artificial Sequence
  Description of Artificial Sequence: Synthetic coding sequence
atgcccagcttcatccgccatggacctactatcccacgaaggactgatatctgcctcccagatagctcacccaacgccttctctacctctggcgacgtggttagccgtaaccaaagttttctgcggacaccaatacagaggacccctcatgaaataatgagacgggaatcaaatagactgtctgcccctagctatttagcgaggagcttggctgacgtcccgcgagaatatggctcctctcagagtttcgttaccgaagtctcattcgctgtggaaaacggggattctggctctaggtactactacagcgacaactttttcgatgggcagaggaagcgacctctgggggaccgggcacatgaagattaccggtattacgagtataatcacgacctgtttcagcggatgccccagaaccaaggtaggcatgcatcggggatagggcgagtcgcagcaactagtctgggcaacctaacaaaccacggatccgaagacctgcccttgccacccggttggtccgtcgactggaccatgagaggcagaaagtactatatcgatcataacacaaatactactcactggtcccaccctctggagagagagggccttcctcctggctgggagagggtggagagttccgagtttggcacttactacgtcgatcacacgaacaagaaagctcagtaccggcacccttgcgcaccatctgtgcctagatatgaccaacctccgccagttacataccagcctcagcagacagagcgcaaccaaagcctgctggtgccagctaatccataccacaccgctgagatccccgattggcttcaggtgtatgctagagccccagtgaagtatgatcacattctcaagtgggagctgttccaactcgccgatctggatacctatcagggaatgctgaaattgttgtttatgaaagaactcgagcagatcgttaagatgtacgaagcttatagacaggcactgttgactgaacttgagaatcgtaagcagcggcagcagtggtacgcccaacagcatggcaagaacttctag

SEQ ID NO: 31284 - DNA, 537 bp, Artificial Sequence
  Description of Artificial Sequence: Synthetic coding sequence
atgactttcagagagggccatcagtgggagaagattcctctgagcgggagtaaccaggagattaggcgtcagaaggaacggatcaccgagcagcccttgaaggaagaagaggacgaggatcgaaaaaataagggtcatcaagctgccgaaattgagtggctcgggtttcggaagccttcacaggctgacatgctgcactcgaagcatgacgaggagcaaaaggtctgggatgaggaaattgacgacgacgacgatgataattgcaacaatgatgaggatgaagtgagggtgattgagtttaagaagaaacatgaggaggtcagtcagttcaaggaggagggggatgcctcagaggactcacccttatcctccgcctcatcccaagccgtgacaccagatgagcagcctaccttaggcaaaaagtccgacatctcccggaacgcatattccagatacaatactatcagttacaggaaaatccggaaggggaacactaagcaacgaatcgacgagtttgagtccatgatgcatctgtag

SEQ ID NO: 31285 - DNA, 312 bp, Artificial Sequence
  Description of Artificial Sequence: Synthetic coding sequence
atggcagcctttaaactggacttcctgcccgagatgatggtggaccactgctcgctcaacagtagtcctgttagtaagaagatgaatggcactctggatcacccagatcagccggatctggatgccatcaagatgttcgtcggccaggttccccgaacctggtctgagaaggatttaagggagctcttcgaacagtacggagccgtgtatgagatcaacgtgcttcgggatcgatcacagaacccaccccagtctaaggggtgttgtttcgtgaccttttatactaggaaggccgcacttgaagcccagtag

SEQ ID NO: 31286 - DNA, 1917 bp, Artificial Sequence
  Description of Artificial Sequence: Synthetic coding sequence
atgccacccattaacctgcaggagaaacaggtgatctgtctgtcaggagatgacagttctacttgcataggaatcctggcaaaagaggttgaaattgtcgccagcagtgatagcagcatctcatctaaggcacggggaagtaacaaagtcaagatccaaccggttgctaagtatgattgggaacagaagtattactatggaaacctcattgctgtatctaactcattcctggcgtatgctattcgggctgcaaataatggaagcgcaatggtgcgggttatctctgtgagcaccagcgaacgcactttacttaaaggcttcaccggttcagtcgccgacctggcctttgcacatctgaacagtccacaactggcatgtctggacgaagccggaaacctcttcgtttggaggttggcgctggtcaacggcaagatccaggaagagatcctcgttcacattaggcaaccagagggaacaccactcaatcacttccggagaataatttggtgcccatttatcccggaagagagtgaggactgctgcgaggaatcttcccccacagtcgcccttctgcatgaagatcgggcagaggtgtgggaccttgacatgttgcgcagtagccatagtacatggccagtcgacgtttcgcaaataaaacagggctttatcgtggtgaagggtcactccacatgtctctctgaaggcgcactttcccctgatggcaccgtgctggctaccgcaagccatgatggatacgtaaagttctggcagatctacattgagggccaggacgagccaaggtgtctccacgaatggaaaccacatgatgggcgtcctctgagttgtctgctgttttgtgataaccacaaaaagcaggatcctgacgtccctttctggcggtttctgattacaggagctgaccagaaccgggaacttaaaatgtggtgtaccgtgagctggacttgcctccagaccattaggttctctcctgatattttcagctccgttagcgttccaccttctctcaaggtttgcctcgacctaagtgctgaatatctcatcctgtcggacgtgcagcgcaaggtgctctatgtaatggagctgcttcagaatcaggaggaaggacacgcctgctttagctcaatttctgagtttctcctgactcatcccgtgctaagcttcggtatccaggtggtctccaggtgtcgtctgcgccatacagaggtcctccccgctgaggaagagaacgattctttgggtgccgacggaactcacggggcaggagcaatggaatcagctgcaggggtactcataaagctcttctgtgttcacaccaaggctctgcaggacgtccagattcggtttcagcctcaacttaaccctgacgtggtggcgcctctaccaacccatacagcccacgaagatttcactttcggcgaatcacggccagagctgggatccgaagggctgggcagcgctgcccatgggagtcaaccagacctcaggcggattgtagagttgccagctcctgccgacttcctgtctctgagttctgagactaagcccaagttaatgacccccgacgcattcatgaccccatctgcaagcctccagcagatcaccgctagcccgtctagctccagcagcggctcctcatcctcctcctcttccagttcatcttctctgacagctgtgtcagccatgtccagcacatccgcagttgacccctctctcacccgaccgcctgaagaactgacgctgtcaccaaaactgcagctcgatgggtccctgaccatgtcttcttcaggaagtctccaggctagccctcgtgggctgttgcctgggctgctgccagctcccgctgacaaattgactcctaagggacctggacaggtctgtgattgggtttgtgtctag

SEQ ID NO: 31287 - DNA, 495 bp, Artificial Sequence
  Description of Artificial Sequence: Synthetic coding sequence
atgcgaatactcatacttgggctagacggagccggaaagactaccattctgtacagactccaggttggagaggtcgtcactacaatacctactatcggcttcaatgtggaaactgtgacttataaaaaccttaaattccaggtgtgggatctcggaggccagacatcaattcgtccttattggcggtgctactatagtaacacggatgccgtcatatatgtcgttgacagctgcgatagggatcgcatcgggatcagcaaaagtgaactggtggcaatgcttgaggaagaagagctgcggaaagcaattctggttgtgtttgccaataagcaggatatggaacaggccatgacatcaagtgagatggcaaattccctgggcttgccggctctgaaagatagaaaatggcagatttttaagactagcgctacaaaaggaaccgggctagacgaggccatggaatggctggtcgagaccctgaaatcccgccaatag

SEQ ID NO: 31288 - DNA, 1944 bp, Artificial Sequence
  Description of Artificial Sequence: Synthetic coding sequence
atggcacagggcagcgtgtcctttaacgacgtgacagtcgattttacccaggaagaatggcagcaccttgatcatgcccagaagaccctctacatggacgttatgctagagaattattgccacctcatttcggtcggctgtcatatgaccaaaccggacgtgatcctaaagctcgaaagaggcgaggaaccttggacttcatttgccggacacacatgccttgaggaaaactggaaggccgaagatttcctcgttaagttcaaggagcaccaggaaaagtattctcgcagtgtggtctcaattaatcacaaaaagctggtgaaggaaaaaagcaagatctatgagaaaacatttacgctcggaaaaaacccagtcaatagtaagaatctgcctcccgaatatgatacacatgggaggatcctcaagaacgtgtctgaactgataatcagcaacttgaatccagctcggaagcggctatctgaatacaatggatacggcaagtcactgttgtctaccaaacaggagaccactcatccggaggtcaagagtcacaaccaaagcgctagggcgttctcacacaacgaggttctgatgcagtaccagaagacggagaccccagcccaaagcttcgggtacaacgactgcgaaaaatcttttctgcagagaggaggtctcataacccatagtaggccttacaagggcgagaatccgtccgtgtacaataagaagagaagagctacaaatatagaaaagaagcacacatgtaacgaatgtggcaagtcattttgcagaaagtccgttttgattctccaccaagggatccacagtgaagaaaagccctaccagtgtcatcaatgtggcaatgcctttagacgaaagtcctatctcattgatcaccagcggactcatactggggagaaaccttttgtgtgtaacgagtgtggaaagagctttcgcctcaagaccgcgctgaccgatcaccaaaggacccataccggtgaaaaatcctacgagtgtttacagtgccgcaatgcattccgcctcaagagtcatctgatccgacatcagcggacacacactggggaaaaaccctacgagtgtaacgactgcggcaagtcttttagacaaaagaccaccctgagtctgcaccagcgtattcacacgggggagaaaccctacatttgcaaagagtgcggcaagagttttcaccaaaaggctaatcttacggtgcaccagcggacgcacaccggggaaaagccttatatatgcaacgagtgtggtaagagcttctctcaaaagacaaccctggccctgcacgagaaaacacataatgaagaaaagccctacatctgttcggaatgtggcaagtccttcagacagaagacaacacttgtggcacaccagaggacccacactggagaaaagagctacgagtgcccccattgcgggaaagcctttagaatgaaatcctacctgattgaccaccatcggacacacactggagagaagccctatgaatgcaacgaatgcggcaagagtttttcccagaagaccaaccttaacctgcaccagagaatccacacaggagagaaaccttacgtctgtaacgagtgcgggaaatctttccgtcagaaagccacgctgacggtccatcaaaaaatccatactggtcagaaatcatatgagtgcccccagtgtgggaaagccttctctcggaaaagttacctcatccaccaccagcggactcatactggggagaagccctacaaatgcagcgaatgtggaaagtgtttccgtcaaaagaccaatctgattgtccatcagaggactcatacaggggagaagccttatgtgtgtaatgaatgcggtaaaagcttctcctacaaacggaatttaatcgtccatcagcgtacacacaagggtgaaaatattgaaatgcagtag

SEQ ID NO: 31289 - DNA, 3570 bp, Artificial Sequence
  Description of Artificial Sequence: Synthetic coding sequence
atgaaactcgaatgtattcctgcgcctattaccccctccacggtgccatcctttccacccaccccccctacccccccagcatccccaccccacacgccagtaatagtccctgctgcggctaccacagtgtcatccccaagcgctgcgataacagttcagcgcgtgttagaggaggacgagagcatccggacttgcttatctgaggacgccaaagagattcagaacaagattgaagtggaagcagacggtcagaccgaggagatcctggattcacagaatttgaactcaaggaggtcgccggtcccagcccagattgctatcaccgtgcctaagacttggaagaaacctaaagatcggacccggaccactgaggagatgctagaggccgagctcgagttgaaggcagaggaggagctctcaattgacaaggtgctcgaatcggagcaggacaagatgtcccagggtttccatccggagcgggaccctagtgacctgaaaaaagttaaagctgtggaggagaatggcgaagaggccgagccggtaagaaacggcgcagagagtgttagtgagggggaggggattgacgcaaatagcggatcaactgacagcagtggtgacggcgtgaccttcccatttaagcccgaatcatggaagccaacagacacggagggaaagaagcagtatgatagggagttcctgctagacttccagttcatgcccgcttgtattcagaaacctgaaggtctgccacctatttcagacgtggtcctggacaagatcaaccaacccaagttgcccatgaggacacttgacccccgtatcctgcctcgcggacccgacttcactcccgcatttgcggacttcggcagacagaccccaggcggaagaggggtccctcttctcaatgttggttcccggagaagccagcctgggcagcggagggaacccagaaagatcataaccgtgagtgtcaaggaggatgttcatctgaaaaaagccgagaatgcttggaaaccgtctcagaaacgagatagccaagccgatgatcctgagaatatcaaaacacaggagcttttccgcaaagtgcggtctattctcaacaagttgacgccccaaatgtttaaccagctcatgaagcaggtaagtgggctcacagttgatacagaagaacggctcaagggggttattgacctggtgttcgaaaaggctattgacgaaccatctttttcagtggcctacgccaatatgtgtaggtgtttggttacacttaaggtgcccatggcagacaagcccggaaacactgtcaactttcgcaagttgttgttgaatcgctgccagaaggaattcgagaaggataaagcggacgatgacgtgttcgagaagaaacagaaggagttagaggctgcatcagcgcctgaagagagaacacggctccatgacgaactggaagaagcaaaggataaggcaagacgcaggtcgatcgggaatatcaagttcatcggggagctgttcaagctgaagatgctgactgaggcaatcatgcacgattgcgtggtcaaactcctcaagaatcacgatgaagaatctcttgaatgtctctgccggcttttaaccacaattggtaaagacctggacttcgagaaggccaagcccagaatggatcagtattttaaccagatggaaaaaatcgttaaggaacgaaaaactagctctcgcataaggtttatgcttcaggatgtcatcgacctgcggttatgcaactgggttagcagaagagcggatcagggcccaaaaacaatcgaacagatccataaggaggcaaagatcgaggaacaggaggaacagcgcaaggtgcaacaactcatgacaaaagaaaaaaggcgcccaggtgtacagagggtggacgaggggggatggaataccgtccagggagcgaaaaattctagagtgctggatcccagcaaatttctgaaaatcactaaacccacaatagacgagaagattcagctcgtcccaaaagcccaactgggcagctggggcaagggctctagcgggggtgctaaggcttccgagacagacgcccttagatctagcgcctcatctctgaatagattctcagccctacagccgcctgcgccttcaggatccaccccatcgacaccagtggagttcgatagcagaagaacattgacatctagaggcagcatgggcagggagaagaacgataagccactgccaagcgcaactgccaggcccaacacctttatgcggggagggtcatccaaagatctcctcgataatcaaagccaggaagaacagaggagagaaatgctggagactgtcaaacagctgacaggcggagtggacgtggagcgaaactccaccgaagccgaacgaaacaagactcgggaaagtgccaagcctgagatttccgccatgtccgcacacgataaagctgccctgagtgaggaagagcttgaaagaaaaagcaagtcaatcattgatgaattcctgcacataaacgatttcaaggaagccatgcagtgcgtggaggagctcaatgctcaaggactgctgcatgtatttgtgagagtcggtgtcgaatctacactcgagcgtagccagatcactcgcgatcacatggggcagttgttatatcagctggtacagagcgagaaattaagtaagcaggactttttcaagggtttctccgagactcttgaactggctgacgacatggctatagatattccccatatctggctttacctcgccgaactcgtaactcctatgttgaaagagggaggaatttcaatgcgggagctcaccattgagttcagcaaacccctgttacccgtcgggcgtgctggagttctcctttccgagattctgcacctgctgtgcaagcaaatgtcccacaagaaggtcggcgctctgtggcgcgaggctgacctgtcatggaaagactttttgcctgaaggagaagacgtacacaatttcctcttggagcagaagctcgatttcattgaaagtgatagtccttgcagttcagaggccctctcaaagaaggaactgagtgctgaagaattatacaaacgtttagagaaacttattatcgaggataaggcgaacgatgaacagatctttgactgggtcgaggccaatcttgatgagatccagatgtcttcacccaccttcctgagagcactcatgaccgcagtgtgtaaggccgcaatcattgccgacagcagcaccttcagagtcgacacagctgtgattaagcagcgggtacccatcctgcttaagtacctggactccgataccgagaaggagctgcaggctttgtacgctttgcaggcttccattgtcaaattggatcaacccgctaaccttctccggatgttctttgactgcctttacgacgaggaagttattagcgaagacgccttctacaaatgggagagctccaaggaccccgcagagcagaacggaaaaggcgtggcattaaaaagcgtgactgctttctttacctggctcagggaggcagaagaggaatccgaggataattag

SEQ ID NO: 31290 - DNA, 591 bp, Artificial Sequence
  Description of Artificial Sequence: Synthetic coding sequence
atgtggtctgtattgcaagacggcccaatttctcgggtgatcgtgttctccctatcggcagccaaagagacaaaagatagacctctccaagacgagtattccgtgctggtagcctccatgctcgagcctgccgtagtttatcgagaccttctgaacagaggacttgaggaccaactgttgctaccgggaagcgaccagttcgatagtgtgctctgctctctcgtgacagacgtagacctagatgggagaccagaggttctggttgccacttacggacaggagctgttgtgttataagtatcgcggtcctgagagcggtctgcccgaggctcaacatggatttcatctgctgtggcagagaagcttctcgtcccctctgcttgctatggctcacgtggatcttacaggtgatggattgcaggagttggctgtcgttagcttaaaaggagtacacatactgcaacattctctgatccaagcttctgaattggtgctgacgcgcttgcgccatcaagtcgagcagcggcgacgcaggctgcagggtctggaagatggagccggagctgggccagccgaaaatgctgcaagttag

SEQ ID NO: 31291 - DNA, 1056 bp, Artificial Sequence
  Description of Artificial Sequence: Synthetic coding sequence
atggtgagtcacacgttccatatgagaacagaagagagcgatgcgagtcaggagggggatgatcttcctaagagcagcgcaaacacctctcaccccaaacaagatgacagccctaaatcatctgaagaaacaatccagcccaaggagggggacatacccaaggccccagaggaaactatccagtccaaaaaggaagacctaccgaaaagcagcgagaaggcaatacaaccgaaggaaagcaacattcctaaatctagtgcaaagcccatccagccaaagttaggcaatataccgaagacctccgtgaagccctctcagcctaaagagagcgacattccaaaatctcccgaggaggctattcagcctaaggagggggacattccgaaatccctggaagaagcaatccagcccaaagaaggcgacataccaaagtcaccagaggagactattcagccaaagaaaggggacattcccaagtcccctgaagaagccattcagccaaaggagggcgatatacccaaatcaccaaaacaggccattcaaccaaaagagggcgacattcccaagtctttggaagaagcaattccacccaaggagatcgatattcccaaatcccccgaggaaaccatacagcccaaggaagacgatagtcctaaatcactggaagaagccacaccttcaaaggagggggatatacttaaacccgaagaagagacgatggagtttccagagggtgacaaggttaaggtgatcctgagcaaggaggatttcgaggcctctctgaaagaggcaggggagaggctcgtcgccgtcgatttctcggccacatggtgcggcccttgtagaacgattaggccattttttcatgcgctttcggtgaagcatgaagatgtggtctttttggaagtggatgcagataattgcgaagaggtagtgcgggagtgcgctattatgtgtgtccccacattccagttctacaagaaggaagaaaaagtcgacgagttatgcggggcactgaaagagaaactcgaggcggtgattgcggagttgaagtag

SEQ ID NO: 31292 - DNA, 1473 bp, Artificial Sequence
  Description of Artificial Sequence: Synthetic coding sequence
atgccggacggcaagatccagaagcttatcattaccgaggaaaccgctaaaattaggccttttgcagtagctgctgtgctgagaaacatcaaattcaccaaagatcggtatgacagtttcatcgaactgcaagaaaagctgcaccagaatatatgccgtaagcgtgccttagtcgccataggcacacacgacctggataccctgtcaggccctttcacatacaccgccaaaagaccttctgatattaaattcaagccactcaataaaaccaaggagtataccgcctgtgaactcatgaacatatacaagacagataatcacttaaagcactatttgcatatcatcgaaaataagccactatacccagtcatttatgacagcaacggcgtagtgctgtccatgccacccatcataaatggcgaccactcacgaatcaccgtcaatacgaggaatattttcatcgaatgtacaggaacagatttcacaaaagccaagatcgtgctcgatattatagtgactatgttctccgagtactgcgagaatcagtttacagtggaggccgcagaggtagtcttccctaacggtaagtcccacacattcccagaactggcttacaggaaggagatggttcgggctgatttaatcaataagaaagtgggaatcagggaaactcccgaaaatctcgcaaagctgttgacaaggatgtacttgaaatctgaggtcattggggacgggaatcagatcgagatagaaatacccccaacgcgcgcagacatcatccatgcctgcgatatcgtcgaggatgctgcaattgcatacggctacaataacatccagatgaccctccccaaaacttatacgatcgccaaccagtttcctctaaacaagctaacagaattgttaaggcatgacatggccgctgcagggttcacagaagccctaacgttcgcgctttgctctcaggaggatatcgctgacaaattgggtgtggacatatccgctactaaggccgtccacattagtaatcctaagacagcggagttccaggtggctcgaaccacacttctgccgggactcttaaaaacgatcgcagccaatcggaaaatgcccctccccttgaagctctttgaaatcagcgacatagtaataaaggattccaacacagatgtaggggcaaagaattaccgtcatctctgcgcagtgtactataataagaatccaggtttcgagattatacacggtcttctcgatcgcatcatgcagctgcttgacgtgcctcctggggaagacaaaggtggctatgtgataaaggcatccgagggccctgccttttttcccggacggtgtgctgagattttcgctcggggacaatccgtgggaaagctgggagtgctacaccctgacgtcattactaaattcgagctcacaatgccctgttctagcctcgaaatcaatgttgggcctttcctctag

SEQ ID NO: 31293 - DNA, 1458 bp, Artificial Sequence
  Description of Artificial Sequence: Synthetic coding sequence
atggcagcagaattgtacgcccctgctagtgctgctgcagccgacctcgcgaattccaacgccggtgcggcagtcggcaggaaagccggacctagaagccctccgtccgcaccggcacccgctccaccaccccctgccccagcacctcctacactgggcaacaatcaccaagagtcaccagggtggcgctgttgtcgcccaaccctgcgagagcgcaatgctctgatgttcaataacgaactgatggcagatgtacattttgtagtgggtcccccaggcgctactcgaaccgtgcccgctcacaaatatgtgttggcggtcgggtctagcgtgttctatgccatgttctatggagacctggcggaggtgaagtctgagattcacattccagacgtcgagcccgcagcttttctgatactgttgaagtatatgtatagcgatgagatcgatctggaggcggataccgtcctcgctaccctctacgcagccaagaaatatatcgtccctgccctagcgaaggcttgcgtgaatttcttggaaacttccttagaagccaagaacgcctgtgtcctgctgagccagtctcgcctctttgaggaacctgagttaacacaaaggtgttgggaagtcatagacgcccaagctgagatggcactccgttccgaaggattttgcgaaattgaccgccaaaccctcgagattatcgttacccgggaagccttgaatacgaaagaggccgttgtcttcgaggctgttcttaactgggcagaggccgagtgcaagcgccagggtctgcccatcacacccaggaataaacggcacgtactcggtcgggctctgtatcttgtccggataccaaccatgacactggaagaatttgccaatggggctgctcagtctgacatcctgactttggaggagacgcactctatattcctgtggtataccgccactaataaacccagactagatttccctctcacgaaacgcaagggactcgcaccacagcgctgtcatcgcttccagtcatccgcttatcggtccaatcagtggcgctaccggggtcgatgcgactccatacagttcgcggtggacagacgagtgtttattgccggattgggcctgtacggctcaagtagcggaaaggccgaatatagtgttaagattgaattaaagaggctgggcgtggtcctggcccaaaatctgaccaaattcatgtccgacggctcctcaaacacctttcctgtgtggttcgaacatcctgttcaggttgaacaggacactttttacaccgcttccgcagtgctagacggatctgagctgagttattttggccaagagggaatgactgaggtccaatgcggcaaggtggcttttcagttccaatgtagcagtgattccaccaacggtacaggagtccaaggcggtcagatcccggaattaattttttatgcatag

SEQ ID NO: 31294 - DNA, 204 bp, Artificial Sequence
  Description of Artificial Sequence: Synthetic coding sequence
atggcccttctcgcagagcacctcctgaaaccactcccagctgataaacagattgaaacagggccattcctcgaagctgtgagccaccttccccctttctttgactgcttaggctctcccgtgtttacgccaatcaaggctgacatttccggcaacataactatgaggaagcttaggctgcgtggggtcgaaggcctggcatag

SEQ ID NO: 31295 - DNA, 816 bp, Artificial Sequence
  Description of Artificial Sequence: Synthetic coding sequence
atctgtgagcgcatcaggtccactgttgacgagaaagaacagaaacagctgctgatggatttggatgtggtgatgcgctcttccgactgcccctatatcgtccaattttatggcgctttatttcgtgaaggcgattgctggatttgcatggagctgatgagcacttcatttgataaattttacaaatacgtgtatagcgtgttggatgacgtaatccctgaagaaatacttggcaagatcactcttgctacagtgaaagctcttaaccatctcaaggaaaacctcaaaatcattcatcgcgatatcaagcctagcaacattttgctggacagatccggcaacatcaagttatgcgatttcggcatttcaggacaattggtcgacagcattgccaagactcgggatgccggatgtcgcccatacatggccccagagagaatcgacccttccgccagcaggcaaggctacgacgtgcgcagcgacgtgtggagtctcggaatcaccctgtacgagctggccacaggccgtttcccttacccaaagtggaacagtgttttcgaccagctgacgcaagtggtgaagggcgacccgcctcagctctccaattctgaagagagagagttttcccccagcttcattaactttgtgaatctgtgcctaaccaaggatgaaagtaaaaggccgaaatacaaggagttgcttaagcacccatttatactgatgtacgaggagagagcggtcgaggtggcatgttacgtatgtaagatactggaccaaatgcccgcaaccccatcatccccaatgtatgtggactag

SEQ ID NO: 31296 - DNA, 291 bp, Artificial Sequence
  Description of Artificial Sequence: Synthetic coding sequence
atgagtgagaaggtggattggttgcaatctcagaatggggtgtgtaaagtagacgtgtactcgcccggagacaatcaggcgcaggattggaagatggacaccagcaccgatcccgtgagggtactctcctggctgcgaagggaccttgaaaagtcaactgccgagttccaggacgtacgatttaagcctggggagtcctttggtggtgagaccagcaactccggggacccacacaagggcttctctgtcgattactacaacacaaccacaaaaggcactcctgagagatag

SEQ ID NO: 31297 - DNA, 792 bp, Artificial Sequence
  Description of Artificial Sequence: Synthetic coding sequence
atgttatcctctaagggtctcacagtcgtggatgtgtaccaagggtggtgcggcccatgcaaaccagtcgtatctttgtttcaaaaaatgcgaatcgaagtgggtctggacttattacactttgctttggccgaggctgaccggttggacgtgttggagaagtatagagggaagtgtgagccgaccttcttgttttacgccattaaggatgaggccctgtcagacgaggacgagtgcgtgtcccacggcaagaataacggagaggacgaggacatggtgagcagtgagaggacatgtactcttgcaataatcaagcccgacgctgtcgcccacggaaaaacggacgaaattatcatgaaaatacaggaagccggattcgagattttgactaatgaggagcggactatgacagaggcagaggtgcgacttttttatcagcataaagccggtgaggaagccttcgaaaagttggtgcatcacatgtgctctggtccttcgcaccttttgatcctaacgagaactgaggggttcgaggatgtggtcaccacctggcgcacagtgatgggccctcgagatcctaatgtcgcaagacgcgagcagccagagagcctgcgtgctcagtatggcaccgaaatgccttttaatgcagtacatgggtcgagagatagggaagacgccgacagagagctggcattactctttccctcgctgaagttcagcgacaaggataccgaggcccctcagggagagagttctacacagccgagactgaaaattaccgacctcgactag

SEQ ID NO: 31298 - DNA, 867 bp, Artificial Sequence
  Description of Artificial Sequence: Synthetic coding sequence
atgtcttcctccatgtggtatattatgcagagcatccagtctaaatactccctttctgaaaggttgattcgcactatcgctgcaatcagaagctttccacacgataacgtggaagaccttattcgcggtggcgcagatgtgaattgtactcatggcacgctgaaaccattacactgcgcatgtatggtctcagatgcagactgtgtcgagctgttattggagaagggcgcagaggtgaacgcactagacgggtacaacagaactgctctacactatgccgcagaaaaagatgaggcatgtgtggaagtgctactcgagtacggggctaatcctaatgccctggacggcaaccgggacactccacttcattgggctgcctttaaaaataacgccgagtgcgttagggcgctgctggagtcgggtgcaagtgtcaacgctctggattataacaatgacacccctctgagttgggcggctatgaaaggcaatctcgagtccgtaagtatcctgttagactatggagccgaggtgcgggtcattaatctcatcgggcagactccaatatcacgcctggtcgccctgcttgtccgcggactgggcactgagaaagaggactcgtgttttgaactcctccaccgcgctgtgggacatttcgaactgcggaaaaatggcactatgcctagagaggtggcccgtgaccctcagttgtgtgagaagctgaccgtgctttgttctgcccctggtacattaaagacccttgccaggtacgccgtgaggaggtcgctcggcctccagtatctgccggacgcagtgaagggactgccactgccggctagcttgaaggagtacctcctcctgctcgaatag

SEQ ID NO: 31299 - DNA, 549 bp, Artificial Sequence
  Description of Artificial Sequence: Synthetic coding sequence
atgcctatccctccccctcctcctccacccccagggcctcctcccccacctacattccaccaggccaacacggagcaacctaagcttagccgcgacgagcagagaggtaggggagccctcctccaggatatttgcaaaggaacgaaacttaagaaagtgactaacataaacgacagaagcgcccctatcctggaaaccccgcctccgccaccccctgtgatccgcaatggcgctagagacgcccctccgcctccccctccttaccgcatgcacgggagtgagccacccagccgcggaaaacctcctccccctccaagccgtactccagcgggtcccccacctcctccgcctccaccactgcgcaatggtcaccgcgattctataactactgtgcgttcctttttggatgacttcgagagtaagtactcatttcaccccgtggaggactttcccgctcctgaggagtacaaacattttcaaagaatttacccgagcaaaactaatagagccgcacggggtgccccaccgttgccacccattttgcgatag

SEQ ID NO: 31300 - DNA, 999 bp, Artificial Sequence
  Description of Artificial Sequence: Synthetic coding sequence
atggaccaaccagctggccttcaggtggattacgtcttccggggtgtggaacacgccgttcgtgtgatggtttctggccaggtgctggaactggaagtggaagaccgcatgaccgccgatcaatggcggggagagtttgacgccggttttatcgaagatctgacacacaaaaccggcaacttcaaacagttcaacattttttgccacatgctggagagcgcgttaacacagtcctccgagtccgtcacattagacctgctcacatataccgacctggaaagcttgcggaataggaaaatgggcggtaggccaggcagtctcgctcccaggagtgctcagctgaacagcaaaaggtacttaattctgatctacagtgtagagttcgaccgcattcactacccattgccgttgccatatcaaggaaagcctgaccccgtagtgctccagggaattataagaagtctcaaagaggagcttggccgactacagggactggatgggcagaacactagagataccagggaaaacgaaatttggcatttgcgcgaacagcagcaacaaaggaatcgtctgggctcaggaggctctggtgacggcccttcggtgtcttggtcgcgccagacccagcctcccgcagccctgaccgggagaggggatgcacccaaccgctcacgcaacaggtctagcagtgtcgattctttcaggagccggtgttcatccgcttcctcatgtagcgatcttgaggactttagcgagtctctgagtcggggtggccatcggcgacgaggtaagcccccttccccaacaccgtggtccggctctaacatgaagagcccccctgttgagaggtctcatcaccagaaaagcctggccaattcaggagggtgggtgcccattaaggagtatagctcagagcatcaggccgcagacatggcagagattgatgccagactgaaagcactgcaagaatacatgaatcggctggacatgaggagttag

SEQ ID NO: 31301 - DNA, 516 bp, Artificial Sequence
  Description of Artificial Sequence: Synthetic coding sequence
atgtcctcaaaaaggacaaaaactaaaactaaaaaaaggccacagcgggctacctccaacgtgttcgccatgttcgaccagtcccagattcaggaattcaaagaggcgttcaacatgatcgaccagaatcgggatggcttcatagataaagaggatctccacgatatgcttgcctccctcggcaagaacccaaccgatgaatacctagatgccatgatgaatgaagcccctgggccaatcaattttaccatgtttctcacgatgtttggtgagaaactgaatgggacagacccggaagatgtaattagaaacgcatttgcctgctttgacgaggaagcgacaggcactatacaggaggactatctgcgagaattgttgacaacaatgggtgatcgatttacagacgaggaagtggacgagctttaccgtgaggcccctatcgacaaaaaaggtaattttaactacattgagtttacccgtatattgaagcatggagcaaaggataaagatgattag

SEQ ID NO: 31302 - DNA, 2391 bp, Artificial Sequence
  Description of Artificial Sequence: Synthetic coding sequence
atgagtctggacgacaacctgtcaggcacgtctggcatggaggtggacgacagagtgtcagcccttgaacagcgcctgcagctccaagaggatgaattggccgtgctaaaggccgctcttgcagatgccctccgccgactccgggcttgcgaagaacagggagcggctttgcgggctcgcggaactcccaagggaagggcccctccacgacttggaaccactgcctccgtgtgtcaattattaaagggccttcccactaggactcctctcaacggctcagggccacctcgacgcgtggggggttatgccacatcaccatcttcacccaagaaagaagcaacttccggccgatctagtgtgcgcaggtacctaagcccagaacgactagccagcgttcgtagagaagaccctcgttctaggaccacttcatcaagcagcaattgtagcgctaagaaagaagggaagacaaaggaggttatcttttcagtggaagatgggagcgtgaagatgttcttacgcggtcgtccggtgccaatgatgatacctgacgaactcgcgccaacctattcactcgatactcgatctgagcttccttcttgcagactgaagcttgaatgggtgtacggctatcggggacgggactgtcgagcaaatctctacctgttgcctaccggtgaaatcgtatacttcgtggccagcgtggcagttctgtactctgtggaagagcagcggcaaagacattacctggggcacaacgatgacatcaaatgcctggccatccaccctgacatggttaccatcgcgactggccaggtggccggaaccacgaaggaaggtaaaccgttaccgcctcacgtgcgcatctgggactccgtttccctctcaacactgcacgttctagggttaggcgtttttgatagggcggtgtgctgtgtcggcttcagcaagagtaacggtgggaatttactgtgcgctgtagatgagagtaatgatcacatgctgagtgtttgggactgggccaaggagacaaaggtggtggacgtcaaatgttccaacgaggctgttctcgttgctacatttcatccgaccgatcccaccgttctgatcacctgtggaaagagccacatatacttttggaccctggaaggtggcagtctgagcaagcggcagggactgtttgaaaagcacgagaagccgaagtacgtactctgcgtcaccttcctggagggtggcgatgtggtgaccggggactcaggcggaaatttatatgtgtggggcaaagggggaaatagaatcacacaggctgtgctcggtgcccatgacgggggagtgtttggcctatgcgcgcttcgagacggtacactggtgagcgggggaggcagggaccggcgtgtagttctctggggtagcgactacagcaagctgcaagaggttgaagtgcctgaggattttgggcctgtgaggaccgtagccgaggggcacggtgatactctgtacgttggcactacacggaatagtattctgcagggttctgtccacacaggctttagcttgctggtccagggccacgtggaggaactttggggtctggcgacccatcctagtcgcgcacaattcgttacttgcggtcaggacaaactggtgcatctgtggtctagtgatagccatcagccactgtggtcgcggatcattgaagaccccgctcgttctgcaggattccatccctcaggtagtgtgttggccgtgggtacagtgacaggacgctggctcctcctcgataccgaaacacatgacctcgtcgccatccacacagatggcaacgaacagatctccgtggtttcctttagcccagatggggcatatctcgcggtcggcagccatgacaacctcgtgtacgtgtatacggtagatcagggtggccgtaaggtgagccggctgggcaagtgctctgggcattcttcctttataacccacttagattgggctcaggacagctcttgcttcgtaaccaactcaggcgactatgagattctctattgggatcccgctacctgtaagcagataactagtgctgatgcagtccgcaatatggagtgggcgacagctacatgcgtgctgggcttcggcgtttttgggatttggtcagaaggcgcagatggtacagacatcaacgccgtggcgcgaagtcatgacggcaaactgttggcatccgcagacgacttcggaaaagtgcacttattctcctacccttgctgtcagcctcgtgcgctcagtcataagtacggagggcattctagccacgttaccaacgtcgcctttctctgggatgacagcatggcactcacaactggaggcaaggacacgtccgtcctgcagtggagagtcgtgtag

SEQ ID NO: 31303 - DNA, 1059 bp, Artificial Sequence
  Description of Artificial Sequence: Synthetic coding sequence
atggcactgctcgggcaggcacttaagtggcagcagcaccagggactgctccctcctggcatgacaatcgatttatttagggggaaagctgccgttaaagacgttgaggaagaaaagtttccaacacaactcagccggcacatcaagtttggtcagaaaagtcatgtcgaatgtgccagattcagcccagatgggcagtatttggtgactggttcagtcgatgggttcatcgaagtgtggaacttcactacgggaaagattcgcaaggatctgaagtatcaggctcaggacaatttcatgatgatggacgacgcagtgctatgtatgtgcttttccagagacactgagatgctagccaccggagcacaggacggaaagattaaagtgtggaagatccagtccggccaatgcctgcgcagatttgaacgtgctcactctaagggagtcacgtgcctgtctttttctaaggactcttcccagatcctgagcgccagtttcgatcagaccatacgcatccacgggctgaaatccgggaaaacacttaaggaatttcgagggcactcgtccttcgtgaatgaggcaacctttacccaggacggccactacatcataagtgctagcagcgacgggaccgtgaaaatctggaacatgaaaaccacagagtgttctaatacctttaagtctcttggatccacagctggtaccgatataactgtgaacagtgtgatcctgctgcccaagaatccggagcattttgttgtgtgcaacaggtctaataccgtggtcatcatgaatatgcagggacagatcgtgagatccttttcttccgggaagcgagaagggggtgacttcgtgtgttgcgcactttcccccaggggcgaatggatatactgcgtaggggaagactttgtactgtactgcttttcaaccgtgacgggaaaattagaacgcactttaactgtccacgaaaaggatgtcatcggcattgctcatcatcctcatcagaatctgattgccacctattccgaagatggccttctgaagttgtggaagccttag

SEQ ID NO: 31304 - DNA, 951 bp, Artificial Sequence
  Description of Artificial Sequence: Synthetic coding sequence
atgcaatcgtgggtgcttatctcgaaggagctgatctccctgctccacctgagtttgttgcatttggaggaggataagactacggtctcccaggagtcgcggagggcagagacattggtgtgctgctgtttcgatctgctgaagaaactcagagcaaagctgcagtcgctcaaagccgagcgtgaggaagccaggcacagggaagaaatggctctgcgaggcaaagatgccgcagagattgtcctggaagcgttctgcgctcacgcaagccaacgcatatcccagctggaacaggacttagcctccatgagagaattccggggattgctgaaagacgcccaaacacaactggttggtctgcatgcgaaacaggaggaattagtgcagcaaactgtttctctgacctccaccctacagcaggactggagaagtatgcagctggactacactacctggacagcactactgagcagatcgcggcagctcacagagaaacttacagtcaagagccagcaagctctgcaggagcgggacgtggccatcgaggaaaaacaggaggtctcacgcgtgctggagcaggtgagcgcgcagctggaagagtgtaaaggtcaaacagaacaactggagctggagaatagtcgtttggccactgacctgcgcgcacagctgcagatcctcgcgaatatggattcacagctcaaagaactgcagagtcagcatactcattgcgcccaggacctggcaatgaaagacgagctgctgtgtcagttgactcagagcaatgaggaacaggctgctcaatggcagaaggaagaaatggccctcaagcatatgcaagctgagctgcagcagcagcaggccgtgctggccaaggaagtgcgcgatctaaaggagacactagagttcgcagaccaggagaaccaggtcgctcacttagagctggcttggtag

SEQ ID NO: 31305 - DNA, 597 bp, Artificial Sequence
  Description of Artificial Sequence: Synthetic coding sequence
atgactcttagatgcttggaaccctccggtaatggcggagaggggacccgcagccagtggggaacagcgggatctgctgaagagccttcgcctcaggccgctagactcgcaaaagcccttagggagctcgggcagaccggctggtactgggggagcatgaccgttaacgaagccaaggagaagctcaaagaagcgccagaggggactttccttatccgcgatagtagtcacagtgactaccttctgaccatctccgtgaagaccagtgcagggccaaccaaccttcggatcgagtaccaagatggtaagttccgcctcgattcgatcatttgtgtcaaatctaaactgaagcaattcgattcagtagtccacctgattgattactatgtgcagatgtgtaaggacaagcgcacgggccctgaagcgcctcgaaacggcacggtgcacctgtatttgacaaaaccactatataccagtgcccctagcttgcagcatctgtgccgactgactatcaacaaatgtactggcgcaatttggggtcttcctctgcccactaggctgaaggattatttagaagaatataagtttcaagtgtag

SEQ ID NO: 31306 - DNA, 591 bp, Artificial Sequence
  Description of Artificial Sequence: Synthetic coding sequence
atggtgccgcgtccttggtccggcagcccagggccaggagaatgccttcacagtctattgtctgagcggctttggatttgtcgagacatcagcgcccaacggcgatccgctccaggctcccctcgacctagcgactgccagcagctctcgttcctccccggaaaccaacccaccttcctctgtctccaggcactagctgccctagtccccggagtcacccaggtcgataacaagtccggctttctgcagaagagacctcaccggcagcatcccggaatcctgaagctccctcacgtccggctgccacaggccctggcaaacggcgcacagttgctactgttggggtcagccggtccaacgatggagaatcaggttcaaaccctcacctcttacctctggagccgccatctcccggtagagcctgaggagctacagaggcgggcacgccatcttgagaagaagttcctagaaaaccctggtccagatttccagtcgctgttctcaccacagacctacctgagacagagacgcaactttgtagaacaatgttatacgcattacgtgaaattgcccactatcggaaagaactag

SEQ ID NO: 31307 - DNA, 1131 bp, Artificial Sequence
  Description of Artificial Sequence: Synthetic coding sequence
atgcctgatgtggttcagacacggcagcaggcttacagggacaaactagctcaacagcaggcagcggcagccgctgcagcggcagcggcagcgagccagcagggaagtgccaagaacggggaaaatacagccaatggtgaggagaatggtgcacacacaatcgctaggatctggaacctctctgagaattcgacttccgggtctacgcagctggtgctgcggcattgcattcgggaaggaggccaagacgtcccatcaaacaaggatgtgaccagcctagactggaattccgagggaaccctgctagctactggctcctacgatgggtttgcacgcatttggaccaaggacgggaacctagccagcactctaggacagcacaaggggcctatattcgccctaaagtggaacaagaaagggaattttatccttagcgccggtgtggataagaccactataatatgggacgcacacaccggggaggctaaacagcaattcccatttcattccgcccctgctctagacgtagactggcaaagcaacaacacctttgcatcttgctctaccgatatgtgcattcatgtttgcaaactgggtcaagacagacccatcaaaacatttcaagggcacacaaacgaggtgaatgctataaaatgggaccctacaggcaatttactcgcgagttgctccgatgatatgactctgaaaatctggtcaatgaaacaggacaattgcgtccacgaccttcaagcgcataataaagaaatttacaccatcaaatggtctccaacgggcccagggaccaataaccccaatgctaaccttatgctggcctccgcctcgttcgacagtactgtcaggttgtgggatgttgacaggggcatttgcatccacactttaaccaaacatcaggaaccagtatattctgtggcctttagtcccgacgggcgatacctcgcaagcggttcgtttgacaagtgcgtccacatttggaacacccaaaccggcgctctcgtgcactcatatcgcggtactggtggaatcttcgaggtgtgttggaatgccgcaggcgataaagtgggtgccagcgcttctgacgggtcagtgtgtgtcctcgaccttaggaaatag

SEQ ID NO: 31308 - DNA, 1116 bp, Artificial Sequence
  Description of Artificial Sequence: Synthetic coding sequence
atgcatatcaaatctataatcctcgaaggatttaaatcatatgcccagaggaccgaggtgaatggcttcgaccctttgttcaatgctatcactgggttgaacggaagtggcaagtctaatatactggatagcatttgtttcttactggggatctccaatctctcacaagtacgagcttctaacctgcaggacctcgtttacaagaatgggcaagccggaatcaccaaggcgagcgtttctattacctttgacaattcggacaaaaagcagtctcctctaggcttcgaggtacacgacgaaattacggtgacgcgtcaggttgtgatcgggggacggaataagtacctgattaatggagtcaacgctaataacactcgggttcaggacctgttctgcagtgtcggcctgaatgtgaacaacccgcacttcctcattatgcagggccgtattacaaaggtgttgaatatgaagccgcctgagatattatccatgatcgaggaggccgctggtacaaggatgtatgaatataaaaagatagccgcacagaagactatcgagaaaaaggaggccaagctcaaggagattaaaactatactcgaggaggaaataactccaacgatccagaaactgaaagaggagcggtccagctacctcgagtaccagaaagtgatgcgggagatagagcatctgagtcgcttgtatattgcctaccagttcctcctggctgaggatacaaaagtaagaagtgcagaggagctaaaggaaatgcaggacaaggtaattaagctccaggaagagttgtccgagaatgacaagaaaatcaaagcattaaatcacgagatcgaagagctcgaaaagagaaaagataaagagacgggcggaattttgaggagcctcgaagatgccctggccgaggctcagcgggtgaacactaaatcccagagcgcgtttgatttaaagaagaagaacctggcgtgtgaggagtcaaaacgtaaagagctcgaaaagaatatggtcgaggatagtaagacattggctgctaaggaaaaagaaaagattaagagaaaagccttctggaagtctgctggctcgtgccttgtgatcctggttgattag

SEQ ID NO: 31309 - DNA, 507 bp, Artificial Sequence
  Description of Artificial Sequence: Synthetic coding sequence
cataagttgcagtccggaattggtcggctgatcctgaaggaggaaatgaaggcaagaagcagctcctatgcagacccctggaccccaccacgctcctccacatcttcccgagaggccttgcacactgccggatacgagatgtccctgaacgggagcccccgttcccactatcttgccgattcagacccactgatttccaaaagcgcatctctcccagcctacaggcgcaacggactgcatagaaccccaagcgccgatctatttcattacgactccatgaatgcagtgaactggggcatgagggagtacaaaatctacccctacgaactactactcgtcacgaccagagggaggaatcgcttacctaaagatgttgaccgaacacgactggaacgacatctgtcccaagaggaattttatcaggtgttcggaatgactatctcagagtttgaccgtttggcactgtggaagaggaacgagctcaagaaacaggcgagactcttttag

SEQ ID NO: 31310 - DNA, 1770 bp, Artificial Sequence
  Description of Artificial Sequence: Synthetic coding sequence
atgtccgtttccgtgcatgaaactcggaagtcaagaagctcaactggatcgatgaatgttacactgttccacaaagcttcccatcccgactgcgtcctggcccacctaaatacgctgcgcaagcattgtatgttcaccgacgtgaccttgtgggccggtgatcgggcattcccatgccatagggccgtgctggcggcttcttctcggtacttcgaggccatgttcagtcacggactgagggagtctagggacgacactgtgaattttcaagacaacctacaccccgaagtgctcgaactcctgcttgattttgcctactcttcacgcatcgccattaacgaagagaatgccgaaagcttgttggaggctggagatatgctgcagtttcatgacgtgcgagatgccgcagccgagttccttgaaaagaacctctttcccagcaattgtctcgggatgatgcttctgtcagacgctcaccagtgtaggaggttatatgaattctcctggagaatgtgtttagtacatttcgagacggtgaggcagtcagaggactttaacagcctgagtaaagatacactgctggatctcatctcttccgatgagttggagacggaggatgaaagagttgtctttgaagccatcctgcaatgggtgaaacatgatctggagcctagaaaggtccacctcccagagctgctgaggagcgtgcgactcgctctactgccctctgattgtctccaagaggctgtgagctccgaggctctacttatggcggatgaacgaaccaaattgatcatggatgaggcccttcgttgtaaaacgcgcatcctgcagaacgatggagttgttacatccccgtgcgccagacctaggaaggctgggcatacccttctcatcctgggagggcagactttcatgtgtgataaaatataccaggttgaccataaagccaaagagattattccaaaggcagatctacccagcccaaggaaggaattctcggcaagtgccatcggttgtaaagtgtacgtgacgggcggacgaggatcagagaatggagtctcgaaggatgtgtgggtgtacgatactgtccacgaggaatggtcaaaggccgcaccaatgctgattgccaggttcggtcatggcagtgctgagcttgagaactgcttatacgtggtcggcggacataccagcctggctggcgtctttcccgcaagcccttccgttagccttaagcaggtagagaagtacgaccccggagctaataagtggatgatggtagctccactgagggacggggtgtctaatgccgcagttgtcagtgcgaaactcaaactgtttgtgttcggcggaacttcaatccaccgagatatggtctcaaaagtgcaatgctatgacccatctgagaatcggtggactatcaaagcagaatgtccccaaccctggaggtatactgccgcagccgtgctgggttcccagatattcattatgggtggtgacaccgagtttacagccgcatctgcctatagatttgattgtgaaacaaaccaatggactcgcatcggagacatgactgcgaaacggatgagttgtcatgctttggctagtggtaataaactgtacgtcgtgggtggatattttggaacccaacgctgcaagactctggattgttatgacccaactagcgatacgtggaactgtatcaccactgtgccatattcactcattcctactgcttttgtcagcacatggaaacacctcccagcctag

SEQ ID NO: 31311 - DNA, 1287 bp, Artificial Sequence
  Description of Artificial Sequence: Synthetic coding sequence
atgtcaatgcttaagccctcaggtctgaaagcccctactaagattctgaaacccggaagcaccgcgcttaaaactcctacagcggtagtcgcccctgtggagaaaaccatttcatccgagaaagccagttccactcccagcagcgagacacaggaagagtttgtggacgactttagggtgggtgagcgggtgtgggtgaacggtaacaaacccggttttattcagtttcttggtgagacccagtttgccccaggtcagtgggcgggaattgtgctggacgagcccataggtaagaacgatgggtctgtggctggtgtaaggtattttcagtgtgaacctctcaaaggcatatttaccaggccatccaagcttaccaggaaagtgcaggccgaggacgaagccaatggactccagaccacacctgcttcccgggctacatcaccattgtgtacttctactgcctccatggtgagcagttccccatccaccccctctaatattcctcagaagccgtctcagcctgccgctaaggaaccaagcgccacacctcctatctccaatctgacaaagactgcatctgaatctatctccaatttatccgaggcgggatccataaagaagggcgaaagagaactgaagatcggggatagagtcttggtgggaggaaccaaagcaggagtggttcgcttcttgggggagacggattttgccaaaggggaatggtgtggcgtggagctcgatgaaccgctgggtaaaaacgacggagcagtggctgggacccggtactttcagtgtcaaccaaaatacggcctgtttgcacccgttcataaggtgaccaaaatcggttttcctagcacaacacccgctaaagctaaggccaatgctgtgagaagagtgatggccaccacgagcgctagcttaaaacgcagcccttccgccagcagtctttcatccatgagcagtgtggccagttctgtttcctccagaccatcgcgcaccggtcttcacgttctggagctggaagcaaaaatggaccagcttaggactatggtcgaagccgcagaccgagagaaggtcgagttgttaaatcagctggaagaggaaaagaggaaagtcgaggatcttcaattcagagtagaagaggagtccattactaagggggacctggaacaaaagtctcagatctccgaagatcctgaaaacgtccggggacaccttaccgtgtggatctttcctctgctgactaagatcgaccacaggctgaagtgtctgttgatctactcatag

SEQ ID NO: 31312 - DNA, 3483 bp, Artificial Sequence
  Description of Artificial Sequence: Synthetic coding sequence
atggtggtgaccctcggcccaggacccgattgtctgatcttggaagcctcccgtcaaccccagctggtacccaaacccgagagaatggccagcgacggcgcaagcgctctgcctggaccagatatgagcatgaagccatctgccgcacccagcccaagccctgcgctgccatttctcccccctacaagcgacccaccagaccacccccctcgcgaacctccacctcagcctatcatgccctccgtgttctctcccgataatccactgatgctgtctgccttcccctcgtctctgttagtgaccggagatggcggtccatgtctatctggagctggcgcaggaaaagttatcgttaaggtaaaaacggagggtggcagcgccgagcctagtcagactcagaactttatcttaacacagaccgctctgaattccactgcccctggaactccatgcgggggactcgaagggcctgcacctccgtttgtaactgcttccaatgtgaagacaatcctcccttcaaaagctgtcggtgtgagccaggagggaccaccagggctgcccccacagccaccaccccctgtggcacagttggtgccaatcgtcccattagagaaagcgtggcccggtccccacggtacaacaggagagggaggacccgtggccaccctttcaaagccatcactgggcgaccggtctaagatatcaaaggacgtgtatgaaaactttcgccagtggcagcgctacaaagccctcgccagacggcacctgagccagagccctgatacagaagctcttagctgtttcctcattccagtattaaggagcttggctcgacttaagcctactatgaccctggaagagggccttccactggccgttcaggagtgggagcacaccagtaatttcgatcgcatgatcttttatgaaatggccgagagatttatggagtttgaggcggaggaaatgcaaatccagaacacccaattgatgaatgggtctcagggactgtcgcctgcaaccccactcaagctcgacccattaggcccactcgcgagcgaggtatgccagcagcctgtgtatattcccaagaaggctgctagtaaaactcgggctcccagaagacgccagcgaaaagcccagagacctcccgctcccgaagccccaaaggagataccccctgaagccgtgaaggagtatgttgacatcatggagtggcttgtgggcacacatctggccaccggcgagagtgatgggaaacaagaagaggaggggcagcagcaagaagaagaaggcatgtaccccgatcctggcctgctcagttacatcaacgaattgtgcagtcagaaggtattcgtctcaaaggtggaggcagtgattcatcctcaatttttggccgacttgctgtcaccggagaaacagagggacccactggcactgattgaggaactggaacaggaggaagggctaacgctagcccagctggtccaaaagagactaatggcactcgaagaggaagaagacgccgaggcacctcccagcttttccggagcacagctagattcaagcccttcagggtccgtcgaagatgaggacggagatggtagacttaggccgagccccggtctgcagggagctggaggagcggcatgtttgggcaaggtgagttcctctggcaaacgcgctcgtgaggtgcacggcggacaggaacaggctctcgattcgcccagggggatgcacagagacggcaacacgttgcctagccccagttcctgggacctgcagcctgaattagctgcgccacagggcacgcctgggcctctcggtgtggaaaggcgcggttctggcaaggttattaatcaggtgtcactgcaccaagatggtcacctggggggagccggtccccctggccactgcctcgtggctgatcggacttccgaagctcttcccctctgctggcagggagggtttcaaccagagtctacaccatctctagatgctggattggccgagcttgcacctctccagggccaaggcctggagaaacaagtgttagggctgcagaaggggcagcagactggaggccgtggagtactcccccagggaaaggaaccgttagcggtcccatgggagggatccagcggagctatgtggggtgacgatagaggtaccccaatggcacaaagttatgaccagaacccaagccccagagctgcaggcgaaagggacgatgtgtgtctgtccccaggggtatggctgagcagtgagatggatgcggtgggtttggagctgccagtgcagatagaagaggtcattgagtctttccaggtggagaagtgcgtgaccgaataccaagaaggatgccagggactgggatccaggggcaacattagcttaggcccaggcgaaactctggtaccgggtgacacggaatcctcagtcatcccgtgcggtggtacagtggcagctgccgctctggaaaagagaaactattgtagtctgcccggaccattgagagccaattcaccacctttaaggagtaaagaaaaccaagagcagagctgcgaaaccgtgggccatccgagcgatctttgggcagaaggctgttttccactgctcgagtccggggactctaccctgggcagcagcaaggagaccttaccaccaacatgccagggaaatttgctgatcatgggcacagaagatgcatcgagtcttcctgaggctagccaggaggccggttcacgaggcaactccttctctccgttattggagaccattgagcctgtcaatattctggatgtgaaggacgattgcggtttgcagctgagagtttcggaggacacgtgcccactcaacgttcattcttatgatccccaaggagaggggcgagtcgatcctgatcttagtaagccaaaaaaccttgctccgctgcaagagtctcaggaatcctatacgacagggacaccgaaggccacaagttcccaccaaggactcgggtcgactttgcctcgcagggggactcggaacgccatcgttccccgtgaaacctccgtgagcaagacacatcggagtgccgaccgggctaagggtaaggaaaaaaagaagaaagaggccgaggaagaggatgaagagctctctaatttcgcgtacctgctggcaagcaaactgtctttgtcccccagggagcaccctctgagtccccatcacgcatcgggtggccaagggtcacagcgggcatcccacctccttcctgctggcgcaaagggcccaagcaagcttccttaccccgtggcaaagagtggaaaaagggcattggccggagggcctgccccaaccgagaaaaccccacattcgggggctcagctcggcgtccccagggagaagcccctggccctgggcgtagtccgccctagccaaccccgtaagcggaggtgcgacagtttcgtgaccgggaggcggaaaaagcggcgtaggagccagtag

SEQ ID NO: 31313 - DNA, 1548 bp, Artificial Sequence
  Description of Artificial Sequence: Synthetic coding sequence
ctcaatagccagtgccgaaataaaaatccattcgccgctggtccgaggccccctcaccatcagttcttccagcgtcctcagatacagccccctcgcgcaaccatccccaatagttccccatccattaggccgggtgcccaaactcctaccgccgtctatcaggcaaaccagcatatcatgatggtaaatcacctcccaatgccctatcctgtaccccagggcccacagtactgcatcccccagtaccggcacagcggcccaccctacgtcggcccaccgcagcaataccccgtgcaacctcccggtcctgggcctttttaccctggccctggcccaggggattttcctaatgcctacgggaccccgttttatcccagccagccagtgtaccaaagtgcacccattattgtgcccactcagcagcagcccccaccagctaaaagggagaagaagactatacgcattcgcgatcctaatcaaggcggaaaagacatcactgaagaaatcatgtcaggcggaggcagtagaaatccaacgcccccaatcggtaggccgactagtacccctacacctccccagcagttaccatcccaggtgcctgagcatagcccggtcgtgtatggaacggtggagagcgcacacttggcagcgagcacacccgtcaccgcagcttccgatcagaagcaagaagaaaagcctaaaccagatcccgtcctgaagtccccatcacctgtgttacgactggtgcttagtggggagaagaaggaacaggagggccaaacctcagaaacaacagccattgtctctattgcagagctgccccttccaccatcgcctacaacagtgtccagcgtcgctcggtctaccatagctgcgccaacctccagcgccctaagctcacaacccatttttaccacagcaattgacgaccgatgcgagctgtcttccccacgggaggacaccatcccaattccatcactgacttcctgtaccgagactagtgatcctttgcccactaacgagaatgacgacgacatctgcaaaaagccttgttcagttgcccctaatgatatccctttggtgtcaagcactaacctcattaatgagatcaatggagtgtccgaaaaactgtcggccacagagtctatcgtggagatcgtgaaacaagaggtgctgcctctgacccttgaactggagatcctggaaaatcccccagaggaaatgaaactagaatgtatacctgcaccaattactccctccaccgtgccctcattccctccaactccccctactccgccagcgtccccacctcatacccctgtgattgtgcctgccgcagccactaccgtaagcagtccatcagccgctatcaccgtccagagagtcttggaagaggacgaatccattcgtacctgcttgagtgaggacgcaaaagaaatacagaataagattgaagttgaggccgacggacagactgaggaaatcctggactctcagaatctcaactctagacgctcccctgtccccgagacatccaacgagtgttag

SEQ ID NO: 31314 - DNA, 204 bp, Artificial Sequence
  Description of Artificial Sequence: Synthetic coding sequence
atggcccttctcgcagaacacctacttaagcctctccccgctgataagcaaatagagaccggaccttttctggaggctgtcagccacctgcctccgtttttcgactgtctgggatctcccgtcttcaccccaattaaggctgacatttccggaaatatcactatgagaaagctacgactgcgcggtgtcgaggggctggcttag

SEQ ID NO: 31315 - DNA, 2418 bp, Artificial Sequence
  Description of Artificial Sequence: Synthetic coding sequence
atgatgcagaatgtccacctggccccagagacagacgaggacgatctgtactccggttataacgattataatcctatctacgacattgaggaactcgaaaatgacgcagccttccagcaagccgtgaggacaagccatggaagacggcctccttcgaagacatccttggcaagcagtatcggcaggccaatgacaggcgctattcaggacggagtcaccaggccaatgaccgccgtccgcgcagccggtttcactaaggccgctcttcgaggctctgcttttgacccgttgagtcagagcaggggtccggctagcccgttggaggctaagaagaaagattcccctgaggagaagatcaaacagctggagaaggaagtcaacgaactcgtggaggaatcttgcatagccaactcatgcggagacttaaaactcgctctcgagaaggccaaggatgccggaaggaaagagagagttctggtgcgacagagagaacaggtaacaacaccagaaaatattaatctggacctgacatacagcgttctcttcaacctggcttctcagtactccgtcaatgagatgtacgctgaggcactgaatacatatcaggtgatcgtaaagaacaagatgttctcaaacgcgggtattctaaaaatgaatatggggaacatctatctgaaacaacgcaattattccaaggcaatcaaattctatcgcatggcgttggatcaagtgccctccgtgaataaacaaatgcgcattaagatcatgcagaacattggcgttacatttattcaggccggtcagtatagtgatgcaatcaacagttacgagcacatcatgagtatggctccaaatcttaaggccggttacaaccttacaatctgttacttcgctatcggagaccgcgagaagatgaagaaagcattccaaaagctcattacagtgcccctggaaatcgatgaggacaaatatatctcgccctctgatgacccacacacaaacctcgtgacagaggctatcaaaaacgaccacttacgtcaaatggaaagagagagaaaagcgatggcagagaaatacattatgactagcgccaaactcattgcccctgttattgagacctcatttgccgctggttacgactggtgtgttgaggtagtgaaggccagtcagtacgtggaactagccaacgatctggagataaacaaggctgtgacctacctgaggcaaaaggattacaatcaggctgtagaaatcctcaaggtgctagaaaagaaagacagccgggtcaagtccgcggcagcaacaaatctgtcagccctgtattacatggggaaggattttgctcaggccagctcatatgctgacatcgcagtgaactcagatcgttacaaccccgcagcactcactaacaaggggaacactgtgtttgctaacggcgattatgagaaagctgccgaattttataaggaggccttgagaaatgacagctcctgcacggaggccctatacaatataggtcttacatatgaaaaactcaaccggttggacgaggctctcgattgcttcctcaagctgcacgctattctgagaaactccgcagaagtcttgtaccagatcgcaaatatctatgagctaatggaaaacccctctcaggcaatcgaatggctcatgcaagtcgtgagcgtgatacctaccgatccacaggttttgtctaagctgggtgagctctacgacagagaaggggataagagccaggccttccagtactattacgagagctatagatacttcccctgcaacattgaggttatcgagtggctaggcgcttattacatcgacacacagttctgggaaaaggccatccaatattttgagcgagcctccttgatccaaccaacgcaggtgaagtggcagctaatggtcgcttcttgcttccgccgtagtggcaattatcagaaagcactggatacttataaggacacccataggaaatttcccgagaacgttgagtgcctgagatttcttgtgcgcctatgcacagatcttgggctcaaagacgcacaggagtacgccagaaaacttaagaggctggagaaaatgaaagaaattagagagcaacgaataaaatccggaagggacgggtcaggcggatcccgtggcaaaagagaaggttcggccagcggtgattctgggcagaattattctgccagttcaaaaggagagaggctctctgctagattgcgtgctctgccgggaacgaacgagccctatgagtcgagcagcaataaagagattgatgcctcatacgtggaccctctgggaccacagatcgagagacccaaaactgctgctaagaagcgtatcgatgaggacgattttgccgatgaggaactgggagatgacctgctgccagaatag

SEQ ID NO: 31316 - DNA, 765 bp, Artificial Sequence
  Description of Artificial Sequence: Synthetic coding sequence
atggcaccaggatcattcgcagagtatacggtggtgcccgctagcattgccactcccgtgccaagcgtgaagcccgagtatttgactctcctggtgtccggcaccacggcctacatatccctaaaagagctgggcggattgtcggagggcaagaaagtactggtcaccgccgcagctgggggtaccgggcaatttgccatgcagctcagtaaaaaagctaaatgtcacgtaatcgggacttgcagcagtgatgaaaagagcgcgttcctgaagagccttggttgtgacagaccgattaattataagacagaaccagtgggtaccgtactaaaacaggagtacccagagggggtggatgtagtttacgagagcgtgggcggtgcaatgttcgatctagcggtggatgctttggctacaaagggaaggcttatagtcattggattcatttctggatatcagacccccacgggtctctcccctgtgaaggccggtacgcttccagcaaagttgctcaagaaatcggcatccgtgcagggcttcttcctgaaccactatttatcgaaatatcaggccgcaatgtctcacctcctggagatgtgtgttagcggagatctcgtgtgtgaagttgacttaggcgatctgtcccctgagggtcgctttaccggactggaatccattttccgggctgttaactatatgtacatgggaaagaataccgggaagatcgtagtagagctgccccacagtgttaattccaaactctag

SEQ ID NO: 31317 - DNA, 1212 bp, Artificial Sequence
  Description of Artificial Sequence: Synthetic coding sequence
atgcatcaccccattcaaatgaagcctgccgattctgagaagagtaacgccgtagaggacagaaagctgtttatcggcatggtatctaagaaatgcaacgagaacgacattagagttatgttctcaccgtttggtcaaatcgaagagtgccgaatccttcggggtcctgatgggttgagccgcggatgtgcttttgttacattttccacacgggcaatggcgcaaaacgcaattaaagctatgcatcagtcacagacaatggaaggctgttcgtcccctatagtagtgaaattcgcagatacacaaaaagacaaggaacagcgcaggctgcagcaacagctggcccaacagatgcagcagctgaacaccgccacctgggggaacctgaccggactgggcggattaacccctcagtacctcgcccttcttcagcaggccacgtcctcatccaatcttggagctttttcaggaatccagcagatggcaggaatgaacgctctgcagctgcagaacctggccaccttggctgctgccgcagctgctgcacagacgtccgccacatctactaacgcgaatcccttgtctacaaccagcagcgccctgggtgctctgacttcccccgtggctgcatctacacctaattccactgctggtgccgctatgaactctctgacttcattgggaacgctccaaggcctggcgggtgccaccgtgggtctgaacaatattaatgcgttagcagttgctcagatgctgtctgggatggctgcactaaacggcggtctgggggctacaggattgaccaacgggaccgcgggaacgatggatgccctcacacaggcctactctggcatccagcagtacgcagcagctgctttgcccaccctctattcccagagtctccttcagcaacagtcagctgcaggcagccaaaaagaaggcccagaaggcgcaaatcttttcatctatcatctgccccaggagtttggtgatcaagacatcttacaaatgttcatgccctttggaaatgtgatctccgccaaagttttcatcgacaagcagacaaacctctctaagtgcttcggtttcgtgtcctacgacaatcccgttagtgctcaggcagccatccaagccatgaatgggtttcagattggtatgaagcgcctcaaagtccaactcaaacggagcaagaacgattccaagccgtactag

SEQ ID NO: 31318 - DNA, 1332 bp, Artificial Sequence
  Description of Artificial Sequence: Synthetic coding sequence
atggccgaattcctgaaacaggtgaaaccgtacgttgaagaaggactgcacccacagatcattattcgggcatttcggacggccacccagctagctgtgaataaaataaaggagattgcagtgaccgtgaagaaggccgacaaagtcgagcagcgcaaattgctcgagaaatgtgccatgaccgcgctcagttctaaacttatctcgcagcagaaggctttcttcgctaagatggttgtggacgcagtgatgatgctggacgatctattgcagctgaagatgatcggaatcaagaaagtccaaggcggtgccctcgaggattcacagcttgtagcgggtgttgcctttaaaaagactttttcatacgcagggttcgagatgcagcccaagaagtaccacaaccccaaaattgccctgcttaacgtagaactggaactgaaggcagagaaagataacgccgagattcgggtccatacggtcgaagactatcaagcaattgtggacgccgagtggaacattttgtacgataagctggagaagatacatcacagcggagctaaggtagtgttatccaagctgccaattggagacgtcgcaacacaatattttgctgaccgcgacatgttttgcgcgggtcgagttcctgaagaggatttgaaaaggacaatgatggcctgcggcggtagcattcagactagcgtcaatgctctgtcagccgatgtgctgggtcgctgtcaggtgttcgaagagactcagatcggcggagaaagatataattttttcacagggtgccctaaggctaagacatgcacatttatcctccgaggaggcgctgagcagttcatggaagagaccgaacggtccttacacgacgccattatgattgttcggagggcgatcaagaacgatagtgtcgtcgcaggcggtggagccatcgagatggagctgtcgaaatacctgcgcgactactctcggacgattccgggaaaacagcaactactcatcggtgcctacgccaaggccttggaaataatccctcgccagttgtgcgacaacgcaggctttgatgcaactaacattttgaacaaattaagggcccgacacgcgcagggcggtacgtggtacggcgtggacatcaacaacgaagatatcgcagacaatttcgaggcgttcgtgtgggagcccgctatggtgcggatcaacgccctaacagctgcatctgaagctgcctgtctgatcgtatctgttgatgagactattaaaaaccctcggtcaactgtggatgcaccaaccgctgctggcagggggcgaggcaggggtcggcctcattag

SEQ ID NO: 31319 - DNA, 2193 bp, Artificial Sequence
  Description of Artificial Sequence: Synthetic coding sequence
atgcagctcttcgagcagccttgtcctggcgaggatcccagacccggagggcaaatcggcgaagtcgagttgagtagctacacacccccagcaggcgtccctggcaaacccgcagcaccacattttctgcccgtgctgtgtagcgtatcgcccagtggctctcgtgtccctcacgacctcctcggaggaagcggaggcttcactctggaagacgcgctcttcggattactgtttggagcagacgccactctgttgcaaagccctgtcgtgctgtgtggactgcctgacggccaattgtgctgcgtgatactaaaagccttggtgacttccaggtctgctccaggcgatcccaacgccttggtgaagattctgcaccatcttgaagagcccgtcatttttataggtgcactcaaaacagagccacaagcagctgaggccgctgagaatttcctgcccgatgaagacgtccattgtgattgtctggtagcttttggacaccatgggcgtatgctggcaatcaaggccagttgggatgagagtgggaaactagtgccagagcttcgagagtactgtttgcctggcccagttctttgcgcggcatgcggaggagggggtcgtgtttaccattccacacccagcgacttgtgcgtggtggaccttagtagagggagtacacccctcgggcctgaacagcccgaggaggggcctgggggactgcccccaatgctatgtccggcttccctgaacatatgttccgtggtgagcctgtctgcgtcccccagaacccacgaaggtggcacaaagttgctggcactttccgccaagggacgactgatgacttgctctctggatcttgactctgagatgcccggtccggctcggatgactacagaaagtgctggccaaaagatcaaggaactgctgagcggaattggcaacatctcagaaagagtgtcctttctgaaaaaagccgtcgaccaaagaaataaagccttgacctctctgaacgaggctatgaatgtgagttgcgccctgctgtcgtcaggaaccggccctcggccaatatcatgtacaacgtccacaacctggtcacgcctgcagacacaggacgttctgatggcaacatgtgtgttggaaaactctagctcattcagccttgatcagggctggactctctgcattcaggtgttgacttcaagctgtgccctcgatctcgactccgcgtgcagtgccataacttatactatccctgtggatcagctgggaccgggtgctagacgcgaggtgacactgcctctgggtccaggcgagaacgggggtctggaccttcctgtgactgtgtcatgcaccctcttctatagcctccgtgaagtagtcggcggtgccctcgccccatccgactccgaggatccattccttgatgaatgcccgtcagacgtattacccgagcaggaaggtgtgtgtttacccctgtcacgccataccgttgatatgctccagtgcctgagattcccagggttggccccaccccatacacgtgcacctagcccactgggtcctacacgggacccggtcgcaacattcctcgagacctgccgcgaacccggatcacagcccgcaggacctgcctcgcttcgagctgagtatctgcccccatctgtcgcaagcatcaaggtgtcagctgaactccttcgcgcagctctgaaagatggtcattcgggcgtaccactgtgttgcgccacactacagtggttactggcagaaaatgccgcagtggacgtcgtgagagcacgtgcactgagctctatacagggggtggctcccgacggggcaaacgttcacctgattgttcgggaagtggccatgaccgacctgtgtcccgctggtcctattcaagctgtggagatccaagtggagtcctcctctctggctgacatctgccgcgctcaccacgcggtcgttggccgtatgcagaccatggtcaccgagcaagccacacagggatccagcgccccagaccttagggtccagtacctgagacagatacacgcaaaccatgagacattactacgagaagtccagactcttagggatcgactttgcactgaagacgaagcttcttcatgcgcaactgcacagcgcctgctccaggtatacaggcagctgcggcatccctctctcattttgctttag

SEQ ID NO: 31320 - DNA, 4179 bp, Artificial Sequence
  Description of Artificial Sequence: Synthetic coding sequence
atgtcgatgctaaaacccagcggattaaaggcccctaccaaaatcctgaaacctggtagcacagcactgaaaactccaacagccgtggtcgctccagtcgagaagacaattagcagtgagaaggcttccagcacaccctcttccgagacccaggaggagtttgtggatgatttccgcgtcggagagcgagtatgggtgaacggcaataaaccgggatttatccaattcctgggggaaactcagttcgctcccggtcagtgggccggtattgtgctcgacgagccaatcggcaaaaacgatggatccgtcgccggagtgcggtacttccagtgtgagcccctgaaggggattttcacgcgaccctctaaactcactagaaaggtccaagccgaagatgaggcaaacggccttcagacaacgccagccagtcgcgctacctcacctttgtgcacttcaactgcttccatggtgtccagttcacccagcaccccatctaacatacctcagaaaccctcacagcctgccgctaaagagccttcagcaactccaccaatcagtaatctaaccaagacagcctcagaaagcatatccaacctcagcgaagccggtagtataaagaaaggcgagcgcgagctgaaaatcggagacagagtattggtggggggtacaaaggcaggcgtcgttcggttcctgggggagaccgactttgctaagggggagtggtgtggagtagagctggatgagcccttaggtaaaaacgatggcgcagttgcaggaacccgttactttcagtgccagccaaagtacgggctgtttgctcccgtgcacaaagtgactaagatagggttccccagtacgaccccagcaaaagcaaaagctaacgccgtgaggagagtgatggctaccacaagcgcatcgttgaaaaggtcaccaagtgcttcttcactttcctctatgagcagcgtggcgtctagcgtctcaagcagaccctctcggacaggactgctgacggaaacttcgtcccgctacgctagaaaaatttccggcaccacagctttacaagaggccttgaaagaaaagcaacagcatatcgaacagttgttagcggaaagagatctggaaagagccgaagtggctaaggcaacaagccacgttggcgagatcgagcaggagctggcactggccagagatggccatgaccagcatgtgctggagcttgaggccaagatggaccagctgcggaccatggttgaagcagcggatcgcgaaaaagtggagttgttaaaccagcttgaagaagagaagcgcaaggtggaggatctgcagtttcgggtggaggaggaatccataacgaagggagatctcgaagtcgccacggtgtctgaaaagagtaggattatggagctggaaaaagatctggcattgagggtccaagaagtcgcggagcttaggcgccgactggagagcaataagccagcaggggacgtggacatgtcgctgagcctgctccaggaaatcagctcccttcaggagaaattggaggtgacccgcactgaccatcaacgggagattactagtctgaaagaacacttcggggcacgggaagaaacccaccagaaggagattaaggctctatatacggccactgaaaaactctcgaaggaaaacgagagtcttaagtccaagcttgaacatgctaataaggaaaacagcgatgttatcgcactgtggaagagtaaactggaaactgctatcgcctcccatcagcaggccatggaggagctgaaggtgagcttttcaaaaggcctcgggacagaaacagctgaattcgctgaattaaaaacccagattgagaagatgaggcttgactatcagcacgaaatcgagaaccttcagaaccagcaagactctgaacgagccgctcatgccaaagaaatggaggctcttcgtgcaaaacttatgaaagtcattaaagagaaggaaaactccctggaagccatccggtccaaattagataaggctgaggaccaacacctggttgagatggaagatactcttaacaaattgcaggaagctgagattaaggtcaaagaacttgaagttttacaagcgaaatgcaacgagcaaacaaaggtgatagacaactttacctcacaactgaaggctaccgaggaaaagcttttggacttggatgcgttgagaaaagcatcctctgaaggcaagtcagagatgaaaaagctgaggcaacagttagaagctgccgagaagcagattaaacacttagagattgagaagaacgctgaatccagtaaggcaagtagtatcacgcgtgagctccagggcagggagttaaagctgactaatttacaggaaaatttaagcgaggtgtcccaggtgaaagagacactcgagaaagagctgcaaatcctgaaggaaaagttcgccgaggcatctgaggaggctgtgtctgttcaaaggagcatgcaggagacagtcaacaagctccatcagaaggaggaacagttcaacatgctctcgagcgaccttgagaagctccgcgaaaacctcgccgacatggaggctaaattcagagagaaggacgagagggaggagcagctaatcaaagctaaggagaaattggaaaatgacatcgcagagataatgaagatgagcggcgacaattcgagccagttgacaaaaatgaacgacgaactaaggttgaaggaaagggacgttgaagagctgcagctgaagctcactaaggccaatgagaatgcctctttcctgcagaaatctattgaagacatgaccgtgaaagccgaacaatcccagcaggaagccgctaagaagcacgaggaggaaaagaaggaacttgaaagaaaactttcagatctcgaaaagaaaatggagaccagtcataatcagtgccaagagctcaaggccaggtacgaacgtgcaactagtgaaactaagaccaaacacgaggaaattctacaaaacctgcaaaagaccctcctcgacacagaagacaagctcaagggcgctcgggaggagaactccggtctgttgcaggaattggaggaactccgcaagcaggctgacaaagccaaggcagctcagactgccgaagatgccatgcagatcatggagcagatgacgaaagagaagaccgagacattggctagcctggaagacaccaaacagaccaatgcaaaactgcagaacgagctggatacactcaaggagaataacctcaagaatgtggaagagcttaacaagtctaaggagctgttgaccgtggaaaaccaaaagatggaggagttccgaaaggaaatcgagactttgaagcaggccgctgctcaaaaatcccagcagctgagcgccttgcaggaggagaacgtaaaactggcggaggagctggggaggagtcgtgacgaggtcaccagccatcaaaagctcgaggaagaaaggtccgttctgaataaccagctactggaaatgaagaagcgtgagagtaaatttatcaaggatgccgacgaagagaaagctagtttacagaagtccatttccatcacttcagccttgctgactgaaaaagatgccgagcttgagaaactgaggaacgaggtgacagttcttcgcggtgaaaacgcttctgccaagagcctgcattcggtggtccaaactttagagtcggacaaagtgaaactggaactgaaggtgaaaaacctggaactgcagctgaaagaaaataaaagacagctcagttcgtccagtggaaataccgacacccaggcagacgaagacgagcgcgcacaggagtcccaaatcgattttttaaacagtgtgattgtcgatttgcagcggaagaaccaggacctgaagatgaaggtagagatgatgtctgaagctgcactgaacggaaatggtgacgatctgaacaactacgacagcgacgaccaagaaaaacaatcgaagaagaagccacgtcttttctgcgacatctgcgactgttttgacttgcatgacaccgaggactgccctacccaagcccaaatgtccgaagatccgcctcatagtactcaccacgggtctaggggcgaggagaggccgtattgtgagatctgcgaaatgttcgggcattgggcgaccaactgtaacgacgacgagacattttag

SEQ ID NO: 31321 - DNA, 492 bp, Artificial Sequence
  Description of Artificial Sequence: Synthetic coding sequence
atgttccgtaaaatcggaattgaagccttaaagcaagttaccaagagatatgcccgtaaacaaaatcggtgggtgaagaatagatttctgagtcgcccaggccctatcgtaccgccagtatacggactagaagtgtctgacgtgagcaaatgggaagagagtgtcctcgaacccgcactggagatagtccaaagtttcattcaaggccacaaaccaaccgcaactcctataaaaatgccatacaatgaagctgaaaataagcgctcttatcacttgtgtgatctgtgtgaccgcattattatcggcgatcgggaatgggcagcccatattaagagtaagtcgcacctgaaccagctaaaaaaaaggcgaagacttgattctgacgctgtgaacacgatagagtctcagtccgtatcaccggatcataataaagaaccaaaggagaaagggagcccgggacagaatgatcaggaactgaaatgctctgtatag

SEQ ID NO: 31322 - DNA, 1602 bp, Artificial Sequence
  Description of Artificial Sequence: Synthetic coding sequence
atggcctcaccaggcaaggataattacaggatgaagtcatataagaataatgctcttaacccagaagagatgaggcggagacgcgaagaggaaggaattcagcttcggaaacagaaacgcgaacagcagctcttcaagcgaagaaacgtggagctcattaacgaggaagccgctatgtttgactcacttcttatggactcctacgtctcctctaccactggagagagcgtcatcacacgtgaaatggtcgagatgctctttagcgatgatagcgatctgcagctcgctactacccaaaaatttcgtaagctactgtccaaggagcctagtcctcctatcgacgaagtgattaacaccccacgggtggtcgatcgctttgtcgaatttctaaaacgaaatgagaactgtacattacagttcgaagctgcttgggcattgactaacatagcaagtgggacttcacagcagactaagatcgtcatcgaagccggagccgtgccgatcttcatcgagctcctgaattccgatttcgaggatgtgcaagagcaggccgtgtgggccctcgggaacattgctggagactcatcagtgtgtcgggactatgtcctcaactgtagcattctcaatcctcttttaacacttctgacgaaatccactagactcaccatgactcggaatgccgtttgggccctgtcgaatctttgtaggggaaagaatcccccacctgagtttgcaaaagttagtccttgtctaccagtgctctcgagacttctcttttcatcagatagcgacctcctcgcagacgcatgctgggctctgagctatctatccgacgggccaaacgaaaaaattcaggcagtgattgattctggtgtgtgccgccgattagtggagctgttgatgcataatgactataaggtggcctcacctgctctcagggccgtcggaaacattgtgaccggggatgacattcaaacccaggtgatcctgaactgtagcgcgctcccatgcctgctccacctacttagctcccccaaggaatcaatccgcaaggaggcgtgctggacaataagcaacattactgcaggaaatcgcgcacagatccaggccgtaatcgatgccaatatctttccagtgttaatcgagatccttcaaaaagccgagtttaggacacgcaaggaagccgcatgggcaataacaaacgctacaagtggaggaaccccggaacagatccggtacctagtgagcctcggatgcatcaagcctctctgcgacctgctcacagtaatggactccaagattgtgcaggtggctcttaacggattggagaatatcctgagactcggtgaacaggaaggcaaacggtctggaagcggtgtgaacccttactgcggccttatagaagaagcctacgggctcgataaaattgaatttttgcaaagtcatgagaaccaagagatatatcaaaaagccttcgacctcatcgaacattatttcggcgtcgaagacgatgactcttcattagcccctcaagtggatgaaacgcagcagcagtttatttttcagcagccagaagcacctatggagggcttccaactttag

SEQ ID NO: 31323 - DNA, 993 bp, Artificial Sequence
  Description of Artificial Sequence: Synthetic coding sequence
atggaacgcttcatggagcaggtcgtgttcaagtacctcagggctgagcccgaggatcactactttctgatgacagagccacccctaaacacccccgaaaacagagagtatctggcggagataatgtttgaatctttcaacgtgccgggactatatattgcggttcaggccgttctggccctcgctgccagttggactagtagacaggttggagaacgcacattgaccggtattgtaatcgattctggtgatggagtgacccacgttatccctgtagcagagggttacgtgattggctcatgtattaagcatatccccatcgcgggtagggatattacctatttcatccagcagttacttagagaaagagaagtaggtatccccccagaacagtccctcgaaactgccaaggcaatcaaggaaaagtactgctatatctgccccgatatagtgaaggagtttgctaagtacgatgtggatccaaggaagtggattaagcaatacactgggataaacgccattaaccaaaaaaaattcgtgatcgacgttgggtatgaaaggttcctcggccctgaaatatttttccatcctgaattcgcaaaccctgattttatggaatctatttcggatgttgtggatgaagttatacaaaactgtcccattgacgtgcggagacccctctacaaaaacgtcgtgctgagcggaggttcaaccatgtttcgggactttggtagacgcctccaacgcgacttgaagagggttgtggatgcccgtctgagactttccgaagaactctctggaggcagaataaagccaaagcccgttgaagttcaggtggttacccatcatatgcagcgatacgcagtgtggttcgggggatcgatgttggcctccacccctgagtttttccaagtgtgccatactaaaaaggattatgaggagtatggcccaagcatttgccggcataatcctgtgtttggtgtcatgtcatag

SEQ ID NO: 31324 - DNA, 576 bp, Artificial Sequence
  Description of Artificial Sequence: Synthetic coding sequence
atgtcgcgggagagggggagccgctccgaggagcctggggcaggaaatagagagtctgggtcacgcgaaccaggcctggccgcagctgccatgtctactgtggatctagcaagagtcggtgcatgtatcctcaaacacgcagtcacgggcgaagccgtggaactcagaagtctgtggcgtgaacatgcttgcgtggtggccggactgagaagatttggctgcgtggtgtgtagatggatagcacaggacctgtccagcctcgccggtcttctcgatcagcacggcgtgagactggtgggggtgggccctgaagccttggggctgcaagaattcctcgacggagactattttgctggcgagctgtacctcgatgaatccaaacaactctacaaggagttaggcttcaaacgatataatagtctgagcatcctgcccgcagcccttggtaagcctgtcagagacgttgcagccaaaagcccaggcgactatgtgcccaaggaacatatccttcaagtactgggcataagcgccgaagtttgtgcttcagaccctccccagtgtgaccgtgaggtatag

SEQ ID NO: 31325 - DNA, 1050 bp, Artificial Sequence
  Description of Artificial Sequence: Synthetic coding sequence
aatacgatccatgacgtgctcgacgtcgaagccgcagtcgttaacctggacaatagtgtcgtggacctggagaccctgcaggccctgtatgagaacagagcgcagtccgacgagctagaaaaaattgagaagcacggccgatcttctaaagataaggagaacgccaaatccctcgacaaacccgagcaattcttgtacgaactgtcgttgattcccaattttagcgagagggtcttttgtattctgtttcagagtactttctcagagtccatttgtagtattaggcgcaaactggaattgttgcagaagctttgcgagactctgaaaaatgggccaggagtgatgcaggttctggggctggttctggcattcggcaactacatgaacgggggaaataagacccgcggacaagctgacggattcggcctcgatatactcccaaagcttaaagatgtgaagtcctctgacaatagtagatccctgcttagctacatcgtctcttactatttacggaatttcgacgaagatgcaggaaaggagcagtgcctgtttcctctcccagagcctcaggacctgtttcaggcttcgcagatgaaattcgaggattttcaaaaggacttaaggaaattaaagaaggacctgaaggcttgtgaagtagaagccggaaaagtgtaccaggtgtcttccaaagagcacatgcaaccgttcaaagagaacatggaacagttcatcattcaggctaaaattgatcaagaggccgaagagaacagcctgacagagacccacaagtgttttttagagacaaccgcttactttttcatgaaaccaaagctaggagagaaagaagtctctccaaatgcctttttttcaatttggcacgaattctcctccgacttcaaagacttctggaagaaggagaacaaactgctcttacaggagagagtgaaggaagcggaagaggtttgcaggcagaaaaaagggaaatccctttataagattaaaccccgtcacgactctggcatcaagaacaataattcgatgcacacctag

SEQ ID NO: 31326 - DNA, 570 bp, Artificial Sequence
  Description of Artificial Sequence: Synthetic coding sequence
atgactgcttccgcatcttcattcagcagtagccaaggagtgcagcagcccagcatttacagcttcagccagatcacccgcagtttattcctttcaaacggagtagcagcaaacgacaaactcctcctatcctccaatagaattactgctatcgtgaacgccagcgtggaagggcagaggattctgcggggtatacagtatattaaggtcccagtgaccgatgcaagggattcacgcctatacgatttctttgatcccattgccgatctcatccacaccatcgatatgcgccaggggagaacgttgctgcactgtatggctggcgtaagccgtagcgcatcgctgtgtttggcttatctgatgaagtaccacagtatgtccctgctggacgcccacacatggacaaagagcaggagaccaatcatcagaccaaataatggattttgggagcagctgatcaactacgaatttaagctcttcaacaacaatacggtgcggatgattaactcaccagttggcaacattcctgatatctacgagaaggatctcagaatgatgatttctatgtag

SEQ ID NO: 31327 - DNA, 549 bp, Artificial Sequence
  Description of Artificial Sequence: Synthetic coding sequence
atgagtggcaggtcagtgcctcacgcacatcctgccacggccgaatacgagtttgctaacccttcgcgattaggggagcagcggttcggtgaaggattactgccagaggaaattcttactcccaccctttaccatgggtattatgtgcggcctcgagcagccccagcgggagaggggagccgcgctggagccagtgaacttcggctgtctgagggaaagttccaagccttcctagacgtgtcacatttcaccccagatgaagtgactgtgcggacagtagataaccttttggaggtttccgccagacatccgcaacggctcgaccgccacggattcgtcagtcgggagttctgtcgaacctatgtcctccccgcagatgtggacccatggagagtgcgggcagctctgtctcacgatggtattctcaacttagaggctccacgcggaggtcgccacctggataccgaagtgaatgaggtgtacatatcattattgcctgcccctcccgatcctgaggaagaggaggaagccgctatcgttgaaccttag

SEQ ID NO: 31328 - DNA, 387 bp, Artificial Sequence
  Description of Artificial Sequence: Synthetic coding sequence
atggtgttccgcaggttcgtggaggtagggcgagtggcctatgtttccttcggccctcacgccggaaagctagtggctattgttgatgtgattgatcagaaccgcgcattggtggacgggccatgtacacaggtcagaaggcaggctatgccatttaaatgcatgcaattaaccgactttattctgaagttcccacattccgcacatcagaaatacgtgcgacaagcctggcaaaaggctgacataaacaccaaatgggcagccactaggtgggctaagaagattgaagcccgtgaacgcaaggcgaaaatgactgatttcgatcgcttcaaggtgatgaaggcaaagaagatgcgcaaccgcattatcaagaacgatacgaggtag

SEQ ID NO: 31329 - DNA, 492 bp, Artificial Sequence
  Description of Artificial Sequence: Synthetic coding sequence
atgttccgtaagatcggtatcgaagccctgaagcaggtgactaagaggtacgctcgcaagcagaatcggtgggttaaaaatcggtttctgagccgccctggtcccattgtcccgccagtctatggacttgaagtgtccgacgtctcgaagtgggaggaatccgtccttgagccggcactggaaatcgtgcagtcctttatccagggtcacaagccgaccgcaacacccataaaaatgccatacaatgaagcggagaacaagagaagttaccacctgtgcgacttatgcgatcgcattatcatcggcgatagagagtgggcagcccacataaagagcaagtcccatcttaaccagctgaagaaacgaaggagactcgattcggacgcggtgaacaccatcgagagccagtctgtgagccctgaccacaacaaagagcccaaggagaagggctcaccaggccaaaatgaccaggagttgaaatgctccgtctag

SEQ ID NO: 31330 - DNA, 1224 bp, Artificial Sequence
  Description of Artificial Sequence: Synthetic coding sequence
atggctgcagagctctacgctcctgcctctgccgcagcggcagatctcgcgaacagcaacgcaggcgctgctgttgggcgaaaggccggtccccgatccccaccatccgctcccgcaccagcacccccaccgcctgccccagcccctccaactcttggtaataaccaccaggagtcccctgggtggagatgttgccggccaactttgagggaaaggaatgctcttatgttcaataacgaactgatggctgacgtccattttgtggtggggcctcctggtgcgacacgcactgtgcctgcacacaaatatgttctcgcggtgggcagttccgtcttctatgccatgttttacggagaccttgcagaggtcaagagcgagatccacatcccagatgtggaacccgctgccttcctgattctcctcaaatacatgtatagcgacgagattgatctagaagccgataccgtcctcgccacgctctatgcagcaaaaaagtatattgtccccgctctcgcgaaagcttgcgtgaacttcctggagacaagcctggaggcaaaaaatgcctgcgtgctgctatctcagtcaaggctatttgaggaacctgagttaacccaacgctgttgggaggtaatcgatgctcaagccgaaatggctttaaggtctgaaggattttgtgagattgatcgccagacgctggagattatcgtgacgcgcgaagccctaaacacaaaggaggcagtcgtgttcgaggcagtcctgaactgggcagaagcagaatgcaaacggcagggcctgcctattacacccagaaataagcggcatgtgctgggcagagccctctacctggtacggattcccacaatgacgcttgaagaatttgccaatggtgccgcacagtctgatatactgaccctggaagagacacattcaattttcctgtggtatacggcgacaaataaaccgagactggatttccctctaactaagaggaagggcctggcccctcagaggtgccatcggttccagtccagtgcctatcgctctaatcaatggcggtatcggggtagatgcgattccatccaatttgcggtggaccggagagtcttcattgccggtctggggctttatggtagttctagtggaaaagctgaatattccgtaaaaattgagctcaagaggcttggcgtcgtgctggctcagaatctgactaaatttatgtcctag

SEQ ID NO: 31331 - DNA, 603 bp, Artificial Sequence
  Description of Artificial Sequence: Synthetic coding sequence
atgctcgagctggtggcacaaaagcagcgcgagcgtgaagagcgtgaagaaagggaggcgttagagcgcgaacgacagcgtagaagacaaggccaggagctgtcagccgctcgacagcgtttacaagaggatgaaatgagacgggctgcagaggagcgtcggcgtgagaaagctgaggaactcgcagcaaggcagcgagtaagggaaaagattgaaagggacaaggcggagcgcgctaaaaaatacgggggatcggttggttcccaaccgcctcccgtggctccggagcctggcccagtgccttcttctccctctcaggagccccctaccaagcgcgaatatgatcagtgcagaatccaggtgcgactgcccgacggaacatccctaactcagacctttcgtgccagggagcagctggccgcagtgcgattgtatgttgagctacatagaggggaggagctagggggaggacaggatccagtgcagttgttatcagggtttccacggagagcattcagtgaggctgacatggaacggcctttacaggagctcgggctggtgccctctgctgtcctgatcgtggccaaaaaatgcccctcctag

SEQ ID NO: 31332 - DNA, 885 bp, Artificial Sequence
  Description of Artificial Sequence: Synthetic coding sequence
atgggcctggccagttggagtcagctggctagtactccaagagccccaggatcccgagatgctcgatgggagaggcgcgagccagccctccgcggagcaaaggacagactgacaatcggcaagcacctagacatgggtagccctcagctgcggacgcgcgaccgtggatggccttccccacgacccgagagagagaagcggacctcacagtccgcacgccgtccaacttgcactgaatctcgttggaagtcggaggaggaggtggaatccgacgatgagtatctggcccttccagctaggctcacacaagtcagtagcttggtctcttacttgggctcgatctctaccctggtcacattgccaactggggatatcaagggccagtcacccctggaagtatctgacagtgacggaccagcgagctttccatcctcaagtagccagtcacagctgcctcctggagccgctctgcaggggtccggggaccccgagggccagaatccttgtttcctaagatctttcgtcagggcacatgactctgcaggggaaggctcgctcggttcaagccaggctctgggggtttcatcgggcctgctaaagaccagaccaagcctgccagctagactcgaccgatggcccttttccgaccctgacgtcgagggccagttgccacggaagggaggagagcagggcaaagagtcacttgtgcaatgtgtgaaggtcatgaccctgaacgtccgcaagctctgtgttcaagtaagttgtctattcccacagtccaccaatatcattattaaacacgttcatgttgaccaggccctgttcatgtgccaagcgctgtgttgcacactaagttactctgtgttaacaaccttcaccagatag

SEQ ID NO: 31333 - DNA, 354 bp, Artificial Sequence
  Description of Artificial Sequence: Synthetic coding sequence
atggtcagaaaaattactctcgtgagcgctgccccaggaaaggttatctgcgagatgaaggtggaggaagagcacactaacgccatcggtactcttcatggaggactgaccgcaacgctcgtggacaatatctcaacaatggcgctgctgtgcacggagcgtggggcacctggagtcagcgtcgacatgaacatcacttatatgtcccctgcaaagctcggagaggacattgtaattaccgcacatgtcctgaagcaggggaagacactagccttcactagtgtcgacttgacaaacaaggccactggaaagctgatcgctcagggccgacacactaagcacctgggtaactag

SEQ ID NO: 31334 - DNA, 840 bp, Artificial Sequence
  Description of Artificial Sequence: Synthetic coding sequence
atgacatctgggaaaatcaagaagttcattcaagagaatatttttggcatctgtccacacatgaccgaggacaacaaggatctgatacagggcaaggacctcctgattgcctattacgacgtagactacgaaaaaaatgccaaagggagtaactattggcgcaatcgtgtcatgatggtcgccaaaaagttcctagacgcagggcataaactgaactttgctgtggcttcacggaagacgttcagccatgaactgagtgatttcggtctcgagtccacggcgggtgagatccccgttgtggccatacgcaccgccaaaggagagaagttcgttatgcaggaggagttctccagagacgggaaagcacttgagaggttcttacaggactactttgatggtaatctcaaaagatacctcaaatcggagcccattcctgagtccaacgacggacctgttaaggttgtggtagccgagaatttcgatgagatagtgaacaacgaaaataaggacgtgctcatcgaattttatgctccctggtgcggtcattgtaaaaatcttgaaccaaaatataaggagttaggcgaaaagttgtctaaagacccgaacatcgtcatagccaagatggacgcaacagcgaacgatgtcccctcgccatacgaagtaaggggatttccgactatctacttttctcctgctaacaaaaagctcaatcccaagaaatacgaaggcggtcgcgaactttcagactttatttcatacctgcagagagaggccacgaatcctccggtgatccaggaggaaaagccgaagaagaagaagaaagctcaagaggacctttag

SEQ ID NO: 31335 - DNA, 3228 bp, Artificial Sequence
  Description of Artificial Sequence: Synthetic coding sequence
atgtcccaaggcttccatcccgagagagaccctagtgatctgaagaaggtcaaggccgtagaagagaacggcgaggaggcagagcccgttaggaacggcgcagaatcagtgtccgagggggagggaattgacgccaattctggttcgacagacagttctggcgatggggtcacatttccatttaaaccagagtcatggaaacccacagataccgaagggaagaaacagtacgatcgcgagttcctgctggacttccagtttatgcccgcttgtatccagaagccagagggattgccccctattagtgacgtggtcctggacaagatcaatcagcccaaactgcccatgagaacgctggatcctagaatccttccgagaggccctgatttcactccggcatttgctgactttggtcgacagacaccaggagggaggggggtacctatatgtaaggtgcaatctcgtcatggactgccgatcctagagcaatctaaggcgccaacctgtcccccacttgtgatgtcccaccccccaatgaaaagcctcccccttgggcttttgaacgtggggtctcgaaggtctcagcctgggcaacgtagggagcctcggaagattataacggttagcgtgaaagaggacgttcatctcaagaaagcagaaaatgcctggaaaccatcccagaagcgcgactcacaagcagacgaccccgagaatataaaaacccaggaacttttccgtaaagtcaggagtatcctgaataagctcaccccacagatgttcaaccagctgatgaagcaagtgtctggattgacggttgacactgaagagaggctcaaaggcgtcatcgatctggtttttgaaaaagccatagatgagccttctttctctgttgcctacgccaacatgtgccggtgtcttgtcaccctcaaagttcccatggcagataagcccggaaatacagtcaattttcggaaactgctgttgaaccggtgtcagaaagagttcgaaaaggacaaagcagatgacgatgtcttcgagaaaaagcaaaaggagcttgaagccgcttcggcccctgaagagcggactcgactgcatgatgagctggaagaggcaaaggacaaggctcggagacgaagtataggaaacatcaaattcatcggcgagctattcaagctgaagatgcttacagaagccattatgcatgactgcgtggtcaaactgctgaagaatcacgatgaggaatcacttgaatgcctgtgccgtctgctcactactataggtaaggacctggactttgagaaagctaaaccccgaatggatcagtacttcaaccaaatggaaaagatcgtcaaagagagaaagacatcatcccgaattcgattcatgctgcaggatgtaatcgatctcaggctgtgtaactgggtatcccggagggctgaccagggtcccaaaactatcgaacagattcacaaagaggccaagatcgaggaacaggaggagcagcgaaaagttcagcaactcatgacgaaggaaaaacggagacctggggtacagagagtggacgagggaggctggaacactgtccaaggtgcaaagaattcaagagtcctcgacccgtccaagttcctgaagatcactaaacctaccattgatgaaaagatccagctggtgcccaaggcgcagctaggctcttggggtaagggttcctccggtggcgcaaaagcctccgagacagatgccttacgctcctctgcctcgtccctcaaccggttctccgcgctgcagcctcccgcacctagcgggtccaccccgagcactcctgtcgagttcgattcccgtcggacacttacaagcaggggttctatggggagagaaaaaaacgataagccgctgcctagtgcaactgctcggccaaatactttcatgagaggcggatcaagtaaggatctcctggacaaccagtcccaggaagaacagcggagggagatgctggagactgtcaaacaactgaccggaggcgtggacgttgagcgcaattcaaccgaggccgagagaaataagaccagagagtcagccaaacccgaaatcagcgccatgagcgctcatgataaagctgccttgagcgaggaggaactggagaggaagagcaagtcgatcattgatgagtttctgcacataaatgacttcaaggaggcgatgcagtgtgtggaggagctcaacgctcagggtttactccacgtttttgttcgcgtcggggtggagtccaccctagaaagaagtcagatcaccagagatcacatgggccagctcctgtatcaactagtccagagcgaaaagctatccaaacaggattttttcaaggggttttcagagactttggaactggccgatgacatggcaattgacataccgcatatctggctgtacctcgcggagctggtcacgccaatgctgaaggaaggcggtatcagcatgagagagctgacaattgagttcagtaaacccttgcttccggttgggagagctggtgttctcctttctgagatccttcacctgctgtgtaagcagatgtctcataaaaaagtaggagccttgtggagggaagcagatctgtcatggaaagattttctcccagaaggggaggacgtgcataactttctcctggaacagaaactagattttatcgagtccgatagcccctgttcctcggaagccctttccaaaaaggaactgtccgcagaagagctctataagcgattagagaaattaattatcgaggataaggccaacgacgagcagatcttcgattgggtggaagcaaatctcgatgagatccagatgtccagtcctacattcctgagagctctgatgactgcggtgtgcaaagctgcaatcatcgccgactctagtaccttccgtgtggatacggcggtcatcaagcagcgcgtgcctattcttttgaagtatcttgatagtgacaccgaaaaagagctgcaggcgctctatgcccttcaggcctccattgtcaagttggatcaaccagccaaccttctccgaatgttcttcgactgcctgtacgacgaggaggtcatcagcgaagatgccttttacaagtgggagtctagtaaagatccggctgaacagaacgggaaaggtgtggctctgaagagcgtgacagccttttttacctggttgcgagaagccgaggaggagtccgaggacaactag

SEQ ID NO: 31336 - DNA, 474 bp, Artificial Sequence
  Description of Artificial Sequence: Synthetic coding sequence
atgaaatgcatcccttatagcgtgctcttaaaagatttagaaatgcgaaatttacgggagttggaagacttaataatcgaggctgtgtacacagacattatccagggcaagcttgaccagagaaatcagctcctcgaagtcgatttttgtatagggcgagatatccggaaaaaagatattaacaatatagtcaagaccttgcacgagtggtgcgacgggtgtgaggctgttctcctgggaatcgagcaacaggtgctacgagctaatcagtacaaggaaaatcataatagaacacagcaacaggtcgaagcggaggtgacaaacatcaagaagaccttgaaagccactgcctcatcctcggctcaggagatggagcagcagctcgcagagcgggagtgtccccctcatgccgagcagagacagcccacaaaaaaaatgtcgaaggtgaaaggtctggtttcttcccgccactag

SEQ ID NO: 31337 - DNA, 837 bp, Artificial Sequence
  Description of Artificial Sequence: Synthetic coding sequence
atggattgtagggagatggatctttatgaagattaccagagcccattcgactttgacgctggcgtgaacaagagctatctctacctgtcaccctctggcaattcttccccacccggttcccccactttgcaaaagtttggactgctgcgcactgatcccgtgccagaagaaggggaggatgtggctgcaaccatcagcgctaccgagaccctctccgaggaagagcaggaagaactcaggcgggagctggctaaagtggaggaagagattcaaacattgtctcaagtcctcgcagcgaaagagaagcacttggccgaaatcaaaaggaagctaggtatcaattcattgcaggagctgaagcagaacattgcaaaggggtggcaggatgtaaccgcaaccagtgcttataagaagactagcgagacgctcagccaggctgggcaaaaggctagcgcagctttctcctccgttggttccgtaattaccaagaaactagaggatgtgaaaaatagccccacctttaaaagtttcgaggaaaaggtagaaaatctgaagggctccccaaagaatgttgagtcctttgcgagtatgctgcgccattccccccttacccagatgggccctgcgaaggataagctggtgatcggccgaatcttccacatcgtagagaatgatttatatatagatttcgggggaaagtttcactgtgtctgtagacggccagaggttgacggcgaatccccaatctcttggtatgcagtgtggcgccgttttagtcaggtgatgattacgtgcttctccagcaatagtgacttcggcaaacacaggaaacgctag

SEQ ID NO: 31338 - DNA, 3123 bp, Artificial Sequence
  Description of Artificial Sequence: Synthetic coding sequence
atggtgagcagcgcccaaatgggatttaatctgcaggctctactggagcagctcagccaggacgagttgagtaagttcaaatatcttataactactttttccttggcccatgaattgcagaaaataccacacaaggaggtggacaaagctgatggcaagcagctcgtggaaattctcaccacacactgtgactcatattgggtggagatggcaagtctgcaggtattcgagaaaatgcacagaatggatctgtccgaaagagctaaagatgaggtgcgcgaggccgcactgaagtcttttaataagcgcaagcccctctcactggggattactaggaaggaacgcccacctctggacgtggatgaaatgttggagagattcaaaacagaagcacaggataaggataataggtgtcgctacattctgaagactaaattccgtgagatgtggaaaagttggccaggcgattccaaggaggtgcaagtgatggccgagcgctacaaaatgctgatccccttctccaacccaagggttttacctgggcctttcagctacactgtggttctgtacggaccagcaggcctgggcaagactaccctcgcccaaaaactgatgctggattgggccgaggacaacctcattcacaaatttaaatacgccttttacctctcatgcagagaactgagcagactcgggccatgttctttcgccgagctggtattccgcgattggcctgaattgcaagacgacataccccacatcctggcccaggctcgcaaaattctgttcgtgatcgacggattcgacgagctgggggctgcacccggtgcattgatcgaagatatctgtggggactgggaaaagaagaagcctgtgccagtacttcttggcagcctgctcaatcgtgtcatgctgccaaaggctgctctgcttgtgacgacgcgtcccagagcccttagagatctaagaatactggctgaagaacccatctacatcagggttgagggatttctggaggaagatcgcagggcttattttctgagacactttggggatgaggatcaggcaatgagggccttcgaacttatgcgtagcaatgccgctctgttccagttgggcagtgcccctgccgtgtgttggatcgtttgcactaccctgaaattacagatggaaaagggggaggaccctgttcccacatgcttgacacggaccggcttgttcctcagattcttgtgtagccggtttccacagggcgctcaattgcgcggtgccctgcgcacgctctctcttctggccgcacaggggttgtgggcgcagacgtctgttctgcaccgcgaggatctcgagcggctgggcgtgcaggagtcagaccttcgactattcctcgacggcgacatccttagacaggacagagtctccaaaggatgttacagttttatccacctgtcatttcagcagtttctgaccgcactcttttacactcttgagaaagaagaggaagaggatagggatggccacacatgggacatcggcgatgtccaaaagcttctaagtggggttgaacggctcagaaacccagaccttatccaagccggatactatagtttcggtctggccaatgaaaaacgcgcaaaggaactagaagccacttttggttgcaggatgagcccggacatcaagcaggagctcctgcgctgcgacatctcgtgcaagggcggacactctactgtcaccgatctccaggagttgttagggtgcctgtacgaaagccaggaggaagagctggttaaggaagtgatggcacagttcaaagaaatctccctccatctaaatgccgtagatgtagtgccaagcagtttctgcgtgaaacactgcaggaaccttcagaagatgtcactgcaagtaatcaaggaaaatttaccggagaatgtgacagcctccgagtccgatgctgaggtggaacgtagtcaggatgatcagcacatgctgcctttctggaccgacctttgctccatcttcggctctaacaaagacttaatgggccttgcaatcaatgactccttcctctcagcaagcctggtgcgaatcctgtgcgaacagattgctagtgatacttgtcatctgcagcgggttgtgtttaaaaacataagtccggctgatgcccatcggaatctctgtctggcgttaagagggcataaaactgtgacttatctgaccctgcaggggaacgaccaggatgatatgttccccgctctgtgtgaggtcttaaggcatcctgaatgtaatctgcgttacttaggcctggtttcttgcagtgcaactactcagcagtgggcagatttgtctctggccctagaagttaatcagtcccttacttgtgttaatttgagcgacaacgagctgctggatgaaggcgctaagctgctgtacactactctgcggcaccccaaatgcttccttcagagactctcactggagaactgccacttaacggaggccaactgcaaagatttagccgcagtgctcgtggtgtcccgggagctaacgcatctgtgcctggccaaaaaccctatcggaaatacaggcgtgaagttcttatgcgaaggactgcgctacccagagtgcaagctccagacactcgtgctctggaactgcgacattaccagtgacggatgttgcgatctgactaaacttttgcaggagaagagcagtttattatgtcttgacctgggtctgaaccatataggggtgaagggtatgaaattcctctgcgaggcactgcgaaagcccctgtgtaatcttcggtgcctgtggctttggggttgctcgattcctccttttagctgcgaggacctctgttctgctctgagctgcaatcagagcctagtcacactggacttgggccagaacccactcggtagttctggagtgaaaatgttatttgagactctcacttgcagttccggcaccctgcggacactccggttgaagatcgatgatttcaatgatgaactgaataagctgctggaagaaatcgaggagaagaacccccaactgattatcgatacagaaaaacaccacccttgggctgagaggccatcatctcacgatttcatgatttag

SEQ ID NO: 31339 - DNA, 1809 bp, Artificial Sequence
  Description of Artificial Sequence: Synthetic coding sequence
atgagtgacaaatcagatctaaaggctgaactggaaagaaaaaagcagcgactcgcccagatccgggaggaaaaaaaacgcaaagaagaggaaagaaaaaaaaaggaggcggatatgcagcaaaaaaaagaacctgtccaagatgattccgacctagatcgcaagagacgcgagacggaagccttgcttcagtcgattggtatcagccctgaaccccctcttgtacccaccccaatgtctccctcaagcaagtctgtcagcacaccatcggaggctggttcccaggatagcggtgatctgggacccctgacaaggagaagattacacaaactgggagtaagcaaggtgactcaggtggatttcctgcctcgggaagtggttagttactccaaagaaacacaaacacccttggccacccaccagagcgaggaggatgaagaggacgaggagatggtggagagcaaggtgggacaggactcagagcttgaaaaccaggataaaaagcaggaagtcaaggaagccccacccagggaactcacagaggaggagaagcagcaaattcttcatagtgaagaatttctcatattctttgaccgcacgatcagggtgatcgaaagggccttggccgaagatagcgacatttttttcgactattctggcagggagctcgaagagaaagatggggatgttcaggctggagccaatctttcattcaatcgtcagttctacgatgagcattggtcaaagcatagagtcgtgacttgcatggattggtcgctgcagtatcctgagctcatggtggcttcctataataataatgaggacgcaccccacgagcccgacggggtagccctcgtgtggaatatgaaattcaaaaagacgaccccagaatacgtttttcactgccaaagctccgtgatgtcagtctgtttcgcgaggttccatcctaacctggttgtcggtgggacctactccggacagatcgtcctctgggacaatcgatcccaccggaggactcccgtacagcggactcctctttccgccgctgctcatacgcacccagtctactgtgtgaatgtcgttggtacccagaacgcccacaacctgatcactgtctcaacggatgggaagatgtgctcttggtctctggacatgctgtccacgccacaggagagcatggaactggtgtacaacaagagcaagcctgtggcagtgacaggcatggccttccctacaggagacgtgaacaatttcgtggttgggagtgaggagggcaccgtgtatactgcctgtcggcatgggagtaaggctggcatcggagaggtgttcgaaggacatcaaggacctgttactggcataaactgtcacatggctgtcggccctattgatttcagtcacctgtttgtcacgagctcattcgactggacagtcaagctttggaccacgaaacacaataagcccttgtattcgttcgaggataacgcggactatgtgtacgatgttatgtggtctcctgtgcatcccgctctctttgcctgcgtcgatggcatggggcgactggacctttggaatttgaacaacgacacagaagtgccgacggcttctgtagcgatcgagggggctagcgcccttaatagagtcagatgggctcaagccggtaaggaagtggcggtcggagactcagaagggagaatctgggtgtacgacgtgggagagggactcgctatgctgccaggctggtcccagaactcctggactcaggccatcctgctctgctggccacccaaggtcctgggcctacagacatag

SEQ ID NO: 31340 - DNA, 2847 bp, Artificial Sequence
  Description of Artificial Sequence: Synthetic coding sequence
atgtatgggtccgcacgatccgtcgggaaggtcgagccatcttctcaatcacccggtcgatcaccacgcctcccaaggagtccaagactaggccatcgcagaaccaattctaccggaggcagcagcggatcatccgtcgggggtggcagcgggaagacgttgtctatggagaatatacaatctctgaatgccgcttatgcaacaagtgggcctatgtacctcagcgatcatgagaatgtgggaagtgaaacacctaagagcactatgactctgggccgatctggcggacgactgccttatggagtgagaatgacagcaatgggatcaagtccaaacattgcctctagcggagtggctagtgacaccattgccttcggagagcatcatctcccacctgtgtcaatggcttccacagtccctcattccctgagacaggctagagacaatacaataatggatttacagactcagttgaaagaggtgcttcgcgagaatgatcttcttagaaaagacgtggaagtgaaagagtctaagctgtcgtccagtatgaattcgataaaaacattctggtcacccgaactgaagaaagagcgggctctcaggaaggacgaggctagcaagatcacaatttggaaagaacaatatcgagtggtgcaggaagaaaaccaacatatgcagatgacgatccaggcgctccaagacgagctaaggatccagagagacctgaatcagcttttccaacaggacagctccagtcggacaggcgagccctgtgttgccgagctcacagaagagaacttccagaggttacacgcagagcatgagagacaggctaaagagctcttcctcttgagaaagaccctcgaagaaatggagcttcgcatcgaaacgcaaaagcagactctgaacgcaagagatgagagtataaaaaagttgctggagatgctacagagcaagggcctctcagccaaagccactgaggaggatcacgagcgcactcggagactggccgaagcggaaatgcatgttcaccacttagaatcactcttggaacagaaggagaaagagaattccatgctgcgcgaggaaatgcatagacggttcgagaatgctcctgattctgcgaagacaaaggcccttcagacagtgatagagatgaaggatagcaaaatcagttctatggagcgcggtctgcgggatctggaggaggagattcagatgctaaaatccaacggagcgctgagtactgaagaaagagaggaggagatgaagcagatggaggtatacaggtcccacagtaaatttatgaagaataaaattggccaggtgaaacaggagttatcaagaaaagacaccgaattgttggctcttcagaccaaactggagactcttactaaccaattcagcgacagcaaacagcacattgaggtactgaaagagtccctcacagccaaggagcagagagccgctattctccagactgaagtggacgccctgagattgaggctagaagagaaggagactatgctgaacaagaaaactaagcagatccaggacatggctgaagaaaagggcacgcaagctggcgagattcacgatttaaaggacatgctcgacgtgaaagagagaaaagtaaacgtgctgcagaagaagatcgagaatcttcaggagcagctacgggacaaagagaagcagatgtctagcctgaaagagcgcgtgaagtccctacaggcagatacaaccaatacggacaccgctttgacaacactggaagaagctttggcggagaaggaaagaaccattgagcgtctgaaggagcagagggaccgggacgagagagagaaacaggaggagatcgacaattacaagaaagatctgaaagatttaaaagagaaggtgagcctgctgcagggagaccttagcgagaaagaggccagtctcttagatctgaaggagcacgcttccagtctggcgagctccggcctcaaaaaggactccagactgaagacattagagatcgccctagagcagaagaaggaagagtgcctgaagatggaatcccaactgaagaaggcgcacgaagcagcgctagaggccagggcgtccccggagatgtctgaccggatccagcaccttgagcgcgagattacccgctacaaggacgaatccagtaaagcccaggctgaagtggaccggttgttagagatcctgaaggaagtagagaacgaaaaaaacgacaaagataaaaaaatcgccgagctcgagtccctgttttcccgccaggttaaggaccagaacaagaaagtggcaaatctgaaacacaaggagcaggtcgagaagaagaagtccgctcaaatgctggaggaggcccgtcggagagaagacaacttaaacgacagcagtcagcaactgcaggtggaggagttactcatggctatggagaaagtgaagcaggagctggagtcgatgaaggctaaactcagctctactcagcaaagtttagctgaaaaggagacgcacctcacaaatctacgagcggagaggaggaaacacctggaagaagttcttgaaatgaagcaggaggccctcctggctgcgatttctgagaaggacgccaacatagctctactagaactgtcgtcctcaaaaaagaaaacccaggaagaggtagcagccctgaagcgggagaaggaccgtctggtccagcagctcaaacagcagacgcagaaccgcatgaaactcatggcggacaactacgaggacgaccactttaagtcctcacacagtaaccaaacaaaccacaagccttcacctgatcaggacgaggaggagggcatatgggcctag

SEQ ID NO: 31341 - DNA, 2742 bp, Artificial Sequence
  Description of Artificial Sequence: Synthetic coding sequence
atggaagtagggagtgaagaggaaaaatgggagaaattggatgcagagttcgaccacttcgtagtcgatatgaagccatttgtcttgaaactcccgcatcgaaccgagagacaacggtgcgccctgtggattcgcaagctgtgtgaacctagcggcaccggggcaggcatcatgggcagaaagaacaggaatctgtacgcaaaactgctcctgcacatgctaaagaggggggcactggaaggcccttttactcacagaccagagcctgggaccctgaaaatcctcccatcgtatatgtctatatactttgacgagccaaaccccgctcgcgctaaaggctccagcccagaggggctgcccgcatgggtgttgggcgagttggaaacttcggagcacaaactgaacgaaagttggaagctgtccagtggtgaggataacaccttagtgcagagccctacggatgtttattcccgcgaacagtatactgggaaattgagagtccgctcccatagtctgagtccaacccatcgagaggatgggcagaacatcaccccaaagatctgtgaagtctattccaagaagtcccccgttagcttggacgactcggatatcgaagccagactaaactcatggaacctcgggcttgatatgaagacgaagatgatggaggccaagtttcacgaggaaaagctgaaattacaacagaagcacgacgcagacgtgcagaagatattggaacggaagaataacgaaatcgaagagctgaaaaccctgtatcgttctaaacaacatgagacggaggaaaccatacgaaagctcgaaaaaaaggtccagactttaattagagattgccaggtgatcagagaaacaaaggaggaccagatcgccgaactgaagaaaatttgcgagcagtccacagaatcactgaacaacgactgggagaagaagctgcacaacgctgtggccgaaatggaacaggaaaagttcgatctgcaaaagcaacacactgaaaacattcaggagctactcgaggacaccaacgtgaggctaaacaaaatggaatcagaatatatggcccaaacacagagtacaaatcatatgattaaggagctggaggctagggtgcagcaactgaccggtgaagctgaaaactctaacctccagcggcagaagctgattcaagagaaagctgagctggagcggtgctatcagattacatgttccgagcttcaggaggtgaaagcccgtcgtaatacactccacaaagagaaagatcatctcgtaaatgactatgagcagaacatgaagctgctgcagactaagtatgatgcagacattaatctcctgaaacaggaacatgcgctgagcgcttcaaaagcgagctcaatgatcgaagaacttgaacagaacgtgtgccaactgaaacagcagctgcaggagtccgaactccagcgtaagcagcagctgagagaccaagaaaataagtttcagatggaaaaatcacacctcaaacacatatatgagaaaaaagctcacgatcttcagtccgagcttgacaagggaaaggaggatacgcagaaaaagatccacaagtttgaggaagcgcttaaagaaaaagaagagcagctaacaagggtcaccgaggtgcagagactgcaagctcagcaagctgatgctgcacttgaggagtttaagaggcaagtggagctgaattcggagaaggtttacgccgagatgaaggagcagatggagaaggttgaagccgaccttaccaggtcaaagtctctcagggagaagcagtcaaaggagtttctatggcagctcgaggatatcaggcaaaggtacgagcagcaaattgttgaactgaaactggagcatgagcaagagaagacccatttgttacagcagcacaatgctgagaaggacagcctggtgagggatcatgagcgggaaattgaaaatttggagaagcagctgcgtgctgccaacatggaacacgaaaatcagatacaagagttcaagaaaagagacgcacaggtgattgcagacatggaggcacaggttcacaagttgagggaggagctgatcaatgtcaattctcaacgaaagcagcagctcgttgagctgggccttcttagagaagaggaaaagcagagagccacgcgggaacatgaaatcgtcgtcaacaaacttaaagcggagagtgagaagatgaaaattgagctgaaaaaaacgcacgccgcagagaccgagatgacacttgaaaaagccaattccaaactgaagcagatcgagaaagagtacactcagaaactcgccaaaagcagccagattattgccgagctccaaactaccatcagttccctgaaggaagaaaactcccagcagcagctggcagcggaacggaggttgcaggacgtgcggcagaagttcgaggacgagaagaagcagctaatccgcgacaatgaccaggcgattaaagtactccaggacgagctcgaaaaccgaagcaaccaggtccggtgtgctgagaagaagcttcagcataaagagctggagtcccaggaacagatcacatacatcaggcaagagtacgaaacaaagctgaagggtttgatgccagcatccttgcggcaggaattagaagacactatctcctctctgaagtcacaagttaattttttacagaaaagagcctcaattcttcaagaggagcttaccacttaccagggcaggcggtag

SEQ ID NO: 31342 - DNA, 825 bp, Artificial Sequence
  Description of Artificial Sequence: Synthetic coding sequence
atgcaggacgagaaactacgggacgaaaccgagcagcccgtgagtaaagtcatcgaacgaaatcgtctgcgaacagtgctgaagaatctaagtttgctcaagctactgaaatcttccaaccgaaggattcaagaactgcacaagttagctaagaggtgctggcatagcttactctcggtcccgaaaattctgcgcatttccagtggagagaattctgcgtgcaacaaaactaagcagaataatgaagagttccaggaaatcggctgctctgaaaaggaactgaagtctaagaagctggagtcaaccggtgatcccaagaagaaggaatataaggaatggaaatcacaggtgcagtctggcatgagaaataaggagaaaacttcgctcgcagccatgcctcgcaaagagaaacacatagagcccgaagtgccacggaccagccgagatgattcactgaaccccggagttcaagggagacagcccctcactgagggacctcgagtcatcttcatcaagccctaccgtaatcggaccccaatgggccacatgaaacagttagatgtggctgaccagtggatatggtttgaggggctccccactcgaatccatctgcctgccccaagggtgatgtgtcgttctagcacgcttagatgggtaaagcgccgatgcactcgattttgctccgcgagcctagaaatgccaatgtggcacccttacaaagtcgatgtgacttggacccgagccaggggggctagcaggggttggcggagccgccaccaattgaaaggcaggaacggctggcgtaactctagagtatataagtag

SEQ ID NO: 31343 - DNA, 156 bp, Artificial Sequence
  Description of Artificial Sequence: Synthetic coding sequence
atgcagctccggcacattggagacaacatcgatcaccggatggtacgtgaggatctgcagcaggacggcagggatgcactcgatcacttcgtcttttttttctttcgtagggtccaggttttgttacacttcttctggaataatcatttactctag

SEQ ID NO: 31344 - DNA, 444 bp, Artificial Sequence
  Description of Artificial Sequence: Synthetic coding sequence
atggctggtggcgcaagagaagtcctgacattacagctcggccacttcgcgggatttgtgggcgctcattggtggaaccagcaggatgccgcacttggcagggcaacagattcaaaagagccccctggagagttatgccctgatgttctctataggaccggaaggacccttcatggccaggagacttacacaccacgactgatcctgatggacttgaagggaagcctgagcagtctgaaggaggaggggggtctttacagggataaacagctggatgctgcaattgcttggcagggtaaactgaccacacacaaggaagagctctatcctaaaaatccgtaccttcaggattttctctccgcggaagtgcgggcttctgtcctcaactttctgacgcgctgtcacaacttaagagtgtctatcggcgcagggtccgcggagtag

SEQ ID NO: 31345 - DNA, 1677 bp, Artificial Sequence
  Description of Artificial Sequence: Synthetic coding sequence
atgtccgtcagtgtccacgaaaccaggaagagccgatcttccactggctccatgaatgtgacattgttccacaaggccagccaccccgattgcgtgctcgcagcgtctagtcgctatttcgaggccatgtttagtcacggcctgagagagtcgcgggatgacacggttaatttccaggacaatctgcatcctgaggtccttgagttactgctggattttgcatactcaagccggatagcaatcaatgaggaaaacgctgagagcctgctggaggcaggagatatgttgcaatttcacgatgtccgggatgccgctgctgagttcctcgagaagaatctgttccccagtaactgtctgggtatgatgcttctcagtgacgctcaccaatgccggaggctgtacgagtttagctggcggatgtgcttggtccatttcgagacagtgcgccagtcagaggacttcaactccctctccaaagatactcttctcgatctaatatcaagtgacgagctggagaccgaggacgaacgtgtagtcttcgaagcaatcctgcagtgggtaaaacatgacttggagccccgtaaagtccaccttcctgagctgctgaggagtgttcgcttggcactgctcccatcggattgtctgcaggaggctgtgtcttctgaggctctgcttatggccgacgaacgcacaaagttgatcatggacgaggccttgaggtgcaagaccaggattctgcagaatgacggtgttgttacctccccgtgtgcaaggccaaggaaggctggacacaccctgttgatactggggggtcagacatttatgtgtgataagatatatcaggttgatcataaggcaaaagaaattatccccaaggctgatctgccttctcctcgcaaggagttctccgcttctgctatcggttgcaaagtttacgtgaccggcggtcggggtagtgagaacggggtgtccaaggacgtctgggtctatgatactgtgcacgaagaatggtcaaaggctgccccaatgctgattgcacggttcggacatggatctgctgaactggagaattgcctttatgtagttggtggccacacatcgctggccggtgtgttccctgcttccccctctgtgagtctcaaacaggtcgagaaatacgatccgggtgcaaacaaatggatgatggtggcaccgctgcgcgacggggtgtctaacgccgcagtagtgagcgcaaagcttaagctgttcgtgtttggcggtactagtattcacagagatatggtaagcaaggtacagtgctatgacccctctgagaaccgctggaccattaaggcagagtgtccccagccttggcgctacacagccgctgctgtcctcggtagccaaatctttatcatgggcggtgacaccgagtttacagctgcgtcagcctatcggtttgattgcgagactaaccaatggacccggattggagacatgaccgcaaaaagaatgagttgtcatgcactcgcatcgggaaataagttgtacgtggtaggcggttattttgggacgcagagatgtaagactttggattgctatgatcccacatctgatacttggaattgtattaccacagttccatacagcctcattccaactgcatttgtgtccacatggaaacatctgcctgcatag

SEQ ID NO: 31346 - DNA, 2916 bp, Artificial Sequence
  Description of Artificial Sequence: Synthetic coding sequence
atgaatttccttagaggagtgatggggggacagtctgcgggaccacagcataccgaagctgaaaccgttcggggagcagccggtctggggttggggaaaggttccggccagggacgaggcagatctactcgccgtcccgaagagtgcggcctcaagtttcgacactcttttaggctggtcaaacacattctttatcacgtgaccatcaatgttagtgactccgagatcatagggtatgcgctggatacactctataacatcatcagcaacgaggaggaagaggaagttgggggttcgcaagaagaaaactccacgagacagagcgaggacttggggtcacagtttacagaaatttttattaagcaacaagagaacgtcaccttactcttgagtctcctcgaagaatttgatttccacgtgcgctggcccggtgttaaactgcttactagtctgctgaaacagcttggaccccaggttcaacaaatcatcctggtcagcccaatgggagtgagcagactgatggatctcctggccgattcaagggaagtgatcaggaacgatggggtgctacttctgcaggcgttgacaagaagtaacggagcgattcagaagattgtggcttttgaaaatgcgtttgagaggctcctggacattatttctgaggagggaaactctgacggtggaatcgtggtggaggactgccttatcctcctgcaaaacctactcaagaataacaattccaatcagaacttcttcaaagaaggatcttatattcagcgcatgaagccatggttcgaggtgggcgatgaaaacagtggatggtcggcccagaaagtcaccaatttgcatttgatgctccagctggtaagggtcctggtatcaccaacgaatccccctggggctacatcatcctgccaaaaagcaatgttccaatgtggcctgctgcaacagctttgcacgattctgatggccaccggtgtaccggctgatatcttgaccgagaccatcaacactgtttccgaggttattcggggatgccaagtaaatcaggattatttcgcctctgtcaatgctccctcaaatccaccccgtcccgcaatcgttgtgctgttaatgtctatggtcaacgagagacagccatttgtgctccgatgtgctgtgctctactgcttccaatgctttctttataaaaaccagaagggacagggcgagatcgtgagtactttactgccttcaactattgacgccaccgggaatagcgtctctgcaggacagctgttgtgtggagggttgttctccaccgactctctctctaattggtgcgctgccgttgcattagctcacgccctccaggaaaacgcaactcagaaggaacagttgctgcgcgtccagctcgctacatctattgggaaccccccagtctctttactccagcaatgtactaatatcctttcacagggagataagattgatcgacgaggaagtaaaatacagactcgcgtaggtttgctgatgctcctgtgcacatggctttcaaactgtcccattgcagtgacacattttctgcacaacagcgccaacgttccgttccttacaggccagattgccgagaacctaggggaagaggaacaactcgtgcagggcctttgcgccctcctcttagggatctcaatctatttcaacgacaatagcctggagtcttatatgaaagagaaactcaagcaactgattgaaaagcggatcggtaaagaaaattttatcgaaaaactaggttttatctctaagcatgaattgtacagtagagcttctcagaagcctcagcccaattttccaagtcccgagtacatgattttcgatcacgagtttacaaagctggtgaaagagctggagggagtcattacaaaagctatttacaagagcagcgaagaagacaaaaaagaagaggaagtgaaaaagaccctcgagcagcacgataatattgtgactcactacaagaacatgattagagagcaggatctccaactggaagaacttcggcaacaggttagtacactcaaatgtcagaacgagcagcttcagaccgctgtgactcagcaggtgagccaaatccagcagcataaggaccagtacaacttacttaagatccagctgggcaaggacaatcaacaccaggggtcgtactccgagggtgcccagatgaatgggatacaacccgaggagatcggcagactaagggaggagattgaagagctgaagcggaaccaagaactactgcagagccagttaactgaaaaggactccatgattgagaatatgaagagctcacaaacgagtggcaccaatgaacaaagcagcgccatcgtttcggcaagggatagtgagcaagttgccgagttgaagcaggaacttgctacgttaaagagtcagttaaattctcaatccgtcgaaataaccaaactgcagacagagaaacaagaattactgcagaagacagaagcattcgcaaagagcgtagaagtgcagggcgagaccgaaaccatcatcgcgactaagactacagacgtggaaggccgtctcagcgcactactgcaggaaacaaaagagctgaaaaacgaaattaaagccttgagtgaggagcgcaccgcaataaaagagcagcttgactcatctaatagtacaatcgctatactgcagacagagaaggacaagctcgagttggagattaccgactccaagaaggagcaagatgacttgctggtgctcctcgcagaccaggaccagaagattctttcgctgaagaataaactcaaggaccttggacaccccgtggaggaagaagatgagctggagtccggcgaccaggaagatgaggatgatgagtctgaggatcctgggaaagacctggaccacatctag

SEQ ID NO: 31347 - DNA, 258 bp, Artificial Sequence
  Description of Artificial Sequence: Synthetic coding sequence
atgggcaattctgactctcagtacacacttcaggggtctaaaaatcattcaaacacaataactggcgctaagcagataccctgttctcttaagatccggggtattcacgccaaggaggaaaagagcttacatgggtggggccacggttccaacggtgcaggctataaaagcagatctctagcgagaagctgtctgtcacacttcaaaagcaaccaaccatatgcctctagactgggtggaccaacatgcaaagtatag

SEQ ID NO: 31348 - DNA, 174 bp, Artificial Sequence
  Description of Artificial Sequence: Synthetic coding sequence
tgaggacgcgcacccggacccgcaatcgggggaaggagagccggtgactcgtgtcccggatggcgcagacggtcccgcagtcgaggacggggacagcgcctctcccacggtcctcggcgacgaccacaacttcttactgagactcgtcggcctgtgctcgttcagtggttgtag

SEQ ID NO: 31349 - DNA, 936 bp, Artificial Sequence
  Description of Artificial Sequence: Synthetic coding sequence
atggtatctttgcgcgttaacccgttgtctctggtcgagataatcctccacgtcgttagacaaatgacagaccctaacgtggccctcacattcctcgaaaaaacacgggaaaaagtgaagtctagcgacgaagcagtcattttgtgcaagaccgcgatcggggcactaaagttaaatattggagatctgcaagtgactaaggagacaatcgaagacgtggaagagatgctcaataacttaccaggtgttacatctgtccattccaggttctacgatctgtcatccaaatactatcagacaattgggaatcacgcaagctactataaagatgccctgagatttcttgggtgtgtcgatattaaagatctgcccgtgagtgaacaacaggaacgggcttttacactggggttggcaggcctgttgggagagggcgtcttcaactttggcgaacttctgatgcatccagtactagaatcacttaggaatactgaccggcagtggctgattgacacgctctatgcatttaatagtggaaacgtggagaggtttcagacgctgaagacagcatggggacagcagcctgatctcgccgcaaatgaagcccagctgctgagaaaaatacagctgctatgtctgatggagatgacattcacccggcctgccaaccatcgccaactcacctttgaggaaatcgcgaagagcgccaagatcacagtgaatgaagtggaacttctagtcatgaaggccctcagcgttgggctggttaagggctccatcgacgaggtggataagcgagtgcatatgacgtgggtgcagcctagggtgcttgacttgcagcagatcaaaggaatgaaggatcggcttgagttttggtgcacagatgtgaaatccatggagatgctcgtagaacaccaagctcatgacattctcacttag

SEQ ID NO: 31350 - DNA, 1161 bp, Artificial Sequence
  Description of Artificial Sequence: Synthetic coding sequence
atgaagagcctgaaagcctgcaaacgagagattaagagtgtgatgaataccgctgggaactctgcaccatctttgtttttgaagagcaactttgagtacttacgaggcaattaccgtaaggccgtgaagttgttgaattccagtaacattgccgaacatccgggattcatgaaaactggcgagtgtcttagatgtatgttctggaataatctggggtgtattcacttcgccatgagcaaacacaacctaggcattttctactttaaaaaagccctgcaggagaatgacaatgtttgcgctcaactaagtgctggctcaaccgaccccggaaaaaagttttcaggcaggcccatgtgcactctgctgactaacaagcggtacgaactgttgtacaattgcggtatccagctgctacacattggtaggcctctggccgctttcgaatgcctaattgaggccgtgcaagtgtaccacgccaatcctcgactgtggctcaggttggcggaatgctgtattgcagcaaataagggaacatcagaacaagaaactaagggattgccttccaaaaaagggatcgtccagtctatagtcgggcaagggtatcatagaaagatcgttctggctagccagagtattcagaatacagtttataacgatggccagtcctcagccatccccgtggccagcatggagttcgccgctatttgtctccgaaatgcccttctgctgctgccggaagaacagcaagatcctaagcaggaaaatggggcaaagaattctaaccaactgggcggaaacacagagtcttccgagagctccgagacttgtagtagcaagagccatgatggcgacaaatttataccggctccaccttcaagcccactccgcaagcaggagctggagaatctcaaatgtagcattttggcatgttccgcttacgtcgccctggccctcggcgacaatctcatggctctcaaccacgctgacaagctgctccagcagccgaaactgagcgggagccttaaattcctcggtcatctttacgccgcagaagctctcatttctttggaccggatcagcgatgctattactcacttgaacccagagaacgttacagatgtatccctcggaatcagcagtaatgaacaggatcaggggtag

SEQ ID NO: 31351 - DNA, 1596 bp, Artificial Sequence
  Description of Artificial Sequence: Synthetic coding sequence
atgcttcaagaactcaatttcggagcctatcttggcctccctgccttcctgctccccctgaatcaggaagacaatacaaatctcgctcgggtgctgactaatcatattcacaccggtcaccactcatccatgttctggatgagggtcccactggttgcccctgaggaccttcgggacgacatcatcgaaaatgcgcctacgactcataccgaggagtacagcggtgaggagaaaacctggatgtggtggcacaactttcggactctgtgtgactattctaagagaatcgccgtggctctcgaaatcggtgctgacctccctagcaaccatgtgattgacagatggctgggggaaccaatcaaggccgctatattgccgaccagcatatttctcacgaataaaaaggggttccccgtgttatctaagatgcatcagcgactcatcttcagactgcttaagttagaagttcagtttatcattacagggaccaatcatcattcagagaaggaattctgtagctatttgcagtatctggagtacctgtcccagaacaggcctcccccaaatgcttatgaactgttcgcaaagggctacgaggactacttgcagtcgccactgcagcctttgatggacaacctagagtcccaaacatatgaggtttttgaaaaggatcctattaagtatagtcaatatcaacaagccatatacaagtgccttttagaccgagtaccagaggaggagaaggacaccaatgtacaagtgctcatggtgctgggggctggaagggggcctcttgttaatgccagtctgagggccgcaaaacaggcagacagaagaataaaactgtacgccgtggagaaaaacccaaacgccgtagtaacgttggaaaactggcagttcgaagagtggggatctcaggtgactgtggtatcaagcgatatgagagaatgggttgcccctgaaaaggcggacatcatagtgtcagagcttctgggatcattcgccgacaatgagttaagtccagagtgccttgatggcgcacagcactttcttaaggacgatggcgtgtcaatcccaggagaatacacaagttttcttgccccaatatcctccagcaagttgtacaacgaggtgagggcttgtcgcgaaaaagacagagaccctgaggcccagtttgaaatgccttacgtcgtgcgactgcacaattttcaccaactctctgctccacaaccttgctttaccttctcacatcctaacagggatcccatgatcgacaataaccggtattgtacacttgaattccctgttgaagttaacactgtgctgcacggtttcgctggatactttgagaccgtcctctaccaggacataaccctgtccatacggcctgagacacactcccccggaatgtttagctggttccccatcctgttcccaatcaagcagcccatcacggtgagagagggccaaacaatatgcgtgaggttctggaggtgctccaattccaagaaagtgtggtacgagtgggcggttacggcacccgtatgtagtgccattcataatcctacaggtaggtcctacactatcggactgtag

SEQ ID NO: 31352 - DNA, 789 bp, Artificial Sequence
  Description of Artificial Sequence: Synthetic coding sequence
atggctctctcactaggttggaaagcacacaggaatcactgtggattgttactacaggcactacgtagcagtggcctcctgctttttccttgtgggcaatgtccttggcggggagccggttcctttctcgacccagaaattaaggctttccttgaggaaaatacagaggtgaccagctcgggatcactcacaccggagattcagcttagactgcttactcctcggtgtaaattctggtgggaacgcgctgacctgtggcctcatagcgatccgtattgggcaatctactggcctggcggacaggcactaagcaggtacctcctcgataatcccgatgttgtgcggggaaaaagcgtcttagacttgggctctggttgcggagctacagcaattgccgcaaagatgagtggcgcaagtcgcattctggcaaacgacattgacccaattgctgggatggctatcaccctaaactgtgaactcaaccgcttgaacccctttcccatactcattcaaaatatcctcaatctggagcaggataagtgggaccttgtcgtactcggtgacatgttttacgatgaagatctggcagatagtcttcatcaatggctcaaaaaatgtttttggacatatcgtactagagtcctcatcggggacccaggaaggccgcagttttcgggccactctatccaacaccacttacacaaggtagtggagtactctctgttagagtccaccagacaggaaaattccgggttgaccacctctaccgtatggggattccagccatag

SEQ ID NO: 31353 - DNA, 1131 bp, Artificial Sequence
  Description of Artificial Sequence: Synthetic coding sequence
atggctgccccatccccgagcggaacacctgtgagctccatgcaggggaaacgcaaggctctaaagctcaactttgccaaccccccttttaagtctaccgccaggttcacactgaaccctaatccgactggagtgcagaacccgcacatagagcgccttagaactcacagtatcgaatcctccggaaaattgaaaataagccccgaacaacactgggatttcacagctgaagatctgaaggatctgggcgagatcggtaggggcgcttatggcagtgtgaacaagatggtgcataagcccagcggacagatcatggccgtcaaaagaattaggtccacagtggatgaaaaggagcagaagcagctcctgatggacctggacgtggttatgaggagttctgactgcccttacatcgtccaattctacggtgccctgtttcgcgaaggcgattgttggatctgtatggagttaatgtcaacatcattcgataagttctacaagtacgtctacagtgtcctcgacgatgtcatccctgaagagatcctcgggaagattactttggccacagtgaaagcccttaatcacctgaaggagaacctgaaaatcatccaccgtgatataaaacctagtaatatactgttggatcgctccggcaatattaagctctgtgacttcgggataagtggacagcttgttgacagtattgctaagactagggatgccggatgtcgaccttacatggctcctgaaaggatcgatccctccgccagccggcagggctacgacgttcgcagcgatgtgtggtctctgggcattacattgtatgagctggccacaggccgattcccgtatcccaaatggaacagcgtgtttgaccaactgacccaggtcgtcaaaggagaccctccgcagctgagcaactcggaggagcgtgagttcagtcctagcttcatcaatttcgttaatctctgcttgactaaggatgaatcgaaacgtcccaaatacaaggaactacttaaacatccctttattctcatgtatgaggagagagctgttgaagttgcctgttacgtgtgcaagattttagatcagatgcctgccaccccttccagccccatgtatgtggactag

SEQ ID NO: 31354 - DNA, 1035 bp, Artificial Sequence
  Description of Artificial Sequence: Synthetic coding sequence
atggcgggaagcgggtgcgcctggggcgctgagcccccacgattccttgaagccttcggtcgcctgtggcaggtgcagtctagactggggtcgggtagctccgcttccgtgtaccgtgtgcggtgctgtggcaatcctggatctccccctggggcacttaaacagtttcttccccctggaaccaccggcgctgctgccagcgctgctgaatatggattcagaaaagagcgggcagctcttgaacaactccaagggcaccgtaatatcgtgaccttgtacggggtgttcaccattcacttttccccaaacgttccatctcgctgcttgctgcttgaactgttggatgtctcggtgtcagaactcctgttgtacagtagccaccagggctgttcaatgtggatgattcagcactgtgcaagggatgttttggaggccctcgcattcctccatcatgaagggtacgtgcatgctgaccttaaacccagaaacattctgtggtcagctgagaatgagtgcttcaaactcatcgactttggactcagtttcaaggaaggcaaccaagatgttaagtacatccaaacagacgggtaccgggcacctgaagccgagctgcaaaattgcctcgctcaagcgggattgcaaagtgatacggagtgtacttctgccgtggatctgtggtcgcttggaatcatactgctcgagatgttttcagggatgaaactcaagcacaccgtgaggagccaggagtggaaagccaactcaagcgctataattgaccatattttcgccagcaaagccgttgtaaacgccgctatacctgcctatcatctaagagatttaatcaaatcaatgctccatgacgacccctcgaggaggatccctgctgaaatggccttgtgtagtccatttttctccataccattcgccccacatattgaggatctggtgatgctccctacccccgtgctgcgactgctgaacgtgttggatgacgattatttagagaacgaagaagagtacgagggcttgtgctag

SEQ ID NO: 31355 - DNA, 1467 bp, Artificial Sequence
  Description of Artificial Sequence: Synthetic coding sequence
atggcattaaagatgaacaccctgtcttcaaaccgcgcaaacatgctgaaggaagtgcagctaatgaataggttaagccaccccaacatactcaggttcatgggggtgtgcgtgcatcagggacagttacatgcgttaacagagtacatcaacagtgggaatctggaacaactcctggacagtaatctgcatctcccttggacagttagagtaaagctcgcctacgacatagccgtcggtttgagctatctgcacttcaaaggaatcttccacagagatctcacatcaaaaaactgcctgattaaacgggatgaaaatggatattctgccgtggtggccgactttggcctcgcggaaaaaattccggacgtgagcatggggtccgagaagcttgctgtggtgggtagcccattctggatggctcccgaggttcttcgtgacgaaccttataatgagaaggccgatgtcttctcttatggtattattttatgcgagatcatcgctagaatccaagcagatccagattatctcccacgtacagaaaattttggcctggattacgacgcgttccaacatatggtgggcgactgcccacctgactttttgcagctgacgtttaactgctgtaatatggaccctaagctgcgcccatcttttgtggaaatcgggaaaaccctggaagagatcttatctcggctgcaggaagaggaacaggagagagatcggaagttgcagcctactgctcggggactactcgagaaggcccctggagttaaacggctgagcagcctggacgacaaaatcccacacaagagcccctgccctagacgcacaatctggttgagccgctcccagagtgatatcttctcaaggaaacctcctcgtacggttagcgttttggacccctattaccgcccaagggacggggctgccagaacacccaaagtgaatcctttcagcgcacggcaggacctgatgggtggtaaaattaagttcttcgatctccccagtaagagcgtcatctccctggtgtttgacctggacgcaccgggaccaggcaccatgcccctggctgattggcaggagccattggctcctcctattcggcgttggcggagcctgcctgggagtcctgagtttctacatcaggaagcctgcccgttcgttggtagggaagagtctctttctgatgggcctccgcctcgcttgagctccctgaagtacagggtgaaggaaatccctccattccgggctagcgccctgcccgcagcccaggcccacgaggccatggactgtagtatcttacaggaggaaaacggcttcggctcgagaccacagggaacaagtccctgtcctgcaggggctagcgaggagatggaggtcgaggaacgaccagccggttcaacccctgcaacttttagcaccagtgggatcggcctgcaaacacaaggcaaacaggatggatag

SEQ ID NO: 31356 - DNA, 1458 bp, Artificial Sequence
  Description of Artificial Sequence: Synthetic coding sequence
atgacactctggatccttccaaagttcaaggctgttgacttttcccccagcctggctgcttacacccacacttggcttctgcccaggtttttggaaattctgattcaatgcggtcattgcaaacgcctcgcccctgagtatgaagcagcggctaccaggctcaaggggattgtcccactcgctaaggtagattgcacagctaatactaatacatgcaataagtatggggtctctggctaccccacgctaaagatcttcagagatggtgaagaggcgggtgcatatgatggacccaggaccgcggacggcatcgtctcgcacttgaagaagcaggccggacccgcatcagtcccactgcggaccgaggaggaattcaaaaagttcatttccgataaagatgcatcaattgtgggcttctttgacgatagtttcagtgaagcccatagtgagtttctgaaagccgcaagcaacctgcgcgacaattaccgcttcgcccacactaatgtggagagtttggtcaatgagtacgacgacaacggtgaaggtatcattctcttccggccttcgcaccttaccaacaagttcgaggacaagactgtggcttataccgagcagaaaatgacatccggcaagattaagaaattcatccaggagaacattttcggcatttgtcctcacatgactgaggataataaagatctcattcaagggaaagacctgcttatcgcctactacgatgtagactacgagaagaacgcaaagggatcaaattactggcgaaacagagttatgatggtagcaaagaagttcctggacgcaggccataaactcaatttcgcagtagccagcaggaagaccttttcacacgaactcagcgactttggactggagtccactgctggagagattccagtagttgccatccgaaccgcaaaaggtgaaaagtttgtgatgcaggaagagtttagtagagatggcaaggctctggagcgattccttcaagactatttcgatggcaacctcaagcgatacctgaaatccgagcctattcccgagtcaaatgacggacccgtgaaggtggtcgttgcagaaaacttcgatgagattgtgaacaatgagaataaagacgtgcttatcgaattttacgctccctggtgtggccactgtaaaaacttagagcccaaatataaggagttgggcgaaaagctgtccaaagacccaaacatcgttatcgctaaaatggacgctacagctaatgacgtaccatctccctacgaagttagaggtttccccactatttatttctctcctgcaaacaaaaaactgaatccaaaaaaatatgagggaggacgggaactgagtgacttcatctcgtatctgcagcgagaggccactaacccgcctgtgatccaggaagagaaacccaaaaaaaaaaagaaagctcaggaagacctatag

SEQ ID NO: 31357 - DNA, 885 bp, Artificial Sequence
  Description of Artificial Sequence: Synthetic coding sequence
atgagcgctcagcacttcgtcagcactgagcaggtggagttgcccggtccgggacaatgggtggtggcagaatgtcctgccagagtagacttctccgggggttggtcggatactccccctcttgcttatgaactcggtggagcagtgctcggattagccgtacgcgtagatggtcgccgacctattggcgctagggcacgacggatacccgagccagagttatggctagccgtcggaccacgccaggacgagatgactgtcaaaattgtttgtagatgtctggcggatctgcgtgactactgtcaacctcatgcccctggagccctcctgaaagccgcttttatctgtgccggaatcgtccatgtccactcagagcttcaactgagtgagcaacttctcagaaccttcgggggagggttcgagctgcatacctggtctgagttgcctcacggatccggcctcggtacatcatcaattctcgccggaaccgccctggccgcactacagcgtgcagccggacgagtcgtcggcaccgaagcccttatccatgccgtactgcatcttgagcaggtgttgaccaccggtggcggatggcaagaccaggtaggcggactgatgcccggaattaaggtgggaaggtctagagcccagctcccactgaaagtggaagtagaagaggtgacagtgccagagggttttgtgcagaagcttaatgaccatctgcttctagtttataccgggaagacccggttggctcgaaacttgctccaggacgtgctgagatcttggtatgctagactgccagcggtggtgcagaacgcccatagcctggttagacagactgaagagtgcgctgaaggtttccgccaaggatcacacatctag

SEQ ID NO: 31358 - DNA, 945 bp, Artificial Sequence
  Description of Artificial Sequence: Synthetic coding sequence
gtgggtcggatggaaggctgtagcagcccaatagtggtgaagttcgccgacacccagaaagacaaagagcagcgacggctgcaacaacaactagcgcagcaaatgcagcagctcaacaccgccacctggggaaatttaacagggcttggtgggttgacaccacaatatctcgctctcctgcagcaagccacatcatcatcaaacctgggggcttttagcggcatacaacaaatggcgggaatgaacgccctccagctccaaaatttggctacactggcggcagctgcggctgccgcacagaccagcgcaaccagtaccaacgccaacccactgtcaacaacctcttcggctctgggcgcacttacatcccctgtcgcggcttcaaccccaaactcaactgcgggtgccgctatgaatagtctaacatccctagggactctgcaggggttagctggcgctaccgtcgggctgaataacattaatgctctcgcaggaatggctgctctgaatggaggcctgggcgctactggcctcacaaatgggacagctggtacaatggatgctctcactcaggcctattcaggaatacagcagtacgcagccgcagcacttcccaccctgtactcgcagagtctgttgcagcagcaaagcgctgctgggtcccagaaggagggcccagagggcgctaacctattcatatatcaccttcctcaagaatttggagaccaggatatactccaaatgttcatgcctttcgggaacgtgatctctgcgaaggtgtttatcgacaaacaaaccaacctcagtaaatgttttggtttcgtgtcctacgacaatcctgtttcagctcaagctgcaattcaggctatgaatggctttcagattggtatgaagcgactgaaagttcaactgaagcgatctaagaatgactcaaagccttattag

SEQ ID NO: 31359 - DNA, 1083 bp, Artificial Sequence
  Description of Artificial Sequence: Synthetic coding sequence
tccatggaaaagacgtacactagtaccagcaacaattccatctctggctcactgaagcgacttgaagatacaaccgcacggttcaccaatgcaaactttcaggaggtaagtgcccataccagcagcggcaaggacgtctcagagacaagaggaagcgaaggcaaaggaaagaagtcttctgcacatagttcaggacaacgcggtaggaagcccggtggcggacggaatccagggactactgtatcagcagcttctcctttcccgcaggccggttataagcgggctcagactagtgggatcgaagaggagacagtcaaagagaagaagcgcaagggaaataaacaatctaaacacgggcctggacggccaaaggggaataaaaaccaggaaaatgtgagccacctgagtgtctcttcagcgtcccctacatcttccgtagcatccgcggctgggtctataaccagcagctcactgcagaagtcccctacattgttgaggaatggatcacttcagagtttatcagtgggtagtagccctgtggggtctgagattagcatgcaatataggcacgacggtgcctgcccaaccaccacgttttccgaactcctgaatgccatccacaacgatcgcggagacagctccaccctgaccaagcaagagctgaagttcattggcatttacaattcaaacgatgtcgcggtttctttccctaacgtggtgtctggtagcggttcctccacccctgtgagctcctcgcacttaccgcagcagtcctccggacacctccaacaggtgggcgctctgagcccctccgccgtctctagtgcagcacctgctgtagccacaacccaggcaaacacactgtctgggtcgagcctgtcgcaggcaccctcgcacatgtacggcaacagaagcaactcttctatggctgccctgatagcccaatcggaaaacaaccagactgatcaggatcttggcgacaacagcaggaacttggtggggagaggatcatcccccagagggtccctgtctccgaggtcgcctgtgtcctcacttcaaattcgctacgatcaacctggctag

SEQ ID NO: 31360 - DNA, 924 bp, Artificial Sequence
  Description of Artificial Sequence: Synthetic coding sequence
atgcaatctctgaccctcgacctactcgggccttctgaacttctgttggctctcaatatggggaacacatcctttaacgaagttatggaggcccagcttccatcccatggaggccctaagccctccgccgagtcagatatgggaactcggagagactatattatggcgaaatacgtggagcatagattcgctcggaggtgcaccccagagcctcagcgcctctggactgccatttgtaatagggatctcctgtcagtgctggaggctttcgcgaatgggcaggacttcggacagcccttgccaggccctgatgcacaggctcccgaggaacttgtgttacacttggctgttaaagtggcgaaccaggcatctttacccctggttgactttattatccagaatgggggtcacctggacgccaaggcagctgacggcaacacagcgctgcattatgctgctctgtacaaccagcctgattgcctgaagctactgctgaagggtcgcgctcttgtaggaacagtaaacgaggcgggagagactgctcttgatattgcccgaaaaaagcaccataaagagtgtgaggagctgctggaacaggcccaagccggaaccttcgcctttccgctccacgtggactactcttgggtgatctcaacagaaccgggtagcgacagcgaagaggacgaggaagagaagagatgtcttctcaaactgcccgcacaagcacattgggcgtccggaaggctcgatatttccaataaaacatacgagaccgtggcgagcctcggggcagcgactccccagggggagagcgaggactgccctcccccactgccagtcaagaacagtagccggactctggttcaaggttgcgccaggcatgctagtggagggaggcgagaagaaagagccaggagagagtag

SEQ ID NO: 31361 - DNA, 1497 bp, Artificial Sequence
  Description of Artificial Sequence: Synthetic coding sequence
atgagttcgtgtgtctcttcacagccttcttcaaatcgcgctgctccgcaggatgagcttggtggacggggtagttcgtcctccgagagccaaaagccctgcgaagccctacgaggtctcagttccttgtcgattcatctggggatggagtcatttattgtggtgaccgagtgcgaacctgggtgcgcagttgacctcgggttagctcgggaccgtccgctggaggctgacggtcaggaagttcccctggatacatcgggaagtcaggctagacctcatctatccggcagaaagctgtcgctgcaggaacgctcccagggtggactggcagccggaggaagcctcgatatgaacggcaggtgcatatgcccgagtctcccttactcacctgtgtctagcccgcagagttctcctcgactacccaggcggcctactgtcgaatctcatcatgtttcaatcactggtatgcaggactgtgtccagcttaaccagtacaccttgaaagatgagattggcaaaggcagttacggcgtggtgaagctcgcttacaatgaaaatgacaatacctattacgcgatgaaggtgctttcaaagaagaagctgataaggcaggccggattcccacgacggcctcctccgcgtggcactcggcctgcccctggaggatgcatacagcctcgagggcctattgaacaggtctaccaggagattgctatactcaaaaaactggatcacccaaacgtggtcaagctggtggaggtgctggacgacccaaatgaagatcatctgtatatggtatttgagctcgtcaaccaaggacctgtgatggaagttccaacactcaaaccgctcagcgaagaccaggccagattttattttcaggaccttattaagggaatagagtaccttcactaccagaagattattcatagagatatcaagcctagcaatctgctggttggtgaggatggtcacatcaagattgcagatttcggagtctctaacgagtttaaaggctccgatgctctcctgagcaacaccgtcggcacccctgccttcatggcgcctgaatcactctcagagacaagaaaaattttctctggaaaggctctggacgtatgggccatgggcgtgacattgtattgtttcgtgttcgggcaatgtcccttcatggacgagcgcatcatgtgcctccattccaagattaaatcacaggcactggaattcccagatcagcctgacatagccgaggacctgaaagatctgattactagaatgcttgataagaaccctgagtctagaattgtcgtcccagagatcaaaatcctggtaaagactatgattcgaaagaggtcattcggaaacccctttgagggcagcaggagagaagaaagaagcctcagtgccccaggcaatctgttgacaaaacagggatccgaagataatctgcagggcaccgacccgcctcccgttggcgaagaggaagttctcctttag

SEQ ID NO: 31362 - DNA, 600 bp, Artificial Sequence
  Description of Artificial Sequence: Synthetic coding sequence
atgaccccgctggcgccttgggatccaaagtacgaagctaaagccggtccacgcccagtctggggtgctaattgcagctccggcgcttctttctccggacgaacattatgccacccgagcttttggcccctgtatgaggcggcttccggtcgaggactccgtcccgtagctccagccacagggcattggaacggacaacaagcaccacccgacgctggtttcccagtggtatgctgtgaagacgttttcttgagtgatcctctcttgccacggggacagcgagtgcccctatacttgtccaaagctccacagcagatgatgggaagcctcaaactcctcccccctccacctatcatgagcgcccgtgtcctgcctagaccgtcgccttccagggggccaagcactgcgtggttgtctggacccgagttgatcgccctcaccggactcctgcagatgtctcaaggcgaaccacggcctagctcctctgcagttggtccccctgatcacaccagcgaccctccttctccttgtggttcacccagctctagccagggtgccgacctgagtttgcctcagacacccgacacacactgtccctag

SEQ ID NO: 31363 - DNA, 1248 bp, Artificial Sequence
  Description of Artificial Sequence: Synthetic coding sequence
atgtggcggaaggtctacacacccagatctagttttgagctatccgcgcagcctccgtcatgggaacagcgtaagctgctggaaaaatgcgcaatgactgccctatcttccaagctgattagtcagcaaaaggcttttttcgccaagatggtggtggatgcggtgatgatgctggacgacctgctgcagttaaaaatgattgggattaaaaaagttcagggtggagctttggaagacagccagcttgtcgctggtgtcgctttcaaaaagacattttcctacgcaggctttgaaatgcaacctaagaagtatcataatccaaagattgcgctgctgaacgttgagttggaactgaaggctgaaaaagataacgcggagatcagggtgcatacagtcgaggactatcaggctattgtcgatgccgaatggaacattctctatgacaagctggagaagattcaccactctggcgctaaagtcgtcttgagcaagctgcccattggtgatgtggccacccaatactttgccgaccgcgatatgttttgcgccggaagggtgcctgaagaggacctgaagcgaacaatgatggcctgcgggggtagcattcagacatccgtcaatgccttaagtgcggatgttctgggcaggtgccaggtgttcgaggaaactcagattggcggtgaaaggtacaactttttcacaggatgccccaaggccaagacgtgtactttcattctgcggggaggagccgaacagtttatggaggaaacggagcggagtttgcacgatgcaattatgatagtccggagggctatcaagaacgactccgtggtcgccggtggcggagctatcgagatggagctgtctaaatacctgagagactactcaaggacaatccctggtaaacaacagcttttaattggcgcatatgctaaggccctggagattatacctagacagctgtgcgacaatgccggttttgacgcgacgaacattctgaataaacttagagcaaggcacgcacaaggtggtacttggtacggtgtggacattaacaacgaggacatagccgacaacttcgaggctttcgtgtgggagcctgctatggtccgaatcaacgctcttaccgctgctagcgaagcggcttgcctcattgtaagcgtggacgagaccattaagaatccaaggagtactgtagacgcgccaactgccgctggtcgcggaagaggccgtggccgacctcactag

SEQ ID NO: 31364 - DNA, 3117 bp, Artificial Sequence
  Description of Artificial Sequence: Synthetic coding sequence
atggtcagctctgcacaaatgggatttaacctgcaggcgctgctggagcagctgtctcaggatgaactgtcaaagtttaagtaccttatcactactttttctctcgctcacgagctgcagaagataccccataaggaagttgacaaggctgacggaaaacagctcgtggagattttaaccacacattgtgattcatattgggtggagatggcctcgctgcaggtgttcgaaaaaatgcacagaatggatctcagtgagagggcaaaagatgaggtgcgtgaggcagcccttaaatcttttaacaagaggaaacctctgtctctagccttcactgagaccaagggcaatgttatctgtctgggcaaggaagtgttcaaggggaaaaaaccagataaagataatcgctgccggtatatccttaagacgaaatttcgcgagatgtggaagtcttggccaggtgacagcaaagaagttcaagtaatggcagagaggtataaaatgctcatcccgttctctaatcctagagtcttgccgggtcccttttcctacacagtagtgctatacggcccagcaggcctgggcaaaaccacactggcacaaaagctgatgctagactgggccgaggacaatctgatccataaattcaaatatgccttttacttatcttgcagggagcttagtaggctcggcccttgttctttcgccgaactggtgttccgggattggcccgagctccaggatgacatcccacacatcctggcccaggccagaaaaatattatttgtaattgacggcttcgatgaactgggagctgcgccaggcgctcttatcgaagatatttgcggtgattgggaaaaaaaaaaaccagtgccagtgctcttagggtcactgttaaaccgcgtaatgctgcctaaagccgcattgctggtgaccactcgccctagagccttgcgggaccttaggatcctcgccgaggaaccaatctatatcagagtagagggatttttggaagaagatagaagggcttatttcctgagacatttcggcgacgaggatcaggccatgagagcattcgaacttatgagatccaacgctgcactctttcagcttgggagtgccccagccgtatgctggatcgtctgtaccacactgaagcttcagatggaaaaaggggaagaccctgtacccacctgcctgacaagaaccggcctcttcctccggttcctgtgctccagatttccccaaggggcacagcttagaggcgctctccgtactctgtccctgctcgcggctcagggactgtgggctcagacaagcgtgctccatcgggaagacctggaaaggctcggcgtgcaagagagcgacctgagactctttctggacggcgacatcttacggcaggaccgcgtgtcaaagggttgctacagctttatacacctctcctttcagcagttcctcaccgccttgttctacactctggaaaaggaagaggaagaggatagagatggacacacctgggatattggggacgtccagaagctgctctccggcgtggaacgcctcagaaatcctgacctgattcaagccggttattacagttttggcctggccaacgaaaaaagggcaaaagagctggaggcaacctttggctgtaggatgtccccggacattaaacaagaactgctaagatgcgatatctcctgcaagggcggacattcaaccgttacagatctccaggaactcttgggatgtctatacgagtctcaggaggaagagcttgttaaggaagtcatggcacagtttaaggaaattagtctccatctgaacgctgtggatgtcgtcccgtctagtttttgcgtgaagcactgccggaaccttcagaaaatgagccttcaggttataaaggagaatctgccagaaaacgtgacagcatcagagagcgatgcggaagtggaacgctcacaggatgatcaacacatgctgcctttttggacagatctctgttcaattttcggcagcaataaagaccttatgggtttggcaattaatgattctttcctcagtgccagtctggtgcggattctgtgcgaacagatcgcgtccgacacttgtcatcttcagagggtcgttttcaaaaatatctcacctgccgatgctcaccgaaacctgtgtctagccctgagaggacacaagaccgttacatacctcacgctgcaaggcaacgatcaggacgacatgttccccgctctttgtgaagtcttgagacaccctgagtgtaatcttcggtacctggggctcgtttcttgcagcgccactacacagcagtgggctgacttgtcgttggctcttgaggtgaaccagtctcttacttgtgtcaacttaagcgataatgagcttctggatgagggcgcaaagcttctctacactacactccggcacccaaaatgttttctgcaacgactttcccttgagaattgccatctgacagaggccaactgtaaagatctagcagcagttctcgtagtcagcagggagctgacccacctttgcctcgcaaaaaatcctatcggaaacaccggcgtcaagttcctatgtgaaggcctgcggtaccccgagtgcaagctgcagacgttagttttgtggaattgtgacatcacgagcgatgggtgctgtgacctcacaaaattgttacaagagaagtcttctctgctgtgccttgaccttggcttgaatcatattggagtgaaaggaatgaaatttctgtgtgaagctttacgcaagcctctttgcaatctcaggtgtctgtggttatggggttgtagtattcccccatttagttgcgaagacctctgcagcgcgctgtcatgtaaccaaagccttgtaaccctcgacttggggcagaatcccctggggagcagcggcgtgaaaatgctcttcgaaacgctgacatgctcaagtgggacgcttcgcactctccgccttaagatcgatgacttcaatgatgaactgaataagctcctcgaggagatcgaggagaagaacccccaactcataatcgacaccgagaaacaccacccctgggctgagcgcccttcctcccacgacttcatgatctag

SEQ ID NO: 31365 - DNA, 1443 bp, Artificial Sequence
  Description of Artificial Sequence: Synthetic coding sequence
atgaggcttagacgattggccttattccccggagtggctcttctactcgcagccgcacggctcgcagccgcttctgagttcttcgccccttggtgcggacactgtaaacgcctagcgcctgagtatgaggccgctgctacaaggctgaagggaatcgtgccactagccaaggtagactgcacagccaatacaaacacctgcaacaaatacggggtgtctggatatccaacattgaaaattttcagggacggcgaggaggccggagcttatgacggacctcgtactgcagatggtatcgtgagtcatctgaagaaacaggcgggtcccgcaagcgtgcccctccgaactgaggaggaatttaagaagttcatcagtgataaagatgcatctattgtaggcttttttgatgacagctttagcgaagcccactccgagttcctgaaggcggcaagtaatctgcgggacaattatcgattcgcccacacgaacgtggagagcttagtgaacgagtatgacgacaatggggaagggattattctcttcagaccctcgcatctaacaaacaagtttgaggacaagaccgttgcctacactgaacagaagatgactagtgggaaaattaagaagttcatccaagaaaacatttttgggatttgcccacatatgacagaggataacaaggacttgatacaaggaaaggatttgctgattgcctattatgatgtcgattatgagaagaacgctaaagggagtaattattggaggaacagggtgatgatggtggcaaaaaagtttctggatgccggtcacaagttaaacttcgcggtcgccagtcgaaaaacattctcccacgagttaagtgacttcggcctggaaagcacagcaggcgagatacctgtcgttgctatccgtactgctaagggtgaaaagtttgttatgcaagaagagttttcccgggacgggaaggcgttggaaagattcctccaggattatttcgacggtaacttgaagcggtacctcaagagtgaacctatccctgagagcaacgatgggcctgtgaaagttgtagtggctgagaacttcgatgaaatagtcaacaatgagaacaaggacgtcctcattgagttttacgctccctggtgtggccattgcaagaatctggaacccaaatataaggagctaggagaaaaactcagcaaagaccccaacatcgtgattgcgaagatggacgcaacggccaatgacgtgccatcaccatatgaggtgcgtgggttccctactatatattttagcccagccaataagaagcttaatcccaaaaaatacgaagggggacgggagcttagcgatttcatatcatacctgcagcgcgaggcaaccaatcctcctgtaatccaggaagagaaaccaaagaagaagaaaaaggcccaggaagatttgtag

SEQ ID NO: 31366 - DNA, 228 bp, Artificial Sequence
  Description of Artificial Sequence: Synthetic coding sequence
atgggtgtgaaactcgaaatttttcgtatgattatctacctcaccttccctgtggcgatgttctgggtgagtaaccaagcggagtggtttgaggatgatgtaattcagcggaagcgagagctgtggcctcccgaaaagctccaggaactggaggagtttaaagagagactgcgtaaacgcaaacgccgtgaagagaaattactgcgggatgcccagcagaatagctag

SEQ ID NO: 31367 - DNA, 807 bp, Artificial Sequence
  Description of Artificial Sequence: Synthetic coding sequence
atgggatccgccaagtccgtgcctgtcacccccgcaaggccccctccgcacaacaaacacctggccagagtggccgatccccgaagcccatccgctgggatcctaaggacccccattcaagtggaatcatctccacagcccggactccccgctggtgagcagctggaaggcctgaaacacgcacaggactcagacccaaggagtcccactttagggatcgccagaacgcccatgaagacaagtagcggcgaccctccaagcccacttgttaagcagctgtcagaagtgttcgagacagaggactctaaatctaacctgcccccagaacccgttttgcctccagaggctcccttatccagtgagctggatttgcccttaggtacccaattatccgtggaggagcaaatgcccccttggaatcagacagagttcccttccaagcaggttttctccaaggaggaagccaggcagcccaccgaaactcccgtggctagccagtcttcagataaaccttcaagggaccctgagacccctcgttcatcaggatcaatgagaaaccgctggaaaccaaattcctctaaggtgctcgggcgatcccccctgaccatcttgcaggatgataatagccccggtactttgactctgagacagggtaagcggcctagtcccctgagcgagaacgttagtgagctgaaggagggagccatacttggtactgggcgattgctgaaaacgggaggcagggcatgggaacaggggcaggaccatgacaaggaaaaccagcactttcccctcgttgagtcatag

SEQ ID NO: 31368 - DNA, 351 bp, Artificial Sequence
  Description of Artificial Sequence: Synthetic coding sequence
atgttacttgaatgcggtatgcaggaagaagggctgttcagagttgcacctagtgcttcgaaattaaagaaactaaaagcagccctagactgttgtgtggtcgatgtgcaagagtactctgcagatccacacgctatagccggtgcgcttaagtcctaccttcgtgagttgcctgagccactcatgactttcgagctatacgacgagtggatccaagcatcgaatgtacaggaacaggacaagaaactccaggcactgtggaacgcctgcgagaaactgcccaaggccaaccataataacattagatacctgatcaaattctatccaagctgtcagaatataaaaatgtag

SEQ ID NO: 31369 - DNA, 906 bp, Artificial Sequence
  Description of Artificial Sequence: Synthetic coding sequence
atggtcaggaccaagacgtggacgctgaaaaaacatttcgttgggtatcccaccaatagcgacttcgaactgaagactgccgaattaccccctctcaagaatggtgaagtgctcctcgaggcccttttcctgacagtagacccttatatgcgcgtggcagccaagagactgaaggagggcgatacaatgatgggacagcaggtcgcaaaggtcgtggagagcaagaacgtggccttgcccaagggtaccatcgtcctcgcttcccccggatggacaacccacagcatttccgatgggaaggacttagagaaactgctgacagagtggcctgatacaattcccctttccctggctcttggcactgtcggtatgccagggctcaccgcatattttggcttgctggagatatgcggtgtaaaaggaggggaaaccgtgatggtgaacgctgcagcaggcgcagtgggcagcgtagtgggacagattgcaaaattgaagggatgtaaagtggttggggcagtcggatctgacgagaaggtggcttatctccagaagttgggatttgatgtcgtcttcaactataaaacagtggaatcactggaagaaacactcaagaaggcaagcccggatgggtacgattgttacttcgataacgtgggaggcgaattttctaatacagtgattggccagatgaagaaattcggccgtattgccatatgcggcgcaatctcaacttacaaccggactggaccactccctcccggtccaccgcctgagatcgtcatttatcaggagttgcgtatggaggcattcgtggtgtaccggtggcagggcgatgctcgtcaaaaggctttgaaagatttactgaaatgggtgttggaaattaagcgagaaaacgaggaggactag

SEQ ID NO: 31370 - DNA, 1068 bp, Artificial Sequence
  Description of Artificial Sequence: Synthetic coding sequence
atgctgggctcagggtttaaggccgaaagactcagggtgaaccttcggttggtcatcaacagactgaaactcctcgagaagaagaagacagagctggctcaaaaagccaggaaggagatagccgattacctagccgctggaaaagatgagcgtgcacgcatcagggtcgaacatatcatcagagaggactacttagtggaagccatggagatcctggagctttattgtgatctactccttgccaggttcggactaattcagagtatgaaagaacttgactcagggttggccgaaagcgttagtaccctggctgaactgaaaatagtagcagaccaattgtgcgctaagtactctaaagagtatggcaaactctgtaggactaatcagatcggcactgtcaatgacaggctcatgcataagttaagcgtggaggcccctcctaagattcttgtggagcggtacctgatcgaaattgctaagaattacaatgtgccgtatgaacccgactctgtggttatggccgaggctccaccgggagttgagacagacctaatcgacgttgggttcacggacgatgtgaagaaagggggacctggacggggaggctccggaggtttcacagcgccagttggcggaccagatggaaccgtgcccatgcccatgccgatgcccatgcccatgccctctgctaatacacctttcagctaccccctacctaagggacccagcgatttcaacggtctgcccatgggcacgtatcaggccttccctaacattcatcctcctcagatccccgctacccccccatcctatgagtctgtggatgacattaatgctgacaagaatatttcgtcagcccaaatagtggggccaggcccaaagcccgaagcaagcgccaagctcccaagcaggccggctgacaactacgacaattttgtgctgcctgagctcccatccgtgcccgataccctgcccactgcctctgctggggcaagcactagcgcttctgaagacatcgatttcgatgacctctccagacgcttcgaagaactgaaaaagaaaacatag

SEQ ID NO: 31371 - DNA, 2175 bp, Artificial Sequence
  Description of Artificial Sequence: Synthetic coding sequence
atgcagatgaccatacaagccctgcaggatgaattacgcatccagagagaccttaatcagctctttcagcaagacagctcctcgcgaaccggcgagccatgtgtcgccgaactgaccgaggagaacttccagagactgcacgcggagcatgagcgtcaagcaaaggagctcttccttttacgtaaaacactggaggaaatggagctcaggatagaaacccagaaacagactttaaacgctagagatgagagcatcaagaaacttttggagatgctacagagcaaaggactgtctgccaaagctaccgaggaagaccatgagcggacaaggagactggctgaagccgaaatgcacgtccatcacctggaatcccttctagaacagaaggagaaagaaaactcaatgctgcgcgaggaaatgcaccgtcggtttgaaaacgctccagattccgccaagactaaggccctgcagacagttattgaaatgaaagactctaaaatttcatccatggaaaggggactgcgcgacttagaggaggagatccagatgctaaaatctaacggtgccctctccacggaggagcgcgaggaggaaatgaaacaaatggaagtgtatcgtagccacagcaagttcatgaagaataagatcggtcaagttaagcaagagttatcccggaaggatacagagcttcttgccctacagaccaaactggaaaccttgactaatcagttttcagactctaaacagcacattgaagtgctaaaagagtctttgaccgccaaagagcagcgggctgctattctacaaaccgaagtggatgccttaagactgcgtttggaggagaaggagactatgcttaacaagaagacaaaacaaatccaggatatggccgaagagaagggcactcaggccggtgagatccacgatctgaaagatatgctggacgtaaaagaaaggaaggtgaacgttctgcagaagaagatcgaaaatctgcaagagcagctacgagacaaagaaaaacagatgtccagtctgaaggagagagttaaaagcctgcaggctgacaccaccaacactgacacggcccttaccactctggaagaagccctcgccgagaaggaacgaactatagagagactcaaagagcagagagacagggacgaaagggagaaacaagaggagatcgacaactataaaaaagaccttaaggacctgaaagagaaggttagccttcttcagggggatctaagcgaaaaggaagccagtctgctggatcttaaggagcatgccagtagcctcgccagctcagggctcaagaaggactcacgccttaagacacttgaaatcgcgctcgaacagaaaaaggaagagtgccttaagatggaatcccagctgaagaaagcacacgaagccgctctcgaagcacgcgcatcccccgaaatgtcagaccgtattcagcatctagaacgggaaatcacgagatacaaggacgagtcgtccaaagcacaggccgaggtggatcgcctgctcgagattctgaaagaggtcgaaaacgagaaaaatgacaaagacaagaagatcgcagagttggaatcactgacctcgagacaggtcaaagatcagaacaagaaggtcgctaacctgaagcacaaggaacaggttgagaaaaaaaaatccgcgcagatgctggaggaggctcgaagaagggaagacaatcttaatgactcatcccagcagctccaggtggaagaactgctcatggctatggagaaggttaaacaggaattggagagcatgaaagcaaaattaagttcgactcagcagtctttggcggaaaaagagacacacctgaccaatttacgggcagagcgtcgaaaacacctggaggaagtgttagagatgaagcaggaagctttactggccgcaattagcgagaaggacgctaacattgctctgttagaactatcctcttctaagaaaaagactcaggaagaagtggccgcactgaaacgcgagaaggatcggttggtacagcagttgaaacagcagacgcagaacagaatgaagctgatggccgataattatgaagatgatcacttcaaaagcagccactccaaccagactaatcataaacctagccctgaccaggatgaggaagagggcatttgggcctag

SEQ ID NO: 31372 - DNA, 408 bp, Artificial Sequence
  Description of Artificial Sequence: Synthetic coding sequence
atggccattggttttaatgtggagacagtaacctataagaacctgaagtttcaggtgtgggacctgggcggacagacgtctataaggccttactggcgatgttactatagtaacaccgacgccgtcatttacgtagtggattcctgtgacagagaccgcatcgggatttctaagagtgaactggtcgcaatgctggaagaagaagaactcaggaaggctatcctggtggtgttcgccaacaagcaggacatggaacaggctatgaccagtagcgaaatggctaatagcctaggtctccccgctttgaaagatagaaaatggcagatctttaagacatccgcaactaagggcacaggcctggatgaagccatggagtggttagtcgagaccctgaagagcaggcagtag

SEQ ID NO: 31373 - DNA, 684 bp, Artificial Sequence
  Description of Artificial Sequence: Synthetic coding sequence
cgacgacagatcctgaaggagctggcactgtgcttgcgcaggcaggagatgtatggacccagggcagctagccgcaacaaagagacatctgctggtcctgtcgcagtgatgggtaaagactattacaagatcttaggcatccccagtggcgctaacgaggacgaaatcaagaaggcttatcggaagatggcattgaagtaccacccagacaagaataaggagcccaacgcggaggaaaagttcaaggagatcgcagaagcctacgatgtgcttagcgatcccaaaaagcgaggcctttatgaccagtacggggaggagggccttaagactggaggagggaccagcggcggttcctcaggaagcttccactacacattccatggcgacccccacgctacctttgccagcttctttggcggatccaacccttttgacattttctttgcatctagtagaagtactagacccttttcaggtttcgatcccgacgatatggatgtggatgaggatgaagacccctttggcgcattcggtagattcggtttcaatggtttatcgcgagggcctcggcgtgcaccagagccactctacccgagacgcaaagttcaggatccccctgtggtgcacgaactgagggtctctctcgaggagatctaccatggatccactaaacgcatgaagtag

SEQ ID NO: 31374 - DNA, 252 bp, Artificial Sequence
  Description of Artificial Sequence: Synthetic coding sequence
atgtccatgctgaagccctccggtctgaaggcaccgactaagattctaaagcctggcagcactgcactgaagacccccacggctgtcgtggctcctgtggagaaaacgattagctctgagaaagcctcatccacccccagcagcgaaacccaggaagagtttgtagatgacttccgggtcggagagagagtgtgggtgaacggaaacaagcctggttttatccagttcctcggcgaaacccagttcgcatag

SEQ ID NO: 31375 - DNA, 642 bp, Artificial Sequence
  Description of Artificial Sequence: Synthetic coding sequence
atggacatgctcggtggcccaggcattgagtcacaatgccgaaaggtggatataattgcagacgcagcttacagcatctttcagaagccaaagagtttcaccgggaattttgtaattgatgagaacattctgaaagaagagggtatcgaaaatttcgacgtttacgctatcaagcctggacatcctttacaacctgatttctttctggacgaatatccagaggcggtgtcgaaaaaggtggagagtaccggcgcagtgcccgagtttaaagaagaaaagctgcagctccagcctaaaccgagaagtggcgcagttgaggagactttcagaattgtgaaggacagtctgtctgatgatgtggtcaaagccacccaggccatatatctgtttgagctgtcaggggaagacgggggaacatggtttctggacctaaagagtaaggggggtaatgtgggctatggagaaccttctgaccaggccgatgtcgtgatgagtatgaccaccgatgacttcgtgaaaatgtttagcggaaaactgaagccgaccatggcctttatgtcaggtaagctgaaaattaaaggtaacatggccctggcaatcaaactcgagaaactgatgaatcagatgaacgcccgactgtag

SEQ ID NO: 31376 - DNA, 1230 bp, Artificial Sequence
  Description of Artificial Sequence: Synthetic coding sequence
atgaacagaacctggccccgtcggatctggggctcatctcaggacgagcctgaattcgcaagctccgtgagacggcctcacctgacttccgacgctgtcgctctcctgagagacaatgttacgccaagggagaacgagttgtggacatccctaggtgacagctggaccagacccggtcttgaactgtccccagaagagggacctccctatcgtcccgagttcttcagtggatgggaaccgcctgttaccgacccccagtcccgggcatgggaagatccggtggaaaagcagctgcagcacgagcggagaagacgccaggtgactcaagctacgcagcaagggcgaggatgggaagtgcggggaagaggtaggtccgcttggccacggttgactaggctgagttacttcctgcagcagtcagccccacaggtcgcagttaacggtcaccgagacctcgagcccgaaagcgagccccagctggaaagcgagactgcaggtaaatgggtgctgtgtaactacgactttcaggctcgtaactcaagcgagctatccgtcaagcaacgtgacgttctggaggttctcgacgattcaagaaagtggtggaaggtgcgggatcccgcaggccaggaagggtacgtgccctataacattttgactccctatcccggacccaggctgcatcactcgcagagtccagccagaagcctaaacagcacaccccctccccctcctgctcccgctccagcgccaccgccagcactagccagacctcgttgggacaggcctaggtgggatagctgcgattcacttaacgggctcgatccctccgagaaagagaaattctcacagatgctgattgtaaacgaggagctgcaggccaggctggcccagggcaggtccggaccgagtcgagcggtccctggaccaagagcccctgaacctcagctgtccccaggcagcgatgccagtgaggtcagggcatggctgcaggccaagggcttctcatcaggaaccgtcgacgcactgggtgtgttgaccggcgctcaactattctccttgcaaaaggaagagttacgcgctgtgtcccctgaggagggtgcgagagtgtacagtcaggtcactgtgcagagatcccttctggaggacaaagagaaggtcagtgagttggaagccgtgatggaaaaacaaaagaaaaaagtggagggggaggtcgaaatggaagttatttag

SEQ ID NO: 31377 - DNA, 1425 bp, Artificial Sequence
  Description of Artificial Sequence: Synthetic coding sequence
atggcttctctgagtcgcgcactccgagttgcagccgcacaccccagacagtcccctaccagggggatggggccatgcaatttgtctagcgccgctgggccaactgcggagaagtccgtcccttaccagcgtactttaaaggaaggacagggaaccagtgtggtggcccagggaccctcccggcctttgccttcaactgcaaacgtagtggtgatcgggggtgggtcgctgggctgtcagactctctaccacctcgccaagttaggaatgtctggtgccgtcctgctcgaaagggagcgtttgacctctggcacaacatggcacaccgctgggctgctgtggcagctcaggccaagcgatgtagaggtcgagttattagcacacacaaggcgagtagtgagcagagaactggaagaggagaccggcctgcacacagggtggatacagaatggtgggctgtttatcgcttctaatcgccagcgcctggacgagtataagcggctcatgagtctcggaaaggcctatggcgtggagagccatgttttatcacccgcagaaaccaagactctatacccactcatgaacgtggacgacctttatgggactctgtatgttcctcacgatggcaccatggatcccgctgggacctgcactactctcgcaagagctgcctctgctagaggagcccaggtaatcgagaattgccctgtcacaggcatacgggtgtggacagatgactttggcgttcgcagagtggccggagtggagacacagcatggctctatacagaccccttgtgtcgtcaactgtgcgggagtatgggcttcggctgttggaagaatggcgggagtcaaagtgccgctggtcgctatgcaccatgcctatgtggtcaccgaacgcattgaaggcatccagaatatgccaaacgtgagagatcatgatgcctctgtgtacctaaggctccagggcgacgccctgagtgtgggagggtatgaagcaaatcccatcttctgggaagaagtgtccgataaattcgcatttgggctgtttgatcttgactgggaagtatttactcagcacatcgaaggggcaataaaccgtgtccctgtgttagagaagaccggcattaaaagcacggtgtgcggcccagaatcattcactccagatcataaaccacttatgggggaggctcccgaactgagaggcttctttcttgggtgcggcttcaatagcgcgggaatgatgcttggcggaggttgtggacaggagttagcccactggatcattcacggcagaccggaaaaagatatgcacggatatgatatccgcaggttccatcattccctcacagaccaccctaggtggattagggagagaagccacgaatcctaccaggagctcctgcgacgtcttccgccacgctag

SEQ ID NO: 31378 - DNA, 1893 bp, Artificial Sequence
  Description of Artificial Sequence: Synthetic coding sequence
atgtccatagaattgcagtcggtgtccaatcctgtccaccgcaaagacctagtgattcgtctgaccgatgacacggaccccttcttcctctacaaccttgtgatctcggaggaggacttccagtctttaaagtttcagcagggcctcctggtagacttcctggccttcccgcagaaatttatcgacctcctgcagcaatgtacacaagagcacgctaaagagatccctaggttcctgctccaactcgtgagtcccgctgcgatcctggataattctcctgcctttttaaacgtggtggaaaccaatccattcaaacatcttacgcatctgtcgctcaaacttcttcccggaaatgacgtggaaatcaaaaagttcctggccggatgtcttaaatgttccaaggaggagaagctctccctgatgcagtcgctcgacgacgcaaccaagcagctggactttacccggaagactttagcagagaaaaagcaggaactggacaagcttcgcaacgagtgggcaagccacaccgctgccttgaccaataagcatagccaggagttgacaaatgaaaaggaaaaggccttgcaggcccaggtacagtatcagcagcagcatgagcagcagaagaaagatctggaaatcctccaccagcagaatatacatcagcttcagaacagactctccgagcttgaagctgccaataaagacctcaccgagaggaagtacaagggagatagcacaattagagagctaaaggctaagctgagcggggtggaggaagagctgcaacgaacaaagcaagaagtcctgtctctgcggagggaaaactcaacgctggacgttgagtgccacgagaaagagaagcatgtgaaccagctgcagactaaggtggccgttctcgagcaagagattaaggataaagaccagctcgtgcttcgaactaaggaggcgtttgacactattcaggaacaaaaagttgtgttggaagaaaacggagagaaaaatcaggtgcaactcgggaagctggaagcaaccattaaaagcttgagcgccgagttactaaaagctaacgaaattattaaaaaactccagggagatctaaaaacactgatgggtaaactgaagctcaagaacaccgtgacaattcagcaggaaaagttgcttgcggagaaggaggaaaagctccagaaggaacagaaggagctccaagatgtcggccagagccttaggattaaagagcaggaggtgtgtaaacttcaggagcagctggaggcaactgtcaagaaattagaggagtctaagcagttacttaagaacaatgagaaactgatcacctggcttaacaaggagttgaacgaaaaccaactggttcgcaagcaggacgtgctgggaccttcaacaacccccccagcacacagcagttcgaatacaataaggagcgggatttctcccaacctaaacgtggtcgacggcaggctaacttatccaacgtgcggcataggttatccagttagctccgcctttgcttttcagaatacgttcccacactccatttctgccaagaatactagccaccccggaagtggaaccaaagtacaattcaaccttcagtttaccaaaccaaacgcaagcctgggggatgtgcagagtggcgcaaccatatcaatgccctgttccaccgataaggaaaacggcgaaaatgtgggattggaatccaagtacctgaaaaaaagggaggattctattcctttgaggggtctgtcacagaatctattttctaactcggatcatcagcgcgatggaacactgggggcattgcatactagttcaaaacccaccgccctgcccagcgcttcaagtgcttattttcctgggcagctgccaaactcctag

SEQ ID NO: 31379 - DNA, 1170 bp, Artificial Sequence
  Description of Artificial Sequence: Synthetic coding sequence
atggaccgagaaacgctcatcgacgtggccagaacttcgctgcgaactaaggtgcacgctgaactggccgatgtcctcacggaggcagtcgtcgacagcatactggcaattaagaagcaggacgaaccaattgacctctttatgatcgagataatggagatgaagcacaagtcagaaacagatacatctctgattagaggactcgtgctagatcatggagctcgccatccagatatgaagaaacgggttgaagatgcctatatcttgacatgcaatgttagtttggagtatgaaaagacggaggtgaattccggatttttttataagtccgctgaagaaagggagaagttggtaaaggctgaacggaagttcattgaggatcgcgtcaagaaaataatcgagctgaagcgaaaggtatgtggagattctgacaaaggctttgtcgtcattaaccagaaggggatcgatcctttttccttggacgcgctgagcaaggaagggatcgtggctctgcgcagagccaaacggcgaaacatggaacgcctaactctggcttgcggaggagtggccctcaacagcttcgacgacctctccccggattgcttggggcacgcagggctggtgtacgaatataccctcggggaggaaaaatttacattcattgagaaatgtaataaccccagaagtgtgaccctattaatcaagggcccaaataaacacacgttgactcagatcaaggatgccgttcgcgacggattgcgtgccgtgaaaaatgccattgacgacggctgcgtcgtgccaggagccggtgctgtcgaagtggctatggccgaagcactcataaaacataagccttcggttaagggcagagcacagctgggcgttcaggcctttgccgacgctttacttattatcccgaaagtgctggcccagaatagtgggttcgacctgcaggagactttggtgaagattcaggccgagcacagtgagagtggccaattggtgggcgtggacctgaatacgggagagccaatggtggctgctgaggtaggtgtgtgggacaattactgtgtgaagaagcagcttctccacagctgcactgtcatcgccacaaacatcctgctcgtagatgagatcatgcgcgctgggatgagctctttgaaaggctag

SEQ ID NO: 31380 - DNA, 441 bp, Artificial Sequence
  Description of Artificial Sequence: Synthetic coding sequence
atgacagtgaacgaggccaaggaaaagctgaaggaggcccctgagggaacgttcttaatccgtgattcctcacactcagactacctcctgacaatctccgtgaagaccagtgccggacccaccaatctaagaatcgagtaccaagatgggaagtttaggttagactcaatcatttgtgtgaaatctaagctcaaacaattcgattccgtggtccacctgattgactattatgtacagatgtgcaaagataagcgtaccggacctgaggctcctcgcaacggaaccgtccacctgtacctcactaaaccgctttatacctcagcaccctccctccagcacttgtgtaggctgaccatcaacaagtgcacaggcgcaatatggggattacctcttccaactaggctgaaagattatctggaagagtataaattccaggtctag

SEQ ID NO: 31381 - DNA, 1905 bp, Artificial Sequence
  Description of Artificial Sequence: Synthetic coding sequence
atgcttgaatacgccctgaagcaagaacgggctaaatatcacaaactgaaattcggaactgacttaaaccaaggcgagaagaaggcagacgtttctgaacaggtgtcaaatgggccagtagagtctgtcacattggagaattctcccttagtgtggaaagagggtaggcaattgctacgccagtatcttgaagaggtggggtacaccgataccattttggatatgagatctaagcgggtgagaagcctccttggacgttccctggagctgaatggtgctgtcgagccttcggaaggagcccctcgggctccccctggccctgcaggcctatcggggggtgaatccctcctcgtcaaacagatcgaggagcagatcaagcgcaacgccgctggcaaagacggtaaggaacgcctgggcggatctgtcctgggacagatcccattcctccaaaactgcgaggatgaagattctgacgaggatgatgaactcgacagtgtccagcataaaaaacagagggttaaactaccctccaaggctctggtgccggagatggaggacgaggatgaagaagacgattcggaggacgccatcaatgagtttgacttcttagggtcaggggaagacggagaaggcgctcccgacccaaggagatgtaccgtggacggctcgccgcatgagctcgaaagccgcagagtgaaattgcaggggatcctcgctgatttgagagacgtggatgggctgcctcccaaagtcacagggcctcccccaggcaccccgcaacccagaccccacgaggacgttttcattatggacacaattggaggtggagaagttagcttgggcgacttggccgacctgacagtcaccaacgacaacgatctgagttgtgatctgagtgatagcaaggatgcatttaagaagacttggaatcctaaatttactttgagatctcattatgacggaattaggtcattagccttccaccattctcagtctgcactgctgaccgcctcagaggacgggactctcaaactgtggaatctgcaaaaggcagtgaccgccaagaagaatgcggcactcgatgtggagcctatacacgcatttcgcgcacaccgtggcccagtgctggctgtagccatggggtctaacagcgagtattgctactcaggaggagccgatgcctgcatacactcctggaagatcccagacctgtccatggatccatacgacggttatgatccttcagtgctgagtcacgttttggagggtcacggcgatgccgtttggggcctggccttcagccctacatcacagcgactggctagttgcagtgcggatggcaccgtgagaatctgggacccttctagtagctctccagcttgtctgtgcacctttccaactgcatcagaacacggagtgcccacctcagtggcgttcacgagtacagagcctgcacatatcgtggcttcttttcgcagtggagatacagtgttgtacgacatggaagtgggttctgctttattgactttagagagtcggggatcctctggacccacacaaattaatcaggtagtctcccaccctaaccagcctctgaccatcactgcccatgacgaccggggtatccggttcctcgacaaccggacaggaaagcctgtacactccatggtggcacatctcgacgcagtgacctgtctggcagtggatccaaatggagccttcctgatgagcgggagccacgactgttccctacgactatggtccctagacaataagacatgtgtgcaagagattactgcccatcgcaaaaagcacgaagaagctattcacgcggttgcatgtcacccttcaaaagcactaatcgcttctgcaggcgctgacgcactggctaaagtcttcgtgtag

SEQ ID NO: 31382 - DNA, 1368 bp, Artificial Sequence
  Description of Artificial Sequence: Synthetic coding sequence
atgagcagtctgggggctagcttcgtacagattaagttcgacgacctgcagttcttcgagaactgtggaggcggatcctttgggtctgtctaccgggctaaatggataagccaggacaaagaagtggccgttaaaaaactcctcaaaatagagaaagaggccgagatattgagcgtcctctcgcatcggaacattattcaattctatggggtgatcctagaacctccgaattacggaattgtgacagagtatgcatcgctgggctctttgtacgattatatcaattctaaccgttcagaggagatggacatggatcatatcatgacctgggctacagatgtggccaagggcatgcattacctgcatatggaggctccagtgaaagtgatccacagggatctcaagagcagaaatgtggtaattgcagcagacggggttttgaagatctgcgactttggtgcttcaaggtttcacaatcacaccactcacatgagcctcgtaggcacatttccatggatggcccctgaggtgatccagtcgttgcccgtcagtgagacctgcgatacctattcttacggggtggttttgtgggaaatgttgactcgggaagtgccattcaaagggctggagggactccaagtcgcctggttggtcgtggaaaagaacgaaagattgaccatcccttcttcttgccctcgcagcttcgccgaactgctgcatcagtgttgggaggctgacgcgaagaagaggccatcctttaagcagattatctccatcctggagtcaatgtccaatgatacaagcctccccgacaagtgcaatagttttcttcataacaaggccgaatggagatgtgagattgaggccaccctggagcgcttgaagaagctggaacgggacctttcattcaaagaacaagagttgaaagagcgagaacggagattgaaaatgtgggagcaaaaactgacagaacagagtaataccccactgctgttgccactagcagcccgaatgtctgaggaaagctacttcgagtccaaaacagaagagtcgaatagcgcagaaatgtcgtgccagatcacagccacaagtaacggagaaggccatggcatgaacccttccctccaagccatgatgctgatggggttcggagacatcttctcaatgaacaaggctggcgctgttatgcatagtggtatgcagattaatatgcaggctaaacaaaacagctccaagactacgtccaagaggcgaggtaagaaagtgaatatggcactggggttctctgacttcgatctttctgaaggcgacgatgatgatgacgatgacggtgaggaagaggacaacgacatggacaatagcgaatag

SEQ ID NO: 31383 - DNA, 474 bp, Artificial Sequence
  Description of Artificial Sequence: Synthetic coding sequence
atgaagagtatgagccagctggccgtacttagccgtcgatggaaaccgagcgagatgaaactggatccttttcaagaggtggtgcttgagagctctagcgtggacgaactcagagagaagctgagcgaaatctctggaatacctctggatgacattgaattcgcaaagggcagaggaacattcccctgcgatatctcagtccttgacattcatcaggatttggactggaatcccaaggtcagtactcttaacgtgtggcctctttacatttgtgacgatggggcagtgatattctaccgagataagacggaggaactaatggagctaactgatgaacagcgtaacgaattaatgaaaaaagagtcgtccaggctgcagaagactgggcaccgagtcacctatagtcctcgaaaagagaaggcgcttaagatttaccttgatggtgcccctaacaaagacctcacacaggactag

SEQ ID NO: 31384 - DNA, 1083 bp, Artificial Sequence
  Description of Artificial Sequence: Synthetic coding sequence
atgaaggccacggcgatgacctcagcctggttagcccaagggaccggggagggcgtgaacgatgtgaggaaaggagcctgcgcatcacacgtttcgacgatggcttcattccttaagggcgcacacgtaactatcaatgccagagcggaagaggacgtagagcctgagtgcataatggagaaagtggccaaggccagcggggctaactattccttccataaagaatctggccgttttcaagacgttggtcctcaggcaccagtcggttccgtctaccagaaaaccaacgccgtgagcgaaattaagagggtcggtaaggactcgttttgggctaaggccgaaaaagaggaggaaaaccgaagactggaggagaaaaggagggcggaagaggcccagcgccagctggaacaggaaaggagagaacgcgagctgagggaggccgctcgccgagaacaaaggtatcaggagcagggaggggaagctagcccccaacggacatgggaacagcagcaagaggttgtgagccgcaatcggaatgagcaggaaagtgcagtgcatcctcgggaaatctttaaacagaaagaacgagcaatgtcaaccacaagcatctcctctcctcagccaggaaagctcagaagccccttcctgcagaagcagctcacccagcccgaaacccactttggccgagagcccgctgccgcaatttcacgccctagagctgatctccccgcagaggagccagcaccgtcaaccccaccatgtctcgtccaagctgaggaggaggccgtgtatgaggagccacctgagcaggagacattctatgagcagccacccctggtccagcagcagggtgctggaagtgagcacatcgatcatcatatacagggccaagggctgagcggtcagggtctgtgcgctagggccctgtacgattaccaggccgcagacgatacagagatctccttcgaccctgagaacctcatcaccggcatcgaagtcatcgacgagggttggtggcggggatatggcccagacggacacttcggcatgttcccggctaattacgttgagctaattgagtag

SEQ ID NO: 31385 - DNA, 291 bp, Artificial Sequence
  Description of Artificial Sequence: Synthetic coding sequence
atgtgtcatacatcgtgttcttctggctgtcaaccagcttgctgcgctccaagcccttgtcagccggcatgctgcgttccagtgtcttgtcagtcaagcgtgtgtgtacctgtctcctgccgccctatcgtgtgtgctgcaccgtcttgccagtcgtccttgtgtgtgcctgtgagctgtaggccagttgtgtacgcagctccgtcatgtcagtcctctggatgttgccagccaagttgcactagcgttctgtgtcggccaatctcatattcaatctcgtcctgctgctag

SEQ ID NO: 31386 - DNA, 27 bp, Artificial Sequence
  Description of Artificial Sequence: Synthetic coding sequence
atgcccttgtccagccccaatgcctag

SEQ ID NO: 31387 - DNA, 384 bp, Artificial Sequence
  Description of Artificial Sequence: Synthetic coding sequence
atgagttcctctatgtggtatattatgcaatccatccagagcaagtactcactttctgagcggctcattcggacaatcgccgcaatccgctcgttcccccatgacaacgtcgaggacttgatcaggggtggcgctgatgtcaactgtactcatggtacactgaagcccctccattgtgcgtgtatggtgtctgatgctgactgcgtggagctgctgctcgagaagggcgctgaagttaatgcgctggacgggtacaatcgcaccgctctgcactacgccgctgaaaaggatgaggcatgtgtcgaagtacttctggagtacggcgcaaatcccaatgctctggacggtaatagagacacccccctccactgggccgctttttag

SEQ ID NO: 31388 - DNA, 318 bp, Artificial Sequence
  Description of Artificial Sequence: Synthetic coding sequence
cagtggaccgcaagcacagctaccatcaccaaagagaagcaagaccaacctaagaaggacatcagtaactaccaggtggaacaggcccaagtgctgctcaaaagagaaaaagagatccccccaacagtcttcccgaaccggtccccctggtgtcagaacccctatgtgtccgcccatccctattgcccactcatcgaacctcacaatacctcaacggccggaggccgactggaccgccagcctcgcaccagaagtacaaggcctaaccgcgcttcgggctctaaaaagaagaagacgagtgagtcacagaagcagtag

SEQ ID NO: 31389 - DNA, 1116 bp, Artificial Sequence
  Description of Artificial Sequence: Synthetic coding sequence
atggaagaggagggcttggccgacgaggaggtgagactggtgcagaagaaggacacaggtcatatctatgcaatgaagattctgcggaagtctgacatgttggaaaaggagcaagtcgcacatatcagggcggagcgcgatatcttagtggaggccgatggcgcttgggtcgttaaaatgttttactctttccaggataaaaggaatctctacttaattatggagttcctgcccggaggcgacatgatgaccctgcttatgaaaaaggatactctgacagaagaggagacccagttctatatctctgaaacagtccttgctatcgatgctatccatcagctggggttcatccatcgtgacatcaaacccgataatctgttattggatgccaaaggccatgttaaactgagcgacttcgggctctgcacgggccttaaaaaagcccaccggaccgaattttatagaaacttgacacacaaccccccttcggatttttcattccagaacatgaacagtaagaggaaagccgaaacatggaagaaaaacaggcggcagttggcttacagcacggtgggaacgcctgactatattgcacccgaagtcttcatgcaaactgggtataacaagctgtgtgactggtggtccctcggagtgatcatgtatgaaatgctgatagggtatccacctttttgtagcgagactcctcaggagacttatcgcaaagttatgaattggaaagagacactggtctttcctccagaagtgccgatctctgagaaagcaaaggaccttatcctgcgcttctgcatcgactcagagaatagaatcggaaattccggcgttgaagaaattaaaggccaccctttttttgagggcgtagattgggaacacatccgggagcggcctgccgcaatccctattgaaataaagtccatcgacgatacgagtaattttgacgactttcctgagagtgatattctccagccggtacctaatacaactgagcctgattacaaatcaaaggactgggtgttcttgaattacacgtacaaaaggtttgaagggcttactcaaagaggctcaatccccacatacatgaaggcgggaaagctgtag

SEQ ID NO: 31390 - DNA, 564 bp, Artificial Sequence
  Description of Artificial Sequence: Synthetic coding sequence
atgaataataccctgcgcaaagatgggaaaaaagattgctgttttgaaatcagcgccccagataaaagaatttatcagtttaccgcagcttcccccaaggacgctgaggagtgggtgcagcagctcaaatttgtgctgcaagacatggagagcgacattattccagaggattacgacgagagaggcgaactgtatgatgacgttgatcatcccctgcctattagcaaccctttgacttcctcacagcctatcgacgacgagatctatgaggagttacccgaggaggaggaggacagcgctcctgtgaaggttgaagagcagaggaagatgagccaggacagcgttcatcacacctccggggacaagagcacagattatgctaacttttaccaaggtctttgggactgcacgggtgctttctctgacgagctttctttcaaacggggagatgttatctacattctgagtaaagagtacaatagatatggatggtgggtaggtgagatgaaaggagctattggcttggtgcctaaggcctacatcatggaaatgtacgacatctag

SEQ ID NO: 31391 - DNA, 219 bp, Artificial Sequence
  Description of Artificial Sequence: Synthetic coding sequence
atggcactgtctttgggctggaaagcccacagaaaccactgcgggctgctcctccaggcactgaggagctcaggcctgcttctgttcccatgcggccaatgtccctggcgaggcgcagggagctttctcgaccccgagataaaggctttcctggaagaaaatactgaagtgacttctagtggctccttaacacctgagatccagttgcggctgctgtag

SEQ ID NO: 31392 - DNA, 2919 bp, Artificial Sequence
  Description of Artificial Sequence: Synthetic coding sequence
atggctgctgccgctgcggagcagcagcagttttatctgctgcttggtaatctactgtctcctgacaatgtggtcaggaaacaagcggaggagacctatgagaatatccccggtcagagcaaaattacattccttctgcaagccatacgcaacactaccgctgcggaggaggctcggcagatggccgctgtactgttgcgtcggctcttatcctcagcgttcgatgaagtataccccgcattgcccagtgacgtccagactgccataaagaacttgctgccaggcttcctgcaagctgtcaacgactcttgttaccagaatgatgacagcgttttgaagtccttagtcgagatcgccgacacggtgccgaagtacctacgcccacatctggaggcaactcttcagttgagcttgaaactgtgcggtgatacgagtctcaacaacatgcagaggcaattagccctagaggtgatcgtgacattgtctgaaacagccgcagctatgctcaggaaacatacaaatattgttgcacagacaatacctcagatgttagcaatgatggtggacttggaagaggacgaggattgggcaaatgctgatgagctggaagacgatgactttgattccaacgctgttgccggagaatccgcccttgatcgcatggcatgcggcctgggaggaaaactggtgctcccaatgatcaaagaacacatcatgcagatgttacagaatcctgactggaaatacaggcacgctggtcttatggctctgagcgccattggagaaggatgccatcagcagatggaaggcatcctgaacgagatcgttaacttcgtgttgctgtttttacaggatccccaccctagggttcggtacgctgcgtgtaacgccgttggccagatggcgacggattttgcgccaggatttcaaaagaaatttcatgaaaaggtgattgctgctctgcttcaaactatggaagaccagggaaatcagcgcgtccaagcccacgccgcagctgccttaatcaacttcaccgaagattgccccaagtcactgctcattccctatctcgacaacctggtgaagcacctgcattccatcatggtgctcaagctccaggaactgatccaaaaaggtaccaagctggtgcttgagcaagtggtgacatccatcgccagcgtggccgatacagcagaggaaaaatttgtaccttactatgacctattcatgccctcactgaaacacatagtggagaacgcagtccagaaggagctgcgcctcctgagaggtaagaccatagagtgcatctccttaattgggttggccgtgggaaaggagaaattcatgcaggacgcctcggacgtcatgcagttgttgctgaaaactcaaacggatttcaatgacatggaagacgatgatccccagatttcatatatgatctctgcctgggccagaatgtgtaagattctcggtaaggagttccagcagtacttgccagttgttatgggcccactgatgaagacagccagtattaaacctgaggtggccttactggatacccaggacatggaaaacatgtccgacgatgatggttgggaatttgtcaatctgggagaccagcagagctttggcattaagacggcaggtctggaggaaaagtctacagcctgccaaatgcttgtctgctatgcaaaggagctcaaagaaggcttcgtggaatacactgagcaggtagtcaaattaatggtgccactcctgaaattttacttccacgatggagtgcgagtcgccgctgccgagagcatgcccctgttgctagagtgcgctagagtccgtggccctgaatatttgactcagatgtggcattttatgtgcgatgcgcttattaaagcaattggaaccgagccagacagcgatgtgttgtctgaaatcatgcatagctttgcaaagtgtattgaggtcatgggtgacgggtgcctaaacaatgagcacttcgaggaactgggcggtatacttaaagccaaactggaggaacactttaagaatcaagaattgcggcaggtgaagcgccaagatgaagattatgatgagcaggtagaagagtcattacaggatgaggatgacaacgacgtgtacatcctgacgaaagtgagcgatatccttcacagcatatttagctcctataaggaaaaagtgctgccatggtttgagcagctgttacctctcattgttaacctaatttgtccccataggccgtggcccgatcgccagtggggattgtgtatattcgatgatgtgattgagcattgctcgccagcctctttcaaatacgcggagtactttctaaggcccatgctccaatacgtgtgcgataacagcccagaggtccggcaggccgctgcctatggtctcggcgtgatggcccagtacgggggtgacaattatagacctttctgcacagaggccctgcccctgctcgtgagggtgatccagtccgccgattctaaaaccaaggagaatgttaatgctacagagaactgtatatctgccgtaggtaaaattatgaaatttaagcccgactgtgtgaatgtggaggaggtgctaccacactggctgtcttggctgccgttgcacgaagataaagaggaagcagtgcagacatttaattacttgtgtgatctcattgagagcaatcaccctattgtgctgggccctaacaacaccaacctgccaaagatcttttcaatcattgctgagggagagatgcatgaagctatcaagcatgaggatccatgcgccaagcgcctggcgaacgtggtcaggcaggtgcagacctcaggcggactatggacggagtgcatcgcccagctctcacctgagcaacaggcagccattcaggaactcctgaactctgcatag

SEQ ID NO: 31393 - DNA, 1428 bp, Artificial Sequence
  Description of Artificial Sequence: Synthetic coding sequence
atgcaggtcacctttatatatgtgtgtttgaagggcctcatgcttcaagatttagttagcgccaaattaatatccgattatacagtcactgagatccctgacactattaacgacctacaagggtctactaaggtgctccaggccgtccagtggttggtctcacactgccctcattcactggacctctgctgccaaactttgattcagtatgtggaagacggcatcggacacgagttctcggggaggttcttccacgatcggcgagaacggcgactgggcggactagcatcccaggagccgggtgccatcatcgagttgttcaactctgttttgcagttcctggcttccgtcgtgtcatccgagcagttatgtgacctgagttggccagttaccgaattcgccgaggctgggggtagcaggctgttgccccacctccactggaatgccccagaacaccttgcttggctgaaacaggcagtgttgggcttccagctgcctcagatggacttgcctcccttgggtgcaccatggttgcctgtctgttctatggtcgtgcaatacgccagtcagatccctagttcacggcaaacacaacccgtgctgcagtcccaggtcgagaacctgctccatcggacctattgccgatggaaatccaagagcccatcacctgttcatggagccggtccctctgtgatggagattccgtgggacgatttaatcgctctttgtattaatcacaaattacgagactggaccccaccacgacttcctgtaacttctgaggcattgagcgaggatggtcaaatctgtgtgtactttttcaagaacgatttgaagaaatacgacgttcccctgagttgggaacaagcccgtctgcagacacagaaggagctgcagctgcgagagggacgcttggccatcaagccgtttcacccaagcgccaataactttccaattcccctgctccacatgcaccgcaactggaaacgcagcactgaatgtgcccaggaaggacgaataccttctacagaggacctcatgagaggcgcttccgctgaggagttactcgcacaatgtttgagctcaagcctcttactcgaaaaggaggagaacaaaagattcgaagatcagctccagcaatggttgagtgaggacagtggcgcttttactgacctaacatcccttcccctctacctcccccagacattagtgagtctttcacacacaatcgagcccgtcatgaagacgagtgtaaccaccagcccgcagagtgatatgatgagggaacagctgcaactttcagaggccacaggaacctgtcttggagaacggctaaagcatcttgaacggctgattcgatcatcacgggaagaggaagtcgcgtccgagctgcacctctctgctttactggacatggtggacatctag

SEQ ID NO: 31394 - DNA, 333 bp, Artificial Sequence
  Description of Artificial Sequence: Synthetic coding sequence
atgagtacggccctgacccacaccactgtcgcaatgaggtgtcccatgggtggtgggggaggtcctacctatggtccacctcagccatgggggcaccccgatgtacacattatgcaacaccacgtgctgcccatccaggcaaggctgggatccatcgctgaaattgatctaggtgttccaccacccgtcatgaagactttcaaggagttcctgctcagtctggacgactccgttgacgaaacagaggctgtgaagcgttacaacgactacaagttggacttccgccgtcagcagatgcaagacttctttctagcccataaggacgaggaatag

SEQ ID NO: 31395 - DNA, 828 bp, Artificial Sequence
  Description of Artificial Sequence: Synthetic coding sequence
atgtccgcggaagtgaaggttaccggtcagaaccaagagcaattcctcttgctggccaagagcgcaaaaggagctgcgcttgccactcttattcatcaggtgctcgaagctcccggagtatatgtgttcggcgagttacttgatatgcccaacgtaagggagcttgctgaaagcgattttgcttcgacattccgcctgttgacagtgtttgcctacggtacgtatgcagattacctggcagaagctcgcaacttgccaccgctgactgaggcccagaaaaacaagctgcggcacctatctgtggtgacactcgcggcaaaagtgaagtgtattccttacgcggttttactggaagctctggcgctgcggaatgtgcggcagctggaggatcttgtgatcgaagccgtgtacgctgatgtactgcggggttctctagaccagagaaatcaaagactcgaagtggactacagtatcggtcgcgatattcaacgtcaggatctttccgcaatcgccaggaccctgcaggagtggtgcgtcggttgcgaagtggtcctctcaggaatcgaggaacaggtcagtcgcgctaatcagcacaaagagcagcagctcgggttgaaacagcaaatcgaatctgaggttgctaaccttaagaagacaattaaggttactacagccgcagcggcagctgccacctctcaggacccagagcagcatctgacggaattacgggaaccggctcccggaacgaaccaacgacagccatctaagaaagccagtaaagggaaaggactgaggggtagcgccaagatctggtcaaagtctaactag

SEQ ID NO: 31396 - DNA, 876 bp, Artificial Sequence
  Description of Artificial Sequence: Synthetic coding sequence
atgatcggtgacggtgaggactacttcctatctttgtttggcgactcaaaaaaactgaccgcccactccaattatactcaaaagacgttgaaatactttagcatgatcttagaagaggtgggacaatttactagctcctccctcggcgatgtggaaatcgctgaagtcaacgtgaagggattgttcgtgaagctcatcaactcctcactggataaggagatggctatcggcgatcacattttgcagcagaatgtcaatggacagaccatcagcctctacagatttttacccaatattgtgatgcaggctaactccaccgtcaccgtctgggcagctgcaagcgaagccaagcatcagccaccctctgatttcctctggaaagaacaggacaaattcagagccagcccagattgtatcaccattctttgcaagccaaacggtcaggcaatcgcatggtatactccgatccattggaagcaggcttgggaaaagcttgacgccgatgtcgaattcaatagatgtagcgtggtgagtccaacattcagaaaacgcgtcttccaatggacggccagtactgctactattaccaaagaaaagcaggaccaacctaaaaaggacatcagtaactatcaggtagaacaggcacaggtactgctcaaaagggagaaggagatccccccaacagttttccctaatagaagtccatggtgtcagaatccttatgtcagtgctcatccatattgtcccctcatcgaaccacataatacctcgacagccggtggacgtcttgatcggcagcctcgcacaagatctaccaggcccaatagggcaagtggctctaagaagaaaaaaacgtctgaaagtcagaaacagtag

SEQ ID NO: 31397 - DNA, 1185 bp, Artificial Sequence
  Description of Artificial Sequence: Synthetic coding sequence
atggtgccaagccaggcaccttatctcgttcccgctttccccctcccggctgcaactagccccggaagggaatacgctgcacctgggacggctcccgaggggctgcacgggctgcccctcagtgaggggttgcaaccctatcctgcctttccattcccatatctcgacacatttatgacagtgttccttcctgacccgccagtgtgtcccctcctaagcccctctttcctaccttgccccttcttaggagccacggctagttcagccatctcacctagtatgagttccgcaatgagtcctacacttgacccgccacctagtgtgacgtcccagcgaagggaagaggagaagtgggaggcccagagcgaaggccatccttttatcacaagtagatcctcttcacccttacagctcaacctgctgcaggaagagatgcctcggccaagcgaatcacctgatcagatgagacgcaacacctgccctcagaccgagtactgcgtcaccggtaacaacgggtcagaatcttctcctgcaaccaccggcgcactctctaccggctctccaccacgcgagaatccttctcaccccacggccagtgccctgtccaccggatccccgcctatgaagaaccctagccaccctactgcttcgactctttcaatggggctgccaccatcaaggacacccagtcatcctaccgccaccgtcttgagtacagggagtccaccatctgagtctccttcccggactggctctgcagccagcggctcctctgatagctccatatatttgacatcaagcgtttacagtagcaaaatctctcaaaacggacaacagtctcaggatgtgcagaagaaagagacgttccccaacgttgcggaggagcctatctggcggatgatccgccagaccccagagcgcattctgatgacctatcaggttccagaacgggttaaagaagtggtcttaaaggaggacttggaaaagcttgaatctatgcgtcaacagcagccccagttctcacacggccaaaaagaggaactcgcgaaagtgtataactggattcagtcccagacggtgacgcaagaaattgacatacaggcctgcgtgacctgtgaaaacgaggactccgccgacggggctgccacatcttgcggtcaagtgctggtggaagactcctgctag

SEQ ID NO: 31398 - DNA, 2424 bp, Artificial Sequence
  Description of Artificial Sequence: Synthetic coding sequence
cagggggctagcttcgccctcgccgctgcagcagccctgctgttcgggtctgatatggaggacggcccaagcaacaatgcttcctgtttccgcagactcactgaatgctttttaagccctagtctgacagacgagaaggtgaaggcctacctgagccttcacccacaggtgctggacgaatttgtgagcgaaagtgtgagcgctgaaaccgtcgagaagtggttaaagcggaagaacaacaaatccgaggacgaaagcgccccaaaagaggtatctagataccaggataccaatatgcagggggtcgtatatgagcttaactcgtatatcgagcagaggctggacactggtggggataaccagctgctgctctacgagctcagtagcattatcaagatcgccactaaagctgacggatttgccctgtactttttaggggaatgcaataatagcctatgtatattcactccaccgggaataaaggagggaaaacctcgcctgatacctgctgggcctatcacgcaagggaccacggtgtccgcatacgtagccaagagccgaaaaaccttgctagtggaggatatcctgggcgatgagcgcttccccaggggcaccggcctggaaagcggcacaaggatccagagcgtgttgtgcctgccgatcgttactgctatcggggacctgataggcatcctggagctgtacaggcattggggtaaagaggctttctgcctgagccaccaagaggtagccactgccaacttagcctgggcatccgtcgcaattcaccaagtgcaggtgtgccgcggactggcaaagcagactgaactgaatgatttcctgctggatgtatccaagacatatttcgataatatcgtggccattgacagtttgctggagcacattatgatttatgccaaaaacctggtaaatgccgatcggtgtgctctgtttcaggtcgaccataaaaacaaggagctgtatagcgacttgtttgatatcggcgaggaaaaggaggggaaacccgtctttaaaaagactaaggagatccgatttagtattgagaaggggattgccggtcaagtagctaggacaggagaggtgctgaatatccccgatgcatacgccgacccgaggttcaacagggaggtggatttgtacacggggtatactacaagaaacatcctgtgcatgcccatagttagtcggggatctgtcatcggggtggtgcagatggtgaacaaaattagcggatccgctttttctaagacagatgagaacaatttcaagatgttcgcagtgttctgtgctttagccctgcattgtgccaacatgtaccaccggattcggcattccgagtgcatttacagggtcacgatggagaaattgagctatcatagcatctgcacgtctgaagagtggcagggacttatgcagttcaccttgcccgtccggctgtgcaaggaaattgaactgtttcatttcgatataggacctttcgaaaacatgtggcccggaatcttcgtctacatggttcatcggagctgtggcactagctgcttcgaattggagaaactatgcaggtttatcatgtcggtgaagaaaaactatcgccgagtcccctatcacaactggaaacatgccgtcaccgttgcccactgcatgtatgcgatccttcaaaataatcataccctcttcaccgaccttgagagaaaggggttgctgatcgcatgcctgtgccacgatctcgatcatcgagggttcagcaacagctatctccaaaagtttgatcaccccctcgccgcactctactccacaagcacaatggagcagcaccactttagtcagacagtgtccatccttcagctcgagggtcataacattttttccaccctcagctcctccgaatatgaacaggtgcttgaaatcatcaggaaggctatcatcgccaccgacctggccctgtatttcggcaataggaaacagctggaagaaatgtaccagacaggctccctgaatttgaacaatcagtctcatagggaccgggttatcggtctgatgatgacagcctgtgatttgtgcagcgtgaccaagctgtggcccgtcaccaaattgactgcaaacgacatctacgcggaattttgggcagagggcgacgagatgaaaaaattgggcatccagcctattccaatgatggatagagacaaaaaagatgaggtgccacagggtcagctcggcttctataacgcagtggccataccttgctacactacactgactcagatcctcccccctaccgagcctctgctcaaagcgtgccgcgacaacctttctcaatgggagaaagttataagaggtgaagagacagccacatggatctccagcccttctgtcgcacagaaagcggctgccagcgaggactag

SEQ ID NO: 31399 - DNA, 1677 bp, Artificial Sequence
  Description of Artificial Sequence: Synthetic coding sequence
atggccagttgccccgactcagataactcttgggtgttggcgggaggagagctggggatcagccttaatatgtgtctcctgggggctcttgtcctgctcggacttggcgtcttattgttcagtggaggtctctcagagtccgaaaccgggccaatggaggaggtggagcgccaggtattgccggatcccgaggtgcttgaagcagtgggagatcgacaggacgggctgagagaacaactccaggccccagtgccaccagacagcgttcccagtttacagaacatgggcctcctgttggataagctggcaaaagaaaaccaggatatccggttgctgcaggcgcagcttcaggcacagaaggaagaactgcaatcacttatgcatcaacctaagggactggaggaagaaaacgcacagttacgaggggcactgcagcaaggagaagccttccagagagctctcgaatcagagttgcagcagcttagggctagattgcaggggctcgaggcagactgtgtgcgtggaccggacggggtgtgcctcagtggagggcgagggccacagggagacaaagctatccgcgagcagggtcccagagagcaggaaccggagctttcgttcctgaagcagaaagaacagctggaggcagaggctcaggcgctacggcaggagctggaaagacagcggcgactgctggggagcgtccagcaggacctcgagagatctttacaggacgcctcccggggagaccctgcccatgccggtctggcggaactggggcatcgattggctcaaaagctgcaggggctggaaaattggggacaagaccccggagttagtgccaacgcaagcaaggcgtggcatcaaaaatcccacttccaaaactcacgggagtggtctgggaaggaaaagtggtgggacggccagcgtgatagaaaggccgaacattggaaacataagaaagaggagagcggacgagaacgcaaaaaaaattggggcggtcaagaagacagagaaccagccggtcgatggaaagaggggagacctcgggtggaggagtccgggagcaagaaagagggaaaaagacagggtcctaaggagccgccaagaaagtccggaagtttccactcttccggcgaaaagcagaaacagcctaggtggcgggagggcacgaaggactctcacgaccccttgccctcttgggctgagttactgagacccaaatatagggctcctcaggggtgctcaggtgtcgatgagtgcgcccgacaagaaggcctgactttttttggaacagagctcgcaccagtgcgacagcaggaactggcttctctgttacgcacatacttagcacggctcccatgggctggacaattaacaaaagaactgccattgtctccagcgttctttggcgaggatggcatctttcggcacgaccggctgcggtttagagacttcgtagatgccctggaggactccctggaggaggtggccgtgcagcagacgggagacgatgacgaggttgatgactttgaggattttatcttttcacacttcttcggagataaagcactcaaaaaaagatcagggaaaaaagacaaacacagtcagtcccctagagcagcgggtccccgtgagggccactcccacagccatcatcatcatcacagagggtag

SEQ ID NO: 31400 - DNA, 1881 bp, Artificial Sequence
  Description of Artificial Sequence: Synthetic coding sequence
atgggcaacgcggctggcagcgctgaacagcctgctgggccagctgcccctccacctaagcaacatcgctttgaaaaattaatggaatatttcaggaacgaggattctaacatagatttcatggttgcctgcatgcagttcattaacatcgtcgtgcattctgtcgaaaacatgaattttcgggtctttctgcagtacgagttcactcatctgggtttagatttgtacctggaacggctccgtttaaccgagtccgacaaactccaggtccaaattcaggcctacctggataatatattcgatgtcggcgctctgctcgaagataccgagacaaagaacgctgtgctggagcatatggaggaactgcaagaacaggtcgccttactgactgaaaggctacgggacgctgaaaacgaatctatggccaagattgccgagcttgagaaacagctgtcccaagcgcgaaaggaacttgaaaccctaagggagcgctttagtgaatccacggcaatgggaccatctcgcagacccccagagcccgagaaagcccctccagcagcaccaacaaggcctagtgccctcgagctcaaggtggaagaactggaggagaaggggctgattcggatcctcaggggcccaggcgacgcagtgagcatcgaaatccttccggtggccgtagctactcccagtggaggagatgctcctactcccggtgtgccgactggttctccttccccagatctcgcccctgccgctgagccagcacctggggcagctccccctccccctccccctcctccgggaggtccaccagatgccttaggacgtcgcgacagcgaactggggcctggagttaaagctaagaaacctatccagacaaagttccggatgcctctcctgaattgggtagccctcaagccatcccagataacaggaactgttttcaccgaattaaacgatgagaaagtgcttcaagaacttgatatgagcgacttcgaagaacaatttaaaactaaatcacaagggccttctctggacctctctgcccttaagagcaaagctgctcagaaagccccaagcaaggctacattgatcgaagcgaatcgcgctaagaatcttgcaattacacttcggaagggtaatctgggagccgagagaatctgccaggctatcgaggcctacgatctgcaggccttgggccttgattttctggaactgctgatgcggtttctgccaacggagtacgagcgatcacttattaccagattcgagagagagcagcggcctatggaagaactcagtgaggaagatcgcttcatgctctgtttctctcgcatccccagactccccgagagaatgaccacgttaacgtttcttggaaactttccagatactgcacagctgttgatgccgcaattgaacgcgattatcgctgcctctatgtcaatcaaatcaagtgacaagctgcgtcagattctcgagattgtgctggctttcgggaattacatgaatagtagtaagcggggtgccgcttatgggttccgcctacaatccctggatgcgctcctggaaatgaagtcaacagatagaaaacagactttactccactaccttgtgaaggtcatcgccgagaagtacccacagttaactgggttccactccgacctccacttcctcgacaaggccggttcggtatctctcgacagcgtgctagctgatgtgagatccttgcagagggggctggaactgacccagcgggagttcgtccggcaggatgattgtatggtgttgaaggaattccttagggccaattctccgactatggacaaactgctcgctgactcaaaaacagcgcaagccgtgccaacagggggattatag

SEQ ID NO: 31401 - DNA, 1500 bp, Artificial Sequence
  Description of Artificial Sequence: Synthetic coding sequence
atggataagttgatcgtggacggcagaggcaaagcaacaatcagcaacgacggcgcaaccattctgaaactcctggatgttgtccacccagctgccaagacattggtagacattgctaagagccaggacgctgaagtcggcgacgggacaactagtgtgactttgcttgcggcagaatttcttaagcaggtaaaaccctacgttgaggaaggtctacatccacagatcattattcgcgcatttcggacggcaacccagctcgccgtgaacaaaataaaggagattgctgtaacagttaagaaagccgacaaggtcgaacagcgaaagctattagagaagtgtgctatgacagccctgtcttccaagcttatatcccaacagaaagccttctttgctaagatggtcgttgacgctgtcatgatgctggacgacctactgcaactcaagatgatcggcattaagaaggtccagggcggtgctctggaggactcacagctggtcgccggtgtggcctttaaaaagaccttctcctacgccggattcgagatgcagccgaagaaatatcacaatcccaagatcgctctgttgaacgtggaactggagctgaaagcggagaaagacaatgcggagataagggtgcacaccgtggaggactaccaggcgattgtggacgccgagtggaatatcctttacgataagctcgaaaagatccatcactctggagctaaagtcgtgctgagcaagctgcctatcggtgatgtcgcaactcagtactttgccgatagagatatgttttgtgccggaagggtacctgaagaggacctgaagcgcaccatgatggcttgcggcggatctattcagacgagcgtaaatgcgctatcagccgatgtgctggggcgttgccaggtatttgaagaaactcagattgggggtgagcggtacaacttcttcactggttgccccaaggcgaaaacctgcacctttatcctgcgcggaggagcagagcaattcatggaagagaccgagaggtccctgcatgacgccattatgatcgtgcgacgcgcaataaagaatgacagcgtcgtggccggaggaggcgctattgagatggagctctctaagtaccttcgggactatagtcggacaatccctggcaaacagcagcttctaattggagcctacgccaaagcactggagatcatcccgcgacaactgtgcgacaacgcaggattcgatgcaactaacatacttaataaactgcgagccaggcacgctcagggcggtacctggtacggcgtcgatattaacaatgaggatatcgcagacaattttgaggcattcgtttgggaacctgcaatggtgcgcataaacgcgttgacagcagcatcagaagctgcttgtctcatcgtgagcgttgacgaaaccataaaaaacccccgtagtaccgtggatgctccaacagctgccggtcggggtcgcggtagaggaagaccccactag

SEQ ID NO: 31402 - DNA, 78 bp, Artificial Sequence
  Description of Artificial Sequence: Synthetic coding sequence
atggctcacgaaatgatcggtactcagatcgtgactgaacggttggtggcactgctggaatcgggcactgagaagtag

SEQ ID NO: 31403 - DNA, 633 bp, Artificial Sequence
  Description of Artificial Sequence: Synthetic coding sequence
atggaaaagaccgaactgatccaaaaagccgtagcttacaagaatgtggtgggcggacggagatccgcatggagagtaatctcatcaatcgagcagaagaccgacacgtccgacaaaaaactccagcttattaaggactatcgggagaaggtcgagtctgagttgcggtctatttgcacgactgttctagagttgctcgacaagtaccttatcgcaaatgcaaccaatcccgagtccaaggttttttacctgaaaatgaagggcgattactttagatatctcgctgaagtcgcatgcggcgatgaccgtaaacagaccatcgataacagccagggagcctatcaggaagccttcgacatcagcaagaaggagatgcagccgacccaccccattaggctcggattggcactgaatttctcagtcttttattacgagattctgaataatcccgagctggcgtgtaccttggcgaagactgctttcgacgaagctattgccgaactagacacactgaatgaggactcttacaaagattctacattgatcatgcaactgctgcgcgataacttgacattatggaccagcgatagcgccggtgaggaatgcgatgccgcagaaggagccgaaaattag

SEQ ID NO: 31404 - DNA, 501 bp, Artificial Sequence
  Description of Artificial Sequence: Synthetic coding sequence
atggatctgatgccttttatcaacaaagcaggatgcgagtgcctcaatgagtcagacgaacacggattcgacaattgtctgcgaaaggatactacatttctggagagtgactgtgatgaacagctcctgatcactgttgctttcaaccaaccagtcaagctctacagcatgaagtttcagggccctgataacggccaggggcctaagtatgtcaagatcttcatcaatctgcccaggagtatggatttcgaagaagcggagcggtctgagcccacgcaggctctggaactcacagaagacgacatcaaggaggatgggatagtgccgctccggtatgtcaagttccagaacgttaacagcgtgacaattttcgttcagtctaatcagggcgaggaggaaacgacacgcatttcctattttacctttattggcactccagtgcaggcaaccaacatgaatgattttaagagggtggtaggcaagaagggcgagagccattag

SEQ ID NO: 31405 - DNA, 639 bp, Artificial Sequence
  Description of Artificial Sequence: Synthetic coding sequence
atggccgctccagaagaaagggacttaacccaagagcagacagagaaactcttgcagtttcaggacctgacaggaatcgagtcaatggatcagtgccgacacaccctggaacagcacaactggaacatagaggcagctgtccaggataggttgaatgagcaggaaggagtaccatctgtatttaatcccccacctagccgacccctgcaggtgaataccgccgatcacaggatttatagctatgttgtgtcacgcccacaaccgcgaggcctcctggggtggggttactatctcattatgctgcctttccgctttacttattatacaatactcgatattttccgcttcgcactgcgctttattaggcctgatccgaggtctagagtcacagatcccgtcggggacatcgtgtccttcatgcactcattcgaggaaaagtatggcagggctcaccccgtgttctaccagggcacctatagccaggctctgaatgacgctaaacgggaacttcggttcttgttggtgtatctgcacggcgatgatcatcaggatagtgatgaattttgtaggaacaccctgtgtgcccctgaggtcatttccctcattaatacttcttctcacagtttccttcttctttag

SEQ ID NO: 31406 - DNA, 1371 bp, Artificial Sequence
  Description of Artificial Sequence: Synthetic coding sequence
atggcggattcgttggaaagcactccactgccttccccggaggaccgcctggccaagcttcacccctcaaaggagctgcttgagtactatcagaaaaagatggctgagtgcgaagcagagaatgaggatctcctgaaaaagttggagctctataaagaagcgtgtgaaggacagcacaagctggagtgtgacctgcaacagcgagaagaggaaattgcagagctgcagaaggccctcagtgacatgcaggtctgcctctttcaggagcgtgaacacgtgcttcgtctgtactcagagaacgaccggttgcgcatcagagagctggaagataagaaaaaaatccagaacctgcttgcgttggtcgggacagatgcaggagaggtgacttatttctgcaaggagcccccacataaggttaccatcttacagaagaccattcaggcagtaggggaatgtgaacagtccgagtccagtgctttcaaagctgaccccaagatctccaaacgcagaccaagtagggaacgtaaggaaagctcagagcactaccagagggacatacagacgctgattctccaagtggaggcactccaagcccagctgggcgagcagactaaactgagcagagagcaaatagaaggattgatcgaagataggcgaatacacctagaggaaatccaggtgcaacatcaaagaaaccagaataagattaaggaactcacgaagaatctgcatcacacgcaggagctactgtacgagagtaccaaagattttctgcagctcaggtctgaaaaccagaataaagagaagagctggatgctcgaaaaggacaatctgatgtctaagataaaacagtacagagttcaatgtaaaaagaaagaggacaaaatcgggaaggtgctgcctgtgatgcatgaatcccaccacgctcagtctgaatacatcaagagtttgaaggataagctcgtgcaggagaaaaagctgtcaaacatgtaccaagagcagtgtattagcctcgaggaggagttggcgcgtatccgggaagaagaggggatgaggagggagatattcaaagatagaaccaataaaatgggaaaaaggctgcagattatgactaaacgctatgaggcactggagcggaggagaatcctggaggtggaggggtttaaaacggacattaaagtcctgcgacagaaactgaaggatcttgaacagatgctgtacaaggccaccgtgaacgcgcgagccaaccaggaccttgcgctgctgtgtgaagttcgggattcaaaccgccgagcccacaaaattcaaggagagctgaagaacctgaaatcaaaagtttttggcctagagaatgaattgcggctttgttag

SEQ ID NO: 31407 - DNA, 183 bp, Artificial Sequence
  Description of Artificial Sequence: Synthetic coding sequence
atggacgaacaggccctgctggggctgaacccaaacgctgattccgacttcaggcaacgcgcactggcttacttcgagcagctgaagatctctcccgacgcgtggcaggtgtgcgcagaagccctcgctcagcgcacctatagcgatgatcacgtaaagtttttctgttttcaggtgctttag

SEQ ID NO: 31408 - DNA, 339 bp, Artificial Sequence
  Description of Artificial Sequence: Synthetic coding sequence
atgtctagctcaatgtggtacattatgcaatctatccaaagcaagtattctttgtcggagaggttgattagaaccattgcggctatcagatcatttccccatgataacgttgaagatctgattcggggaggtgctgatgtgaattgtacacacggtaccctaaaaccccttcattgcgcatgtatggtgtcagacgctgactgcgtcgaactgctgttggaaaaaggggcagaggtcaacgcactggatggatataatcgcaccgctctccactacgctgcagagaaagatgaggcttgtgtcgaggtcttgcttgaatacggggctaatcccaattag

SEQ ID NO: 31409 - DNA, 1173 bp, Artificial Sequence
  Description of Artificial Sequence: Synthetic coding sequence
atgtccgccgcaaaccctgagacccccaacagcactatttcaagagaggcttcaacacagagcagcagcgctgcagcttctcagggctgggtgctgcccgagggaaagattgtccctaacaccgtgttcgttggcggaattgatgccagaatggacgaaacagaaattggtagttgcttcggaaggtatggttctgtgaaggaagtgaaaatcataacaaatagaactggggtatctaaagggtacggttttgtctcttttgtgaacgatgtggacgttcagaaaatagtgggctcacagatccacttccatggtaagaagcttaaactgggaccagccatccggaagcaaaagctttgcgctagacatgtccagcccaggcctttggtagttaaccccccacccccaccacagttccagaatgtgtggaggaatcctaacaccgagacctatctgcagccccagatcacccccaaccctgtgacgcagcatgtgcaggcctactctgcttacccgcatagtccgggacaggtaatcacgggatgtcagctcctagtctataactatcaggagtatccgacatatcccgactccgcattccaggtgaccaccgggtatcagctccctgtctacaactaccagccttttcccgcatacccacgtagcccattccaagttactgccggatatcaactgcctgtatacaactatcaggctttccccgcataccctaacagtccatttcaggtagctaccgggtaccagtttccggtttacaactatcagcccttccctgcgtatccttcaagccctttccaggtcaccgccggatatcagttacctgtgtataactaccaagcctttccagcttacccaaattcacccttccaggtcgccaccggctaccagttccccgtatacaattatcaagcattcccagcttatccaaactcaccagttcaggtgactaccggctaccaactgcccgtctacaattaccaggcatttcccgcatacccgaactctgccgttcaggttactacaggataccagttccacgtctataactatcagatgccgcctcagtgcccagtcggagaacagcgaagaaacctttggacagaagcgtataagtggtggtatttggtgtgcctgatccagcgtcgcgactag

SEQ ID NO: 31410 - DNA, 1335 bp, Artificial Sequence
  Description of Artificial Sequence: Synthetic coding sequence
atgagggaaattgttcacctccaggccggacagtgtggaaaccagattggagcaaaattttgggaggtaatatccgacgaacacggcatagatcccaccggcacctaccacggggattcggatttacagttagagcgcattaacgtatactataacgaggccacggggggtaactatgtgccgcgagctgtgctggtcgatttggaacccggaaccatggacagtgtccgctccggaccttttggacagatctttcgacctgacaattttgtgttcggacagagtggggcagggaataattgggcaaagggacactacacagagggcgctgaactcgtggatgccgtgctcgatgtggtcagaaaagaagccgaatcctgcgactgtcttcagggattccagctgactcacagcctgggaggtggcactgggtccggcatgggaactttgctaatcagtaagattcgcgaggagttcccagatcgaattatgaacaccttttccgtcgtccctagccccaaggtatcggacacagtggtggaaccttacaatgccaccctgagtgtgcatcagctggtagaaaataccgacgagacttattgtatcgacaacgaggctctgtacgacatctgttttcgtacactcaagttgactacccccacatatggggatctaaaccacctggtttcagccaccatgtccggggtgacaacatgtctcaggtttccaggtcaactcaacgctgacctgcgcaaactggctgtcaacatggtcccttttcccaggctgcacttctttatgcccggattcgcgcctttaacttccaggggaagtcagcagtacagggctcttacagtgcccgagctcacgcaacagatgtttgacgccaagaatatgatggccgcttgcgatcccaggcatggaagatatctgaccgtagctgccgtgtttaggggccgaatgtctatgaaggaggtcgacgagcagatgctctctgtacagagtaaaaactcatcttatttcgtcgagtggatcccgaacaatgtcaagacagccgtgtgcgacattccacccagaggtctaaagatggcagcgacattcattggtaatagtactgccatccaggagctgttcaagcgaatcagtgagcagtttacagccatgttcaggagaaaagcgttcctacactggtatactggcgaaggtatggacgaaatggaatttaccgaagcagagagcaatatgaacgatttagtgtcagaataccagcagtaccaggacgctacggctgaggaaggcgagttcgaagaggaagcggaggaggaggtggcctag

SEQ ID NO: 31411 - DNA, 495 bp, Artificial Sequence
  Description of Artificial Sequence: Synthetic coding sequence
atggtcaacagcgtagtgttcttcgacattaccgttgatggaaagccactcgggcgaatatccatcaagctgtttgcagacaagatcctcaagactgctgagaattttcgcgctctttcaacaggcgagaaagggtttcggtacaaggggagttgcttccataggatcatccctgggttcatgtgccagggcggtgacttcacacgacacaacggaactggggataagtctatatatggagagaagtttgatgacgagaacttaattcgaaagcataccggctccggaattcttagcatggccaacgcaggccctaatactaacggttcccagttcttcatctgcgcagcaaagacagagtggctggacggtaagcacgttgcttttggtaaggtgaaagagcgtgttaacattgtagaagccatggaacacttcggataccgcaattcaaaaacttccaaaaagattaccattgcagactgcgggcagttttag

SEQ ID NO: 31412 - DNA, 3252 bp, Artificial Sequence
  Description of Artificial Sequence: Synthetic coding sequence
atgtctcagacacaggactacgaatgtcgctctcacaatgtcgacttgccagagagccgtataccagggagcaatacacgactggaatgggtcgagattatcgagcccaggactagagaaaggatgtatgccaatctagtcactggcgagtgcgtgtgggacccacccgcaggtgttagaattaaaaggacatccgagaaccagtggtgggaattattcgatccgaatacttctaggttttattattacaacgctagtacacagcgcacagtgtggcatcgaccccagggatgcgacatcatccccctagctaaactgcagacactcaaacagaacacagagtccccacgtgcctcggccgagtcaagtcctggcaggggcagctcggtgagcagagaaggctccacctcgtcatccctcgagccggaaccagacacggagaaggcacaagagctgcccgctagggcaggtcgccctgcggcattcggaaccgtgaaggaggactcgggctcctcctccccccctggcgtgttcctggagaaagattacgaaatttaccgcgactattctgccgacggacagctgctacactacagaaccagctctctgcgctggaattccggggcaaaggaacgcatgctgattaaggtagccgatagagagccttcattcctcgcagcccagggaaatggatacgctcctgacggccctccgggtgtgcggtccaggaggcccagcggcagccagcattcacctagtctccagacttttgcgcctgaagccgacgggacaattttttttcccgaaagaaggcccagtccttttttgaaacgggctgagctccccggttcgtcatctccactgctggctcagccgagaaagcccagcggcgactctcaacccagcagtcctcgctacggatacgagcctccgctatatgaagaaccgcctgttgagtaccaggcaccgatttatgatgagccccctatggacgttcagtttgaagctgggggaggctaccaggctggaagcccccagcgatctccaggccgtaaaccaaggcccttcctccagccaaacaaacagggaccgccaagcccgtgtcaacagctcgtgctgacgaagcagaagtgcccagaacgtttcctctctctggagtactcacctgccggaaaagaatacgtgagacagctcgtgtacgtggaacaggctgggtcctcaccaaaactgagagccggacctcgccacaaatacgccccaaatcctgggggtggatcctattccctgcagccctcaccctgcctactacgggaccagcgcctaggcgtgaagtcaggggactacagcacgatggaaggccctgaattgcgacactctcaacccccaacgccccttccacaggcccaggaggacgccatgtcctggagcagtcagcaggacacactctccagtactggctactccccaggcacccgcaaaagaaaatcccggaaacctagcctgtgtcaggcgacctccgctacccctaccgaggggccaggcgatctgcttgtggagcagcctttggccgaagaacaaccaccgtgtggaacttccctcgcccctgtgaagagggccgagggggaggccgagggcgcacgtggcgcagccgagccattcctggcccaggcccgtttggcctgggaagcacagcaggcacacttccatatgaagcagcgcagctcatgggactcccagcaggacggctcgggctatgagagtgacggcgcactgccactgcccatgccaggacctgtggtgagggcctttagcgaggacgaagcgctggcacagcaggagaatcggcactggcggcgtggcacatttgaaaagttaggattccctcagattcttttagaaaagtcagtgagcgttcagaccaatctggcttccccggagccatatctgcatcccagtcagtctgaggatctggcagcttgtgcgcagtttgagagcagccgtcaaagccggtctggcgtccctagcagcagctgtgtgttcccaactttcacattacgaaagccctccagcgagaccgatatcgagaactgggcatctaaacacttcaacaagcatacacaaggcttgttcagacgaaaggtatccatagccaacatgctggcttggtccagcgagtctatcaaaaaacccatgatagtgactagtgaccgccacgtgaaaaaagaggcatgcgagttgtttaagctgattcaaatgtatatgggggatcggagggcaaaagccgatcccttgcacgtggctctcgaagtggccactaaagggtggtccgttcagggactccgcgacgaattatacatacagctgtgtcggcagacaacagagaattttcggttggagagtctggctcgcggttgggaactgatggctatctgcctggcgttcttcccgccaacccctaaatttcattcctatttggaaggatacatttaccgccatatggaccccgttaacgacaccaaaggggtggcaataagtacctacgccaagtactgctaccacaagctacagaaggctgctttgaccggggctaaaaaaggccttaagaagcctaacgtcgaggaaattcgccacgcaaagaatgccgtcttcagcccaagcatgttcggcagtgctctgcaggaagtgatgggcatgcaacgagaacgatatccggagcgacagctgccttgggttcagacccgcctcagtgaggaggtgctggccctgaatggtgaccaaacggagggcattttccgtgtgccaggagacatcgacgaagtgaacgctctgaaactccaggtggaccagtggaaagtcccaacagggctcgaagatccacatgtccctgccagcctgttgaagctctggtaccgcgaactggaagagcccctcatccctcatgaattttacgagcaatgcatcgcccactatgactcccctgaagctgctgttgcagtggtccacgcgctgccacgaatcaataggatggtcctctgctatttaattagatttttacaggtcttcgtacagcccgctaatgtggctgtgacgaagatggacgtcagcaacttggcaatggtgatggctcccaattgtctcaggtgtcagagcgacgatcccagagtgatctttgagaacacccgaaaagagatgtcctttctgcgggtgctgatccagcacttagatacctccttcatggaaggggttctgtag

SEQ ID NO: 31413 - DNA, 1503 bp, Artificial Sequence
  Description of Artificial Sequence: Synthetic coding sequence
atggccgcagtgaagaccctaaatcccaaagggacaatgaagatgctcgtcagcggggctggcgatattaagctcaccaaagatggtaatgtgctgctacacgagatgcagatccagcatcctaccgctagtctaatcgctaaagtcgctacagctcaggacgacatcaccggagacggaacaacctcaaacgtcctaattataggcgaattgttgaaacaagcagacctttacattagtgagggcctgcacccacgtataattactgaggggtttgaagcagcaaaagagaaagcgctccagtttctcgaggaggtgaaggtgagtcgggagatggatcgagaaacactgatcgacgtggcccgtacatccttaagaacaaaggtgcacgcagagttggccgatgtattaacagaagcggtcgtggattccatacttgcgatcaagaagcaagacgagccaattgacctgtttatgatcgaaatcatggagatgaagcataagagcgagacagacacatctctgattcgaggactcgttcttgaccacggggcacgccatccagacatgaagaaaagagtcgaggatgcctatatactcacctgcaatgtgagtttggagtacgagaagactgaggtcaattctggcttcttctataaatcagcagaagagcgggagaaactggttaaggcagaacgcaaatttattgaggatcgagtaaagaagattatagagttgaagcgcaaagtgtgtggggacagtgataaaggatttgtggtgataaaccagaagggcattgatcctttctctctggatgctctgtctaaagaggggatagtggcactccgcagagcaaaacgcaggaatatggagaggcttaccctcgcatgtggcggagtggcacttaacagctttgacgacctctctccagactgcctgggacatgctggtctcgtgtatgagtacacattgggagaagagaagtttaccttcatcgaaaaatgtaacaatccaagatcagtgacactgctgataaagggccctaataaacacacactaacacagattaaagacgctgtccgcgacggtctcagggcagtgaagaatgccattgacgacggctgtgttgttccaggagccggagctgtggaagtcgctatggcagaggctctcataaaacacaagccctccgtcaagggtcgggcacagctgggagtccaggccttcgccgatgctctgttaatcatccccaaagtgctagcccagaactctgggttcgatctgcaagagaccctggtgaagatccaagccgaacactcggaaagtggccagctagtcggagtcgacctgaacactggagaacccatggtagcggcagaagttggcgtttgggataactactgcgtgaagaaacagctgcttcactcatgtacagtgatcgcaacaaatatccttcttgtcgatgagatcatgcgagcagggatgtctagcctgaaggggtag

SEQ ID NO: 31414 - DNA, 1542 bp, Artificial Sequence
  Description of Artificial Sequence: Synthetic coding sequence
atgtgggacgtgtgcatggaacggggacaccgcgacttggagcagttcgaaagggttcatagatacatttccgaccagctgttcaccaatttcaaagagagaacagagcgcttggtgatttcaccactcaatcagttactgtccatgtttacaggtccccataagctcgtgcagaaacgcttcgacaagttgttagatttttacaactgtaccgagagggctgagaaactgaaggacaagaagacattggaggagttgcaaagtgccaggaataattatgaagccttgaatgctcagctgctggacgagctgccaaaatttcatcaatacgctcaggggcttttcaccaactgcgtacacggatatgcagaggcccactgcgattttgtacatcaagctctggagcagctgaaaccattgctaagtctgttgaaagtcgccggtcgggaaggcaatcttatcgctattttccacgaggagcattctcgggtactccagcagctccaggtgttcaccttttttccggaatctttacctgctacaaagaaacccttcgaacgcaagaccattgaccggcagtcagctagaaagccgctgcttggcctcccttcttacatgttgcagtccgaggagctgagggccagtctgctggcgaggtatcctcccgagaagctgttccaggcagaaagaaattttaatgccgctcaggacctggacgttagcctgttggagggtgatctggtgggcgtgatcaagaagaaggaccccatgggatctcagaaccgctggctaattgataatggcgtaaccaaaggcttcgtgtattcttccttcctcaagccctacaatcccaggagaagccattccgatgctagcgttggctcccatagttccacggaatccgagcacggctcctctagtccacggttccccaggcagaactccgggtctacacttacttttaatccgagttctatggcagtgtcttttactagcggatcatgccaaaagcagccccaggacgctagccctccaccaaaagagtgtgaccaaggcaccctgtcagcctcactgaacccttccaacagtgaaagttctccttctaggtgcccgtctgaccccgatagcacatcccaaccgagatctggggattccgcggacgtagcgagagatgtgaagcagcctacggcgacgccccgttcctacagaaactttcgccatccagaaatcgtcggctactctgttccgggtcggaacgggcagtcccaggacctggtgaaaggctgcgccagaactgctcaggcgcctgaagatcgcagtacggagcccgatggaagtgaagcggaaggcaaccaggtgtacttcgccgtatatacatttaaggcacgaaatcctaacgaactctcggtctcagcaaaccagaagctcaaaattcttgagtttaaggacgtgaccggtaacactgagtggtggctggcagaggtgaatggcaaaaaaggctatgtgcctagcaactacattagaaagaccgagtatacctag

SEQ ID NO: 31415 - DNA, 153 bp, Artificial Sequence
  Description of Artificial Sequence: Synthetic coding sequence
atgatgcaaaatgtgcatcttgcaccagaaacagacgaggatgacctttactcaggatacaatgattacaatcctatttacgatattgaagaacttgaaaatgacgcagcttttcagcaagccgtgcgtacttcccacggcaggaggccttag

SEQ ID NO: 31416 - DNA, 4317 bp, Artificial Sequence
  Description of Artificial Sequence: Synthetic coding sequence
atgagcatgttgaaaccaagcggcctgaaggcaccgacaaaaattctgaagcccggaagcaccgccctgaagacgcccactgcagttgtcgcgcctgtggagaagactatttcgtctgaaaaagcttccagcaccccctctagcgagacacaggaggaatttgtggacgattttagagtgggggaacgcgtgtgggtcaacgggaacaagcctggcttcatccaattcctgggcgaaacacagttcgcacctggacaatgggccggtattgtgctggacgagcccattggcaagaacgacggtagtgtggcaggcgtacggtactttcagtgcgaacctctcaagggtatttttacgcggccttcaaagctcacccgcaaagtgcaagcagaagacgaggcgaacggattacagacgactcccgcttcgagagctacttctccactgtgcacaagcaccgcttctatggtgagctcttcccccagcacaccgtcgaatatccctcagaagccttcccagcctgcggctaaggaacccagtgctactccccctatttccaatctgacaaaaaccgcatctgagagcatctcgaatctgtcagaagcaggtagcattaaaaagggcgagcgcgagttgaagatcggagatcgcgtgttggtgggcggtaccaaagctggagttgttagatttctgggtgaaacagactttgccaaaggagagtggtgcggggttgagctggacgagcccctggggaagaatgacggcgctgtggccggaactcgctattttcagtgtcagcctaaatatggcttgttcgcacctgtgcacaaagtaaccaagattgggtttccttcaactaccccagccaaagccaaggcgaatgcggtaagaagggtgatggccactacctctgcaagcctgaagcggtcaccctcggccagttcattgtcctctatgtccagtgtggccagtagcgtgtcgagtcggccaagccggaccggcctgctgacagaaacctctagcagatatgcccgaaaaatttctggtactaccgccctgcaggaagccctgaaagagaagcagcagcacatagagcagcttctcgcggagcgggacctggagcgggctgaggtggcaaaggctacttctcatgtcggagaaatcgaacaggaactggcgctggcacgggatgggcatgatcaacatgtactggagctggaggctaaaatggatcagttgaggaccatggttgaagctgcggatcgcgagaaggttgagctgttgaaccagctagaggaagaaaagcgtaaggtcgaggatctgcagttccgggtcgaagaggagagcatcacgaaaggtgacctggagcaaaaatcacagatctccgaggatccagaaaacactcagaccaagttggagcacgcacgcataaaagaactcgagcagtctcttctcttcgagaaaacgaaggccgataagcttcaacgggagctcgaagacactcgggttgcgaccgtgtcagagaaatccagaattatggagcttgaaaaggaccttgccttaagagttcaggaggtcgccgaactgcgtcgcaggttagaaagtaacaagcccgcaggagatgtagatatgtctttgtcattgttgcaggagatctctagcctgcaagaaaagctggaagtgaccaggacagatcaccaacgggaaatcacgagcctgaaggaacactttggagcgagggaggaaacgcatcagaaggaaatcaaggcgctgtatacagccaccgagaaactgagtaaggaaaatgaatccctgaaaagtaaattggagcacgctaacaaggaaaactctgacgttatcgcattgtggaagagcaagttagaaacagccattgcaagccatcagcaggcaatggaggagctgaaagtgagcttctcaaaaggcctgggcactgagactgctgagttcgccgagttaaaaacacaaattgaaaagatgagactggattatcaacacgaaatagagaacctgcaaaatcagcaggattcagagcgtgcggctcacgcaaaagagatggaggctttgagggctaagctcatgaaagttattaaggaaaaggagaattcccttgaagctatacgtagtaagttggataaggcggaggaccagcacctggtcgaaatggaggatacactcaacaagctgcaggaagccgagataaaagtgaaagagctcgaggttcttcaggctaaatgtaacgaacaaactaaggttattgacaactttacgagccaattaaaagccaccgaagagaaactgctggacttggacgcactccgcaaggcctcttcagagggaaagtctgaaatgaagaaactgcggcagcagcttgaggccgctgagaagcaaatcaagcacttggagatcgaaaagaatgcggagtccagtaaggctagttcaattactagagagctacaaggacgagagttgaagttaaccaacctgcaggagaatcttagtgaggttagccaggtaaaggaaaccctggaaaaagaactgcaaatcctgaaggagaaattcgcggaagcttctgaggaggcggtgagcgtccagagatcaatgcaggaaacggtgaacaaattacatcagaaggaggaacagttcaacatgctcagcagtgatctggaaaagctgagagagaacctggcagatatggaggctaagttccgagagaaggacgaaagggaagagcagttgattaaagcaaaagagaaacttgagaacgacatcgccgagatcatgaagatgagcggtgacaacagcagccagctgacaaagatgaatgacgagttgaggctgaaggagagggacgtggaggagctgcaactgaaactgactaaagcaaacgaaaacgcttccttcctgcagaagagtattgaagatatgaccgtgaaggccgaacaaagtcagcaggaggctgcaaaaaaacatgaagaagagaaaaaggagctcgaaaggaaattaagtgacctggagaaaaaaatggaaacatcgcacaaccagtgccaggagctcaaggctcgatacgagagagccacctctgagactaagaccaaacacgaggaaattttgcaaaacctacaaaagaccctgctagacactgaagacaaacttaagggcgctagagaagaaaattccggcctcctgcaagaattggaggaattgagaaaacaggccgataaagcgaaggcggctcagacagctgaggatgctatgcagatcatggagcagatgaccaaagaaaaaaccgaaacactggctagcctggaggataccaagcagactaatgctaagctgcaaaacgagctggacacactgaaggaaaataatttgaagaacgtggaggagctcaataagtctaaggagctgctaaccgtggagaatcaaaaaatggaggaattcaggaaggaaatagagaccttgaagcaggccgcagcccagaagtctcaacaactttccgctctccaggaggagaacgtgaaactggccgaggagcttggtagatccagagacgaggtgactagccaccagaagctcgaagaggaacgctcggtgctcaataaccagctccttgaaatgaaaaagcgcgagagcaagtttattaaagatgcagacgaagaaaaggcctctctacagaagtcaatctccataacgtcagctcttttaacggagaaggacgccgagctggaaaagctaaggaacgaggtaacagtactgcgaggggagaacgcttctgccaagtcgcttcactcggttgtccagacacttgaaagtgataaagtgaagctggaactgaaggtcaaaaatttggaactgcaactcaaggaaaataagcgacaattgtcttcaagcagcggcaacacggatacacaggccgatgaggatgagcgagctcaggagtcccaaatagatttcctgaactctgtgatcgtcgaccttcagcgaaaaaaccaagacctgaagatgaaagtggagatgatgagtgaagccgcactgaacggcaacggagacgacctgaacaactacgattctgatgatcaagagaaacagagtaagaaaaaacctcgactgttctgtgacatctgcgactgtttcgacttgcatgacaccgaagactgccctacacaggctcagatgagcgaggatccaccacacagtacccatcatggatctagaggcgaggaacgaccttattgtgagatttgtgaaatgtttgggcactgggctacgaactgcaacgatgacgagacattctag

SEQ ID NO: 31417 - DNA, 636 bp, Artificial Sequence
  Description of Artificial Sequence: Synthetic coding sequence
atggctttcgctgactcacatctgtggaagctgctggatcgccacgctaatacaattcgccttttcgttctgctccccgagcagtccccggtatcttatagtaaacggacagcctaccaaaaggccggtggggattctggtaatgtggatgacgattgtgaacgcgtgaaaggacccgtgggaagccttaagtctgtcgaagccattcttgaggaaagtaccgaaaagttaaaaagcttatccttacaacagcagcaggatggtgacaacggagactcgagtaaaagcacagaaacctccgatttcgagaatattgagagtcccctgaatgagcgcgactcctccgcttctgttgataatcgtgagttggagcagcacatacaaacctccgatcctgagaatttccagtcggaagagagatctgacagtgatgtgaataacgatcggagcacaagttcggtggactccgacattctgagctcatcccactcatcagacaccctttgtaatgctgacaatgcccagatcccattagctaacggccttgatagccattcaatcaccagttcccggaggacgaaagctaatcgggaaaaaaggaacatgggttacagtcggcgtcgcctctggaactag

SEQ ID NO: 31418 - DNA, 2136 bp, Artificial Sequence
  Description of Artificial Sequence: Synthetic coding sequence
atgttagcttctttgaaagttaagaagcaagagcttgctaattcctccgatgctacgctgcccgacagacccttgagcccacccttgactgctccacccactatgaaatcttcagaattctttgagatgctcgagaagatgcagggcatcaagctggaggagcagaagcccggaccgcagaagaacaaagatgattacatcccttacccgtcaatagatgaggtggtggagaagggtggcccatacccgcaggtcatcctaccccagttcgggggttattggattgaggaccctgagaacgtcgggactccaacatccctgggatcaagtatttgcgaggaggaggaggaagacaacctctcacccaatacattcggctataagcttgaatgcaagggggaagctagggcctaccggcgtcacttcctcggaaaggatcatttaaatttctattgcacaggtagttctttgggcaacctgattttgtccgttaagtgcgaagaggccgaaggcatcgagtacctgcgtgtaatactgaggtcaaaactgaaaactgttcatgaaaggatccccctggccggtctttctaagctgccttcagtcccacagatcgccaaggccttctgtgacgatgcggtggggctacgctttaatcccgttctctaccccaaggcctcacaaatgatcgtgagctatgatgagcacgaggtgaacaataccttcaagttcggcgttatttaccaaaaggcacgacagacattggaggaggaactcttcggcaataacgaagaaagtccagcgtttaaagagttcctggacctcttgggtgacaccattactctccaggacttcaaagggttccggggaggacttgatgtgactcacggccagaccggggtggagtccgtgtataccactttccgcgaccgggagattatgtttcacgtatccacaaaactgccattcaccgatggagacgcccagcagctgcagcggaagcggcatatcggaaacgacatagtggccatcatctttcaggaagagaacacacctttcgttccagacatgatagccagcaatttcctgcacgcatacattgtagtccaggtcgaaacccccggaacagaaactccctcatacaaggtctccgtaactgctcgcgaagacgtgcccacctttggtccccctttaccgtctccgcctgttttccaaaagggcccagaattccgggagttccttttgacgaaactgactaatgctgagaacgcttgttgtaaatcggacaaatttgccaaattggaggatagaaccagggcagccctgcttgacaacctccacgatgaactgcatgctcacacacaggctatgctgggactgggtcctgaagaggacaaattcgagaacggtgggcacggcggatttttagaatctttcaagagagctatcagagtgcggagtcattctatggaaactatggtgggcggacagaagaagtcccactcaggcggaattcctggctctctgtccgggggaatctcccacaatagcatggaggttaccaagactacctttagtccccctgttgtagcagccaccgttaagaatcagtctagaagccctattaagcggagatccggtctgtttcctaggcttcacacaggctccgaagggcagggagactcccgcgctaggtgtgactccactagctctactcccaaaacacccgatggaggccactcctcccaggagattaagagcgaaacctcctccaacccctcatcccccgaaatctgccctaacaaggagaaaccatttatgaagcttaaagaaaatggcagagctatttcgcgatcatctagttcaaccagctccgtcagcagcaccgccggagagggcgaagcaatggaggagggtgattcgggcggatcccagccgagcactacatccccattcaagcaggaggtgttcgtctatagccccagtccttctagcgagtctccatccctcggagccgcagcaacaccaattataatgtccaggagtccaaccgatgccaagtcccgtaattctcccaggagtaatctgaaattccgttttgacaaactcagccatgcctcgtccggtgcaggccactag

SEQ ID NO: 31419 - DNA, 1089 bp, Artificial Sequence
  Description of Artificial Sequence: Synthetic coding sequence
atggacggcttggatgatgttgagaacagtatgctttattacaaccaggcagtgatcttatatcatttgcgccaatacacagaggcaataagtgtcggagaaaagctgtatcagtttatcgaaccattcgaggagaaattcgcacaggccgtctgtttcttgcttgtagacctttatatcctgacctaccaagccgagaaggcgctacacctcctggccgtgcttgaaaaaatgatttcccaggggaacaataataagaatggtaagaatgagactggcaacaataataacaaagatgggagcaaccacaaggcggagagtggcgcactgattgaggctgccaaatcgaaaattcaccagtataaggtccgagcctacattcagatgaaatctcttaaagcttgcaagcgggagatcaaatccgttatgaatacagctggtaactctgctcccagtctgtttctgaagtctaattttgagtacctgagagggaattaccgcaaagctgtgaagctcctgaatagcagcaacatagccgaacatccgggattcatgaaaacaggcgaatgcctccgttgcatgttttggaacaatctcggttgcatacacttcgccatgagcaagcacaacttgggaattttttacttcaagaaggcgttacaggagaacgacaatgtgtgtgcccagctgtccgccggaagtactgatcccggtaaaaaattttcgggcaggcccatgtgcacactccttacgaataaacgctacgaactcctgtacaactgtggaatccaactgcttcatatcgggagaccgcttgctgctttcgagtgtctcatcgaagctgtgcaggtatatcatgcgaacccgaggctgtggctacggcttgccgaatgttgcatcgccgctaacaaaggaacttccgagcaggaaacaaagggacttccgtccaagaagggcattgtgcaaagcattgtcgggcaggggtaccacaggaaaattgtcctggcctcccaatctatccagaatacagtgtataatgatgggcagagcagtgccattccggtagctaaggccggaaaatggggctag

SEQ ID NO: 31420 - DNA, 1821 bp, Artificial Sequence
  Description of Artificial Sequence: Synthetic coding sequence
atgtgtggagcagggtttgggcacttcgagtggttggctggtggtggggcaggccaggacgtgggcaggagttgcattttagtcagtatcgcaggtaaaaacgtcatgctggattgtggaatgcacatgggtttcaacgacgacagacgcttcccagactttagctacattacgcagaacggaagactgacagatttcctggactgtgtgattataagccatttccacctggaccattgcggcgctcttccatacttttccgagatggtggggtatgacggtcctatctatatgactcaccccacgcaggcaatctgtcctatactcctagaagattacaggaagattgccgtggacaagaagggtgaggcaaacttctttacctctcagatgattaaggattgcatgaagaaggtcgtggccgtccacctgcatcagaccgtgcaagtagatgacgagctggagatcaaagcctactatgcaggacacgttctcggagccgctatgtttcagattaaggtggggtccgagtccgtcgtgtacactggagattataatatgacacccgacagacatttaggcgctgcctggattgacaagtgcaggcccaacctgctgatcactgagagcacatacgcgacaacgattcgtgacagcaagagatgccgggagcgggactttctgaaaaaagtgcacgaaaccgttgaacggggtggtaaagtcctgattcctgtattcgctctgggaagggcacaagagctgtgtattctcctggagacgttttgggaacgtatgaatctcaaggttcccatctatttctcaaccgggctgactgagaaggcgaatcactactacaagctatttatcccctggaccaaccagaagatcagaaaaacattcgtgcagaggaacatgtttgaatttaaacatattaaagctttcgacagggcatttgcagataaccccggacctatggtggtatttgcaacccccggaatgctgcatgcgggtcagtccctgcaaattttcagaaaatgggccggtaatgagaagaacatggtaattatgcctggatattgcgtgcagggcacggtgggccataagattttgtctggccaacgtaaactcgaaatggaaggcagacaagtcctcgaggtgaaaatgcaggtggaatatatgtctttttcagctcacgcagatgccaagggtatcatgcagctcgtggggcaagcggagcctgaatctgtccttctggtccatggggaggcaaagaagatggagttcttgaagcaaaaaattgagcaggagcttagggtgaattgctacatgccagccaatggggaaactgtgacactccccacaagcccgtcaatcccagtcgggatcagcctgggattgttaaagagagagatggcgcaaggcctgctgccggaggccaagaaacctcggctcttgcatggtactcttattatgaaagactctaacttcaggctggtttcgagcgagcaggccctcaaagagcttggcctcgccgaacaccagttaagatttacttgccgggtgcaccttcatgacacacgaaaggaacaggagaccgccctgcgggtttactcccacctgaagtctgtgcttaaagatcattgcgtgcagcatctaccagacgggtccgttaccgttgagtctgtgcttcttcaggcagctgcacccagcgaagacccgggaactaaggtactactggtttcctggacctaccaggacgaggagctgggatcgtttctcacaagtctcctcaagaagggtctgcctcaggccccttcctag

SEQ ID NO: 31421 - DNA, 399 bp, Artificial Sequence
  Description of Artificial Sequence: Synthetic coding sequence
atgaagaaggtgcgtcttaaggagctcgaaagccggctgcagcaagtggacgggttcgagaaaccaaaactcctgctggagcaataccctacacgcccacatattgctgcctgcatgctctatacaatccataatacctacgacgatatcgagaacaaagtcgtcgccgacctaggctgcgggtgcggagtcctgagcattggcaccgcgatgctcggcgcagggctgtgcgtcggattcgatattgatgaggacgcactggagatttttaaccggaatgccgaagaatttgaactgcagattttaacctggtttaacgtcatgtgcgcttattacctgacagagtgcccatcccatagcatccagaactacgagagctcattatgggaccagaaatag

SEQ ID NO: 31422 - DNA, 1371 bp, Artificial Sequence
  Description of Artificial Sequence: Synthetic coding sequence
atgatggtgggagatggaacaacaagcgtgactctgctggctgcagagtttttgaagcaggtgaagccttacgttgaggagggattgcaccctcaaatcattattcgcgctttccgcactgctacccaactcgccgtcaacaaaataaaggagatcgcagttactgtgaagaaggctgataaggtcgagcagcgtaaactgctcgagaaatgtgctatgaccgccttatcctctaaactcatttctcagcaaaaggcttttttcgccaaaatggtggttgacgctgtgatgatgctggatgacctgttgcagttgaagatgatcggcatcaagaaagtacagggcggagcgctcgaagactcccaactggttgccggagtcgcttttaaaaagactttttcttatgcaggattcgaaatgcaacccaagaaataccacaaccctaagatcgccctgcttaatgtggaactggagcttaaggccgagaaggataacgcggagataagggtgcacacagttgaagattatcaggccattgtggacgcagaatggaacattctgtatgacaagctcgaaaaaattcaccactcaggggctaaggtggtcttgtccaagctgcccattggggacgtggccacacaatactttgctgaccgcgacatgttttgcgccggacgtgtgccggaggaagatctcaagagaacaatgatggcttgcggaggctcaatccagacttccgtgaacgcactgtcagccgacgtgctaggtcggtgtcaagtcttcgaagagacccagatcggaggggaaagatataacttttttaccgggtgtcctaaagcgaaaacctgcaccttcatcctccggggaggcgcagagcaattcatggaagagacggaaaggtccttgcacgacgctattatgattgtgcgcagggccattaaaaacgattcggttgtggcgggtggaggcgctatagaaatggaactctctaagtatctccgggactactcacgcaccatccccggaaagcagcagcttctcatcggtgcctacgcgaaagctctggagattattcccaggcagctgtgcgacaatgcgggatttgatgcaactaacattctcaacaagcttcgcgctcgtcacgcccaaggtggcacctggtacggagtagacatcaacaatgaggatatagctgataactttgaagcgtttgtctgggagcctgccatggtgcgaattaatgctctgacagccgcaagcgaggctgcctgtctgattgtatctgtggatgagacaattaagaatcctaggtcgacagtggatgcacctaccgctgcgggtagagggcgtggaagagggaggcctcactag

SEQ ID NO: 31423 - DNA, 2520 bp, Artificial Sequence
  Description of Artificial Sequence: Synthetic coding sequence
atggacggaaaggccgatgtcaagtccctgatggccaagtacaacacaggtggcaaccccaccgaagacgtatccgtcaattcacgcccatttagagtcaccggtcctaacagcagtagtggaattcaagctagaaaaaatctatttaataatcagggcaatgcatcaccgccagctggcccatccaacgtgcctaagttcgggtctcctaagccaccagtcgccgtcaaaccatcttcagaggagaagccagacaaagaacctaagcctccctttctcaagccaaccggtgccggacagaggttcggcacacccgctagcttgactacacgggatcctgaggccaaggtaggcttcctgaagccggtgggccctaaacctattaacctaccgaaggaagacagtaaacccacattcccctggcccccagggaataagccctcacttcacagcgtgaatcaggaccacgatctgaaacccttgggacctaagagtggcccaactcccccaacctcagagaacgagcagaaacaggcatttccgaagctgaccggtgtgaagggcaagttcatgagcgcctctcaggacctcgagcccaagcctctgttccctaaacccgctttcggccagaagccccctctgagcacggaaaatagccatgaggatgagtctcctatgaaaaatgtctcctccagcaagggcagtccagcgcctctcggagttcgctccaagtctgggcctctaaaacctgctcgcgaagattcagaaaataaagatcacgccggagaaatttcatcactgccttttcctggggtggtgctgaaaccggctgctagtcggggaggcccaggattgtcaaagaatggcgaagaaaagaaagaagaccgcaagatcgacgcggcaaagaacacatttcagtctaaaattaaccaggaagaattagcctccggcactcccccagccagatttcctaaggccccatccaagctgactgtggggggtccctgggggcaatcacaggaaaaggagaagggagacaagaacagcgcaaccccaaagcagaagccgctaccgcctctattcacattggggccacctccccctaagccaaatcggccacccaatgtggatctgacgaagttccataagacaagttctggcaacagcacttcaaaaggccagaccagttactccaccacttcgctccctcccccaccaccgagccaccccgcatctcagcctccgctgcccgcttcccatcccagtcagccgccagtgcctagtctgccaccaagaaacatcaagccccctttcgatcttaaatctccggtcaacgaagacaatcaagacggggtaacacactcggatggtgctgggaacctggacgaagaacaggactccgagggagaaacttatgaggacatagaggcttccaaggaaagggaaaaaaagcgcgaaaaggaggagaagaaaagattggagcttgaaaaaaaggagcagaaagagaaggagaaaaaggagcaagagattaaaaaaaagttcaaactaaccggtcctatacaggtgatccacctggctaaagcctgttgtgatgtgaaggggggtaagaacgagcttagcttcaaacaaggcgaacaaattgagatcatccgtatcacagataacccagaaggaaagtggttaggaagaaccgccaggggctcttatggctatataaagacgaccgcagtggagatcgattatgattccctgaaactgaagaaggattcactgggcgcaccgtctcgcccaatcgaggacgaccaggaggtctacgacgacgtagccgagcaggacgatatttcttcccacagccaatccgggtccggaggcatctttcctccgcctcccgatgacgatatctacgacggaatcgaggaagaagatgccgacgacgggagcacgttacaagtccaggaaaaatcaaacacctggtcctggggaatcctgaagatgttaaagggcaaggatgacaggaagaagtctattcgtgaaaagccaaaagtcagcgactctgacaataacgagggctcgtctttccccgcaccgcctaaacagctcgacatgggcgatgaggtctacgacgacgtggatacgagcgactttccagtgagctccgccgagatgtcacaggggacaaacgtggggaaagcgaaaactgaggaaaaggaccttaaaaagctgaaaaaacaggaaaaggaggagaaggactttcggaagaaatttaaatatgatggcgagataagagtgctctatagcacaaaggtgactacgtctatcacctcgaagaagtggggcacgcgcgatctccaagtgaagccaggtgagtcattagaggtcatccagactacggatgacaccaaagtgctctgtaggaacgaagagggcaaatacgggtacgtgctgagatcttacctggctgacaacgacggcgagatctatgacgacattgccgacggatgtatttatgacaatgactag

SEQ ID NO: 31424 - DNA, 1017 bp, Artificial Sequence
  Description of Artificial Sequence: Synthetic coding sequence
atggggcatagatacattgaagtgttcaaatctcaccggacagaaatggactgggtcttgaaacactccgggccaaactccgcagatagtgcaaacgatggattcgtacgactgagggggcttccctttgggtgcacgaaagaggagatcgtccagttttttagcggactcgagatcgtaccaaatggcatcacattgcctgtagaccccgaagggaagatcaccggtgaagcttttgtgcaatttgcctcccaggagttggcagagaaggcgctggggaaacataaagagagaataggtcatagatatattgaagtctttaaatcgagccaggaagaggtcaggtcatacagcgatccaccccttaaattcatgtcagttcagcgcccaggaccatacgataggccgggaaccgcccgtcggtatattggcatcgtaaaacaagctggattggagcgtatgcggccaggcgcatattctaccgggtatggcggatacgaggagtatagcgggctcagcgacgggtatggatttaccacagacctctttggccgagatctgtcctattgtctgagcgggatgtacgatcatcgctacggggactccgaatttactgtacaatctacaactggccactgcgtgcatatgaggggccttccttataaagcaaccgagaacgacatttataatttcttttctccgctcaatcctgtgagagttcacattgagattggcccagatggcagagtgactggagaggccgacgtcgagtttgcaacgcacgaggaggcggtcgcagccatgtcgaaggatcgagctaacatgcaacacaggtacatcgagctttttttgaacagtacaacaggcgcttcaaatggtgcgtatagttcccaagtgatgcagggaatgggggtgagcgctgcacaggccacctacagtggactcgagagccagtctgtttctggctgctatggcgctggatacagtggtcagaatagcatgggcggatacgattag

SEQ ID NO: 31425 - DNA, 1536 bp, Artificial Sequence
  Description of Artificial Sequence: Synthetic coding sequence
atggcctcagttgtggagtacaagggcctgagggccggatatcactgtggctactgtgacagtaaagagggcaaagcttcgtgcgggatgtgggcccacagtatgactgtccaggactatcaggacctcatcgacagagggtggaggagaagcgggaaatatgtgtacaaacctgttatgaatcaaacgtgctgtccacaatacactatcaggtgtcggccattgcagttccagcctagcaagtctcataaaaaagtgctgaaaaaaatgctgaagttcctggctaaaggggaggttcccaaaggttcctgtgaggatgagccaatggacagtactatggacgatgccgtggccggtgactttgcccttattaataaattagacattcagtgtgacctgaaaacactgtccgatgacattaaggagtctttagaaagcgaggggaagaactccaagaaggaagaaccacaggagcttctgcaaagccaagacttcgtgggagagaagttgggcagcggagagccatcgcatagcgtgaaggtgcacaccgttcctaaacccggaaaaggcgcagacctttctaaacccccttgcaggaaggccaaagaaataaggaaggagaggaagcggctgaagttgatgcagcagaatcctgcgggagaactcgagggatttcaggcccagggccatcccccttccctcttcccacctaaagcaaagtccaatcagcctaagtcactggaagatctcatctttgaaagtctgcctgaaaatgcgtctcacaaattagaagttagacttgtgcctgtgtcttttgaggaccctgagtttaaaagctcattttctcagtccttctctctctatgtaaagtatcaggtggctatccaccaagacccgccagacgaatgcggaaagacagagtttacaaggttcttgtgttccagcccacttgaagccgaaacacctccgaatggacctgactgtggctacggctcgttccatcagcagtactggctagatggcaaaattattgctgtgggagtcatagacattctgcctaactgtgtgtcctctgtctacttgtattatgacccagactactcattcctgagtctgggcgtgtattcagccctgcgcgagattgcatttacacgacagcttcacgagaaaacctctcagctgagctactattacatgggcttttacattcattcgtgccctaagatgaagtacaaaggacagtaccggccttccgatctcctctgcccagagacttacgtatgggtgccaattgaacagtgtctgcctagcttggagaactccaagtattgtcgctttaaccaggatcccgaggctgttgacgaggatcgcagcaccgagccagaccggcttcaggtatttcataagcgagccataatgccatatggtgtttataaaaaacagcagaaagacccctcagaagaggctgccgtgttgcaatacgcctccctagtgggtcagaaatgtagcgagcggatgctactgtttcggaattag

SEQ ID NO: 31426 - DNA, 3963 bp, Artificial Sequence
  Description of Artificial Sequence: Synthetic coding sequence
atgcaggacgattccatcgaagcttctactagtatcagccagctactgagagagagctaccttgcagagaccaggcaccgcggtaataacgagaggagcagagcagaaccctcgtctaacccttgccacttcggatcaccttccggtgctgctgaagggggaggaggccaggacgacctccccgatctgtctgctttcctgtctcaggaggaactggatgagagtgttaacctggcaaggctagccatcaattacgatccattggagaaggcagatgagacacaggcacgaaaacgcctctcccccgaccagatgaagcacagtccaaatttgagcttcgagcctaacttctgtcaggataatccccgttctcccacatcgagtaaggagtctcctcaggaggcaaaaaggccacaatactgttcggagactcaaagtaagaaggtattcctgaataaagcggctgatttcatcgaggagctaagttccttattcaagagccactctagcaaaaggatacgcccacgcgcttgtaaaaatcacaaatccaagcttgagtcacagaacaaggtgatgcaagagaacagcagcagtttctctgacttgtcagaacggagggagcgaagctctgtccccatccctatcccagcagacacccgagataacgaagtcaaccatgccttagagcaacaagaagccaagagacgcgaagcagaacaagccgcttcagaggccgcaggaggtgacacgactcctgggtcttccccctcttcgttatactacgaagaacccctgggacagcctcctcgatttacccagaagctccgctctagggaggttccagaagggacacgtgttcagctcgactgtattgtggtgggcattcctcccccacaagttcggtggtattgtgagggcaaggagttggagaatagccccgacatacatatcgtgcaagcgggaaacctccactctcttactatcgcagaagcctttgaagaggacaccggccgatattcttgctttgcaagtaatatttacggaacagatagcacctctgccgagatctacatcgagggcgtgtcatccagcgacagcgagggagaccctaacaaggaagagatgaacagaatccagaagccaaatgaagtcagttcaccacccaccactagtgccgtgatacctcctgccgttccccaggcccaacacctcgtcgctcagccccgagtcgcgactatccaacagtgccagtcaccaacgaactacctgcaaggtctagacggcaaaccaatcatagcggctcctgtcttcactaagatgctccagaatctctccgcatccgagggccaactagtcgtgttcgagtgtcgtgttaagggcgctcccagcccaaaggtggaatggtaccgcgagggaaccctgatcgaagacagccccgactttaggatcctgcagaaacgccctgtttgtatggagcacatagaggaaatatgtactcttgtgattgctgaagtgttcgctgaggattccggctgctttacttgcaccgctagcaacaagtatggcactgtttcctcaatagcccagttacatgtacgcggaaacgaagacctttccaacaatggcagccttcattctgctaacagtaccacaaatctcgccgcaattgagccacagccttccccaccccattctgagccaccgagcgtggagcagcctcctaagcctaagttagagggtgtgcttgtgaatcacaatgagcctcgctcaagttctaggatcggactgagagtgcactttaaccttcctgaggatgataaaggcagcgaggcctcgagcgaggccggagtggtcaccaccagacagactaggcccgactctttccaagagagattcaatggccaggctaccaagacgcccgagccgagcagtcccgtcaaagaacccccaccagtcctggcaaaacccaaactggactcaacccaattacagcagctgcataatcaggtcctgctcgaacaacaccagctgcaaaaccccccacccagcagcccgaaagagttccctttttccatgaccgtgctgaactccaatgccccacccgcagtgaccaccagcagcaagcaggtcaaagcaccgagtagccaaacattctcgcttgcaagaccgaaatatttcttcccttctaccaatactactgcagctaccgttgcccctagcagttcccccgtgttcactctttctagcacaccacagaccatccagagaacggtgagcaaagagtctctgctggtcagtcacccctctgtgcaaactaagtctccgggagggctcagtattcagaatgagccattaccacccggacccacagaacctacgcctccaccattcacctttagcataccctctggcaaccagtttcagcctagatgcgtgtctcctatcccagtttctcccacctcaagaattcagaatccggtggctttcctctccagcgtgctcccatctctgcctgcaatcccaccaacaaatgcgatgggactcccgcgtagcgctccttccatgccatctcaaggactggctaagaaaaacaccaaatctccacagccggtgaacgatgacaatatcagggagacgaagaatgccgtgattcgcgatctcgggaaaaagattaccttttccgacgtcaggcctaaccagcaggagtataaaattagtagctttgagcaaagactgatgaatgaaattgagtttagattggaaaggacacctgtggatgagagcgatgacgagatccagcacgacgagattcctactggcaagtgtatcgcaccgatcttcgataagcggcttaagcactttcgagtgactgaaggaagtcctgttacttttacctgcaaaatcgtcggaattccggtcccaaaggtctactggttcaaagacggtaaacaaatctccaaacgaaatgaacactgcaaaatgcgcagagaaggcgatggaacatgtagtctccacatcgagtctacaacttcagacgatgatgggaactacaccattatggccgcaaatcctcagggccgtatttcttgctcaggacatctgatggtgcagtcactgcccataagatccaggctcacgtcggccggacagtcacaccgaggcaggtcccgcgtacaagaaagagacaaagagccactgcaggaaagatttttccggcctcacttcctccaagcccctggtgacatggtggctcacgaaggcagactgtgtcggctagactgcaaagtgtcaggtcttcctccgccagagctgacgtggctgctcaacgggcagcccgttctccccgacgcctctcacaaaatgttagtacgcgaaactggggtgcattcacttctgattgacccactgactcagagggacgccggaacatataaatgcattgcaaccaataaaacagggcagaactcgtttagtctggaactgagcgtggtcgctaaagaggtcaaaaaggcacccgttattctcgaaaaactgcaaaattgcggtgtccctgaggggcacccagtcaggttggagtgcagagttatcggcatgccaccccctgtgttctactggaaaaaggacaacgaaactatcccatgtaccagggaacggatcagcatgcaccaggacaccaccggatacgcatgcctcctcatccaacccgctaagaagtcagatgcaggctggtacacgcttagcgccaagaacgaagccggaattgtatcttgcacggcgcgtctcgacatctatgcccagtggcaccaccagattcctccccctatgagtgtgagaccaagcgggtctaggtacggtagtctgacaagcaaaggactggatatatttagtgccttctcctccatggaatccactatggtttatagttgttcctctagaagcgtggtggaatcggacgagctttag

SEQ ID NO: 31427 - DNA, 2292 bp, Artificial Sequence
  Description of Artificial Sequence: Synthetic coding sequence
atgcaggatcttggcgataagctacgcatgattgtcatgggacaccgccgagttcacatctcccgtcagctggaggtggagccggaggaacccgaagccgaaaacaaacataagccgcgacgcaaatccaagaggggcaagaaggaggcagaagacgaactttccgcacggcacccagctgaactcgccatggagccaaccccagaactcccagccgaagtgctgatggtggaagtcgagaacgtggtgcatgaggatttccaagttacagaggaagttaaagcactgacggccgagatcgttaagaccattagggacattattgcactgaatccactttacagagagagtgtgctccaaatgatgcaagctggtcagagagtggtggataacccaatctatctgagtgatatgggcgcagctctgacgggggcagagtctcacgagctgcaagacgtactggaggagaccaatattcccaagcgcctgtataaagccctgtctctattgaagaaggagttcgagctcagtaaactgcagcagcgtttaggccgagaagtggaggagaaaattaaacagacacatcgcaagtatctgctgcaggagcagctcaaaattattaaaaaggaactgggtctcgaaaaagacgacaaggacgcaattgaggaaaagttcagggagcggctcaaggagttggttgtgccaaagcatgtgatggacgtggtcgacgaggagctcagtaagctgggactgctggataaccacagtagcgagttcaacgtcacccgtaactacctcgattggctgacatccatcccgtggggcaagtactctaacgagaacctcgatcttgctagggcccaggccgtgctcgaggaggatcattacggaatggaggatgtgaaaaagcggatcctggagtttatcgccgtcagtcaactccgcggatcgacacaaggaaagatcctgtgcttttatgggcctcccggtgtgggcaagacatctatcgcccgatcaattgcccgtgccttgaaccgcgagtatttcagattctcagtgggtggaatgaccgatgtggccgagatcaaggggcacaggcgcacgtatgttggagccatgccaggtaagataatccagtgtctgaaaaaaactaagacagagaaccctctgatcctaatcgacgaagtggacaaaatcggcagaggataccaaggtgatccctctagtgctctactcgaactcttggatcccgagcagaatgccaactttcttgaccattacctggacgtacctgtcgatcttagtaaagtgctgtttatttgcacagccaacgtgacagacacgatccctgaaccactacgagacagaatggaaatgatcaacgtgagtgggtacgtcgcgcaggagaagctcgctatcgcagaaaggtatctcgtcccccaggctcgcgctctgtgcggactggacgagtccaaggctaagcttagttctgatgtccttacactgttgatcaagcagtactgtcgagaatctggtgtgaggaatctgcaaaaacaggtagagaaagtgttacgcaaaagtgcctataagatcgttagcggggaggccgaatccgttgaggttacaccagaaaacctccaagactttgtggggaaacccgtttttacagtggagcgcatgtatgatgtaacgcccccaggagtggtgatggggctggcttggaccgcgatgggcggttccaccctgtttgtcgagacaagcctgagacgtccacaggacaaggatgccaagggagacaaggacgggtccctggaagtaacaggacaactgggggaggtcatgaaggagagcgcacgcatcgcctacacattcgcacgggcttttctcatgcaacacgcacccgctaatgactacctggttacatcccatatccacctgcatgtgcctgagggagctacaccaaaagacggcccttctgctggctgcactatagtgaccgctcttttgtccctcgcaatgggaaggcccgtgcggcaaaaccttgcaatgacaggtgaagtgtcgctgaccgggaaaatcttgccagtgggtggcattaaagaaaaaacaatcgcagcgaagagagcaggagtcacctgcattgtgctccctgcggagaataagaaagacttttatgatctcgcagccttcatcacagaaggactggaggtacattttgtggagcattatcgggagatcttcgatatcgccttccctgacgagcaggcagaggctttagctgttgaacggtag

SEQ ID NO: 31428 - DNA, 558 bp, Artificial Sequence
  Description of Artificial Sequence: Synthetic coding sequence
atgaataataaccagatagtggccaaggacctgcaggatgaaaaaattctctatccagagtttaacaaactcaaagagagaaatagggagctaaagacactcctgtcaattgggggatggaatttcggaacctcccgcttcactactatgctgtcgacattcgcgaatagggaaaaattcattgctagcgtgatttccctgttgaggacacacgacttcgatgggctcgacctgttttttctgtaccctggcctgagggggtcccctatgcacgataggtggacttttttgttccttattgaggagctactgtttgcctttcgtaaagaggccctcttgaccatgcgaccgagactgctgttatcagccgctgtttctggagttcctcatatcgtgcagacatcatatgacgtgcggttcttggggcgttttgtgccgcttagcggcgagagaaggtctaccggcctgattaccagtatgagtcgtatgcccactaggggcaaatcaggcctcgctatgaccatgccaagcgctagcgttacacgacacggtttatag

SEQ ID NO: 31429 - DNA, 1269 bp, Artificial Sequence
  Description of Artificial Sequence: Synthetic coding sequence
atgtccggagggaccccctacatcgggtccaagatatccttgatcagtaaagccgagattcgttacgagggaatactttataccattgatacagagaactctacagtggcgcttgcaaaggtcagatcttttggtactgaggacaggccaacagaccgccctattcctccaagggacgaggtgttcgagtacatcatcttccggggttccgatataaaagacctaacggtgtgcgaaccacccaagccccagtgctcacttcctcaagaccccgctatcgtgcaatcgtccctgggttcctctacaagctcctttcaatccatgggctcttatgggcctttcggtagaatgcccacatactctcagtttagtccttcctctttggtggggcaacagttcggagcagtgggggtcggccgttcgtcccctcagttggatccattacgaaaatcgccaaccatggaacaagccgtgcagactgcttcagctcacctgccagcaccagccgcagttgggagaaggagtccagtgagtacacgaccactgccttctgcaagtcaaaaggcaggcgaaaatcaggaacacaggagagcagaagtacacaaggtctcccggccagagaacgagcaactcaggaatgacaacaagcgtcaggttgctcccggagccccttctgcccctcgcagaggcagggggggtcacagaggcggaaggggtcgctttggaataaggcgggacggccctatgaagtttgaaaaggacttcgatttcgagtccgcaaatgcccaattcaacaaagaagaaatcgacagggagtttcataataagttgaaactgaaagaagataaattagagaagcaggagaagccggtcaatggcgaggacaagggtgacagcggggttgatacacagaacagcgagggcaacgcagacgaggaggaccctttgggaccaaactgttactacgacaaaaccaagagcttctttgacaatatttcgtgcgacgacaacagggagcgtaggcctacatgggccgaagagcggagacttaacgctgagacattcggaattccactcaggcccaacagaggcagagggggttacagaggacgagggggtctgggcttcagaggcggaaggggtcggggaggaggaagagggggtacgttcaccgcccctagaggcttccggggtgggtttagagggggtaggggaggacgtgagttcgccgattttgagtaccgcaaaaccacagcattcggcccatag

SEQ ID NO: 31430 - DNA, 1266 bp, Artificial Sequence
  Description of Artificial Sequence: Synthetic coding sequence
atggcttcctcgtctgtcccccctgcgaccgtttccgccgcaacagcgggacccggtcctgggttcgggttcgcatcaaagacaaagaaaaaacacttcgtccaacagaaggtgaaagttttccgagctgctgacccactggtcggcgtgttcttgtggggcgtagcacactcgatcaatgagttgagccaggttcctcctccagtgatgttgctccccgacgacttcaaggcgtcttcaaaaatcaaggtcaacaatcatctgttccacagggaaaacctcccaagtcacttcaagttcaaggagtactgccctcaggtgtttagaaacctgcgcgatcgctttggaatagatgatcaggattatctggtgagcctgacaagaaacccaccatcagagtccgaaggcagcgacggcagattccttatcagctacgacaggactctggtaattaaggaagtctcttcagaggatatcgccgatatgcactctaacctgtcaaactatcatcagtatattgtcaagtgtcacggcaacacgctgctcccccagttccttggaatgtatcgtgtgtccgttgacaatgaagattcctatatgcttgttatgcggaacatgtttagtcataggctgcccgtacatcggaagtacgatctgaagggatctctcgtgtcaagagaggcctcagataaagagaaggtcaaggagcttcctacactcaaagacatggacttcttgaataaaaaccagaaggtatatattggagaggaggaaaagaagatcttcctcgagaagttgaagagagatgttgagtttctcgttcagctgaaaatcatggactactccctgctgctcgggatacacgatatcattagaggcagcgaaccagaggaagaggcacccgtaagagaggacgaaagtgaggtagatggcgattgctcactgacaggccctcctgcactggtggggtcatacggaacttctcccgagggcattggtggctatatccatagtcatcggccattgggcccaggggagttcgagtcatttatcgacgtctacgctatccggtccgctgaaggagctccgcaaaaggaggtttacttcatgggcctgatcgacatcctcacacaatacgacgcgaagaagaaggccgcacacgctgctaagacggttaagcatggagccggtgcggaaatctccacggtgcaccccgagcaatacgccaagcgtttcttagactttatcaccaacattttcgcttag

SEQ ID NO: 31431 - DNA, 756 bp, Artificial Sequence
  Description of Artificial Sequence: Synthetic coding sequence
atggacagcgagctgatgcacagtatagtggggagttaccataagccgccagagcgggtgttcgtcccttcattcactcagaatgaaccgtcgcagaattgtcaccctgccaacctcgaagttacttcgcccaagatcttacactcaccaaattctcaagcactgatcctcgccttgaagacactgcaggagaaaattcaccggctggaattggaaaggactcaggctgaagataatttgaatatcctgtcgagggaggccgcacagtacaagaaggcgctggaaaatgagacaaatgagaggaatttggctcaccaggagcttattaaacagaaaaaggatatatccattcagctgagtagtgcacagagcagatgtacactgctggaaaaacagctcgaatataccaaaagaatggttctgaacgtagaaagagagaagaatatgatccttgaacagcaggcacagttacagcgcgaaaaggagcaggatcaaatgaagctgtacgctaaattagaaaaactcgacgtcctggagaaagaatgctttcggttaacgaccacccagaagacggccgaagacaaaatcaaacaccttgaagagaaactgaaggaagaagagcatcaacgtaagctgttccaggataaagcaagcgagctgcaaacaggtctagagatctccaaaatcattatgagtagcgtctctaatctgaaacattccaaagagaaaaaaaagtcctctaaggtgtgcatctag

SEQ ID NO: 31432 - DNA, 1980 bp, Artificial Sequence
  Description of Artificial Sequence: Synthetic coding sequence
atggatagtcagggtagagtatgggctcaggaaatgctgctgcgagtctcccctgatcacgtaacgctcctggacccagcaagtaaggaagaattggagtcttaccccttgggagccatcgtccggtgcgatgcggtcatgcctccaggcagaagcaggtccctgttgctgcttgtgtgtcaggagcctgagcgcgcacagcctgacgttcatttcttccaaggtctccgcctgggtgcggagctgatccgagaggatattcagggcgctctgcacaattaccggtccggcaggggggagaggcgggctgctgccctcagggccacccaagaagaactacaacgagatagaagtcccgctgctgagacccctcctctccagcgacgcccatccgtgagggcagtaatcagcaccgtcgaaaggggagccggaagaggacggcctcaggcgaaaccaatccccgaagccgaggaagcgcagcggcctgaacccgtgggcacttcaagtaatgccgactcagcgagcccagatcttggcccacgcggacccgatctggccgtcctacaggccgaacgcgaggtagatattctgaatcacgtattcgatgatgtggagtcctttgtgagtcggcttcagaaaagtgcagaggccgctagggtgctcgaacacagggagaggggacgaaggtccagacggagggctgcaggcgaaggcctgctcactctccgtgccaaaccaccttccgaggccgagtacacagatgtgctccagaaaatcaaatatgcatttagccttctggccaggctgagggggaacattgctgatccgtcctcaccagaacttctccactttctgtttggaccactgcagatgatagttaacactagtggcggtccagagtttgcatcgtctgtgcggcgacctcaccttacttccgacgccgtagccctcttgagagacaacgtgacaccacgcgagaatgagttgtggacttcactgggtgacagttggactcgcccaggcctggagctatctccggaggaaggaccaccttatcgcccagagttcttctctggttgggagccaccagtcactgatccccagtctcgagcatgggaagacccagtggagaaacagctgcagcacgagcgcaggcgtagacaacagtccgcgccacaggtggccgtcaacgggcatcgggatttagagccggaaagtgagccacagctggaatcggaaactgctgggaagtgggttttgtgtaactacgatttccaggcgaggaattcatccgaattgtcggtgaagcagagagatgtattggaagtcttggacgatagccggaagtggtggaaggttagagatccagccggacaggaagggtacgtaccttacaatattttaactccgtatcctggtccccgattacaccatagccagagccccgctcgttcactgaatagcacacccccaccgcctcctgcccctgcgccagctccgcctccagcccttgcgaggcccagatgggacagacccaggtgggattcttgcgattccttaaatgggcttgacccctctgaaaaggaaaagttctctcaaatgctcattgtgaacgaagagttacaggccaggttggcgcaggggagatcaggtccctctcgggcagtgcccggacctcgggctcctgagccccagctgagtcctggtagtgacgcctctgaggtgagggcctggcttcaggcaaaaggctttagctcaggtaccgtcgacgctctgggagtcctgaccggtgcccagctgttctcactccagaaagaagaactcagggccgtgagccctgaggagggcgcacgcgtgtacagccaggtcaccgtgcagcgtagccttttggaagacaaagaaaaagtgagcgagctcgaggccgttatggagaaacagaagaaaaaagtggagggagaagtggagatggaagtcatctag

SEQ ID NO: 31433 - DNA, 3702 bp, Artificial Sequence
  Description of Artificial Sequence: Synthetic coding sequence
atgaatacgaagaagcgaggctctcccgctcgcacccattcaatgatgtcacttagtgtgcgccctcaacggagactgctgtccgctcgcgttaacaggtcccagagcttcgccggagtgctgggcagccatgagagaggccctagatctttcccagtgttctctccacccggtcctccaaggaaacccccagcgctaagtagagtaagccgcatgttttccgtggcccatcccgctgccaaggtgcctcagccggagaggctcgacttggtgtatacggcactcaagcggggactcacagcttacctggaggtacaccagcaggaacaggagaaacttcagggccagattcgggaaagtaagcgaaactcgcgcctgggctttctatatgatctggataagcaggtcaaaagcattgagaggttcctgaggcgcctcgagttccacgcgagcaagatcgatgaactttatgaagcgtattgtgtccagcgcagattgcgcgacggggcttacaatatggtgagagcatacacaacaggaagccccggaagcagagaagccagagattcattggcagaggcaactagaggacaccgcgagtataccgaaagcatgtgtctgctggagagtgagcttgaagcacagctgggtgagtttcatctacggatgaagggcctggcgggattcgccagactgtgcgttggggatcaatacgagatatgtatgaaatacggacgacaaaggtggaaactgcggggaagaattgaggggagtggaaagcaagtgtgggattccgaggaaaccatattccttcctctactgactgagttcctgagcattaaggttaccgagctgaaaggcctggccaatcacgtcgtcgtgggtagcgtgtcttgtgagactaaggacctgtttgcagccctcccacaggttgtggccgttgacatcaatgatcttggcactatcaaactatccctggaggtaacatggtctccttttgataaagatgatcaacccagcgcagcaagttccgtcaacaaagcatctactgtcactaaaaggttcagtacatatagccagtctcctcccgacaccccatccttgcgcgaacaggcattctacaacatgctgaggcgccaggaggaactggagaatgggacggcctggtccttgtcctccgagagttcagatgactctagttctcctcagctgagtggcaccgccaggcatagccctgcgcctaggccacttgtgcaacaacctgagccacttcctattcaggttgcatttaggcgtcccgagacacctagttctggtccactggacgaagaaggggcagtggccccagtcctggcaaatggccatgctccttactcccggacactttcgcatatctccgaagcctcagtggatgcggctctagcagaggcctcagtggaggccgtcggccctgagagcttagcttgggggccttctccacctacacatcccgcaccaactcacggagagcaccccagccctgttcctcccgcactcgatccagggcattccgccaccagttcaacgcttggcaccacaggctcagtcccaactagcaccgatcccgctccaagtgcccaccttgattcggtgcacaagagcacggactctggaccgtcagaacttcctggaccaactcacaccacgacgggatctacctactcagctatcacaacgacccatagcgccccaagtcctttgactcataccacaaccggatccactcataagcctattatttctactctgacaaccacaggccctactctgaacattatcggacccgtgcaaacgacgacctcacctacccatacaatgccctctccgactcacacaaccgccagccccacgcatacaagcactagccccactcacacaccaacctccccaactcacaaaactagcatgtccccaccgactacaacatccccaacaccttcagggatgggattagtgcagaccgccacaagccctactcatcccactactagtcctacacatcctacaacgtctcccatcctgatcaacgtgagccccagcacgagtctcgaactggctacactcagctcccctagtaaacattcagaccccactctccccggaaccgattccttgccctgttctccacctgtgagcaactcatacacacaggcggatcctatggccccacggactcctcacccgagcccagctcattcctctaggaagcctctgacaagccctgctcctgatcccagcgaatctacagtccagtctctcagtcccacaccctcaccccctactcccgcaccacagcactcggacctttgcctggccatggccgtgcagacaccagttccaacagcagcaggtggaagcggcgatcggtctctggaagaggccctcggtgcactgatggccgcactcgatgattataggggacagtttccggaacttcagggcctggagcaggaggtgacaagactggaaagcctcctaatgcagagacagggcctcacccggtcccgcgcatcgtcactttctatcactgttgaacacgcattggagagtttctcattcctcaacgaagatgaggacgaggacaatgatgttccaggggataggcccccttcctcacctgaagccggagctgaagattccattgacagcccgagtgcacgccctttgtccacaggttgcccggcattagacgcggcactggtcagacatttataccactgctccagactgcttctgaaacttgggaccttcgggcctcttcggtgtcaggaggcttgggcactggaaagactccttagggaggcgcgagtgctggaagctgtgtgtgagttcagtcggaggtgggaaataccggcaagcagtgcccaagaggtagtgcagtttagcgcctctcgaccaggctttctgaccttctgggaccaatgcaccgaaaggttgtcgtgcttcctgtgccctgttgagagggtgctgttaactttctgcaaccaatacggagctcgcctctccctgaggcaacccggtctggctgaagcagtttgcgtcaaatttctggaggatgccctggggcagaaactccctaggagacctcagccaggacctggtgaacaactgacagtttttcagttttggtccttcgtggagactctcgactctcccactatggaggcttatgttaccgagacagccgaagaggttctcctcgtgcgaaatctgaattcagatgaccaggcggtagttctgaaggccctgagactggctcccgaaggcagactgagacgggatggcctccgggcactgagttcactccttgtacacgggaacaacaaggtgatggcggctgtgtctactcagctcagatcgctcagtttaggaccaaccttccgggaaagggcgttactctgcttcctcgatcagctggaagacgaggatgtgcagacccgggtggccggttgcctggcactgggctgtatcaaggccccagagggcatagaaccccttgtatatctgtgccagacagatacagaggcagttcgcgaagccgctcgacagtccctgcaacaatgtggtgaagagggccagtccgcccataggcggttggaagagtccctcgacgctctgccgaggattttcggtccaggctctatggcgagtaccgcattctag

SEQ ID NO: 31434 - DNA, 1428 bp, Artificial Sequence
  Description of Artificial Sequence: Synthetic coding sequence
atggatcagatggtccagcatcctgcggctaaaatgatcgtgatggccagtcatatgcaggaacaagaggtaggggatggcaccaacttcgtcttagtatttgctggagctttattggagttggcagaagagttgttacgaattgggctgtcagtgtccgaggtaatcgagggctacgagatagcctgcagaaaagcccacgaaattctgcccaatctagtttgctgctctgccaaaaacctgagggatatcgatgaagtcagctccttgctaagaacatctattatgagtaagcagtacggaaatgaggtgttcctggccaagctgatcgcccaggcatgcgtgagcattttccccgacagtgggcactttaatgtggataacatcagagtgtgtaaaatcctagggtctggtatctccagcagctcagtcctgcatggcatggtgttcaagaaggaaacggaaggtgatgtgactagcgtaaaggacgccaaaatagcagtgtactcttgccccttcgacggcatgataacggagacaaaggggactgtccttatcaagaccgcagaagaactgatgaatttctccaagggagaggaaaacctgatggatgcacaggtgaaggccatagccgacaccggtgcgaacgttgtcgtcacggggggtaaggttgctgacatggccctgcactacgccaacaagtacaacatcatgcttgtacgtctgaactccaagtgggatttaaggaggttatgcaagacagtgggcgctaccgctctgccgaggctcacacctccagtgctcgaggagatgggccactgcgactccgtgtacttgagtgaagtgggggacactcaggtggtcgtcttcaaacatgagaaggaagacggagcaattagcactatcgtgctgagaggatctactgacaatctgatggacgatatcgaaagggcggtggacgacggcgtcaatacctttaaggtgcttactagagataagagactggtccccggtggcggagctacagagatcgagctcgccaaacaaattaccagctatggcgaaacctgccctggtctagaacagtacgccatcaaaaaattcgccgaggctttcgaagccattcctagagctctggctgagaatagcggggtgaaggcaaatgaggtaatcagtaagttgtacgcagtacaccaagaaggcaacaagaacgtgggattggacatcgaggctgaagtgcctgccgtgaaggacatgttagaagccggtattctggatacatacttgggaaagtactgggccatcaagctggccacaaacgcagccgtaaccgtgctgcgcgttgaccagatcatcatggccaaacccgcaggaggaccgaagcccccttcaggcaagaaggactgggacgatgatcagaacgactag

SEQ ID NO: 31435 - DNA, 1626 bp, Artificial Sequence
  Description of Artificial Sequence: Synthetic coding sequence
atgcgagctttattgcacaagccagaaatgataaagcagattttgcccgaacattccgtgctacagaatataaactttgtcgaggccttccaggacgagttactggtgaccgaggtctatgacctaccccaaaggcccaatgacgtacagctgttttacggatcaatgtgtaaaataatacttagcgtcattggagagttcagagattgtatttcatcaagagagttcctgcagccttcctctaaggccagtctcgagagcacctctgacctgggcgcaagcggaaagcacggcggtaacgtgtctctggacgtccttccagtgaagggcccacagggctccccactactgtcccgagcggcacggccacctttggatcaactagcttctgaagagccttggaccgttcttccggaacatctgattctcgtggctcccagcccctgtgacatggctaaaaccggcaggttccagatcgtgaacaattcagtccgactattgagattcgagctttgctggcccgcacactgcctgacggtgacgcctcagcatggttgcgtcgcccctgaatccaaactacagatactcgtgtcgccgaattccagcctatccaccaaacaaagtatgttcccctggtccggcctgatttacatccactgtgatgacggacagaaaaagatcgttaaggtacaaatcagggaagatctcacgcaggtcgagctgttgaccaggctgacaagcaaaccttttggcatccttagtccggtgtccgaaccatctgtaagccatttggttaaacccatgacgaagcccccaagcacaaaggtagagattcgaaataaaagcattacgttccccacaacagagcccggagagacgtctgagtcttgtctggagttagagaaccacggcactacagatgttaaatggcacctgtcttctctggcgccaccatacgtgaagggggtggatgaatctggcgatgtgtttcgggctacatacgcggcatttagatgctcccccattagcggactgctggaatcccatgggatccaaaaggtaagtatcacatttctgcctaggggccgaggcgattacgctcagttctgggacgtggagtgccacccattaaaggagccacacatgaagcacactcttagatttcaactgtccgggcagtcaatcgaggccgagaacgaaccggagaatgcgtgcctctccaccgattctctcataaagattgatcacctcgttaaaccaagacgacaggcggtaagcgaagcaagcgcacgcatccctgagcagttggacgtgacagcaaggggcgtttacgcacccgaagacgtttatcgtttccgtccaacgagcgtgggcgagtctcgtaccctgaaagtgaatctgcggaataattccttcatcacacattccctgaaattcttgtcaccaagagagccgttttacgtgaagcatagcaagtactcgttgcgcgcacagcattacattaacatgccagtccagtttaaaccaaaatctgctgggaaattcgaagcactgctggtaattcaaactgatgagggaaaatcaatcgcaattagactaatcggagaggctctggggaagaactag

SEQ ID NO: 31436 - DNA, 1737 bp, Artificial Sequence
  Description of Artificial Sequence: Synthetic coding sequence
atgagtagcaagggatcttccaccgacggccgaacagaccttgcaaatggcagtctgagtagcagccccgaggagatgtcgggcgcagaagagggtagagagaccagttcaggcattgaggtggaagcttccgacctctcattgtccttgaccggtgacgacgggggacctaacagaacgagcatggaggatactggacactattctattaacgatgaaaaccgcgtacatgataggtccgaggaggaggaagaagaagaggaggaagaggaagaagaacaacccaggagacgtgttcagcgaaagagagcgaaccgggatcaggactccagtgatgacgagcgggctctcgaggactgggtgtctagcgagactagcgcgcttccgcgaccacgatggcaagccttgccggcattaagggagagggagctagggagctccgctaggtttgtgtacgaggcctgtggcgcacgtgtcttcgtgcagcgctttcgactgcagcacgggttagaaggacacacagggtgcgtaaacaccttacacttcaatcagagagggacatggctcgcatctggcagcgatgatctgaaagtggtggtttgggattgggtgagacgtcaacccgtgctggatttcgagtcagggcacaagtccaatgtgttccaggccaagttcctgcctaacagtggggactccacacttgcgatgtgtgccagagatgggcaagtgcgagtcgccgagctcagcgcgacacagtgttgtaaaaatactaagcgagtggcccagcataagggcgcttcacacaagctggcactggaaccggactccccatgtacctttctatcagccggtgaggatgctgtggttttcaccatcgaccttcggcaagatcgccctgctagcaagctggtcgtgactaaagaaaaggagaagaaagttggcctgtatacaatttatgtcaatcctgcaaacacccatcagttcgccgtgggtgggcgagaccaatttgtgcgaatctacgatcagcggaagatcgacgagaacgagaacaatggagtactcaaaaagttctgcccacaccacctggtcaactctgaaagtaaagctaatattacctgtctcgtctatagccatgatggcaccgagctgctcgcatcctacaatgatgaggacatttatttgtttaatagctctcatagtgatggtgcacaatacgtcaagcggtataagggacaccgcaacaatgccacagttaagggtgtgaacttctacggaccaaagagcgaatttgtagtttccggttccgattgtgggcatatcttcctgtgggaaaagtccagctgccagattatccaatttatggagggagacaaaggaggcgttgtgaattgcctggaaccacacccgcacctgcccgtactcgcaacctcgggacttgaccatgatgttaagatctgggctccaactgctgaagcctcaactgagcttacaggcctgaaagatgtcattaaaaaaaacaagcgagagcgggacgaggacagcctgcatcaaacagatttgtttgacagccatatgctgtggtttctgatgcatcatctacggcagcggagacaccaccgcaggtggagggagccgggtgtaggggctactgacgcagatagcgacgagagcccatctagctctgataccagtgatgaggaggagggacctgatcgcgtgcagtgcatgcccagttag

SEQ ID NO: 31437 - DNA, 426 bp, Artificial Sequence
  Description of Artificial Sequence: Synthetic coding sequence
atggggggaaagcctcgacattccctgtatttcataggataccaggacgactttctgctgtatctcgatccccactactgtcaaccgacagtggacgtatctcaagctgactttcctctcgagtcatttcactgtacttccccaagaaagatggcctttgccaagatggatccttcttgtacggtcggattttacgcgggtgatagaaaagagtttgagacactgtgctctgagcttacacgagtgctgagtagtagtagcgctaccgagaggtacccaatgttcaccctagccgagggtcacgcccaggaccattccctcgatgacctctgcagccagttggcccagcctactctgagacttcctagaacaggtaggcttctgagagcgaaacgcccttcgagcgaggacttcgtgtttctgtag

SEQ ID NO: 31438 - DNA, 570 bp, Artificial Sequence
  Description of Artificial Sequence: Synthetic coding sequence
atggtgctgttgcatgttaaaaggggcgacgagtctcagttcctccttcaggcaccgggaagcaccgaacttgaagagttgaccgtccaggtcgcccgagtgtacaacggcaggttgaaagtccagcggctatgtagcgcccctaatgagaagatgaagcaggttctgaaaaaaaccatcgaggaagcaaaagccattatatccaagaaacaagtggaggccggagtgtgcgtgactatggagatggtgaaggatgcactggaccagctgaggggtgccgtcatgatcgtgtatccaatgggcctgcccccatatgatccgattagaatggagttcgaaaacaaggaggacctgagtgggacacaggctggattgaatgtaattaaggaagcagaggcccagttgtggtgggcagctaaggagcttaggcggacaaaaaaattgtccgattacgtgggtaaaaatgagaagacaaagattattgctaagatacaacaggtaagcacattctgttttaacgttagcgttgttttcgtgatatcactgcagactgacaagaacgtgcaatag

SEQ ID NO: 31439 - DNA, 2031 bp, Artificial Sequence
  Description of Artificial Sequence: Synthetic coding sequence
atggcagcgatccagcacggtcacgaagctgtggtcaggctgctgatggagtggggagctgatcccaatcacgccgctcggactgtgggttggtccccacttatgctcgctgcactgactgggaggttgggcgtagcgcaacagcttgtggaaaagggggctaatcctgatcacttgtcagtcctagagaagacagcatttgaggttgcacttgactgtaaacacagagatctggtggactacctggatccgctgactaccgtgaggcctaaaacagacgaagagaagcgtcgccctgacatcttccacgccctaaaaatgggtaattttcaactagtgaaggaaattgccgatgaggacccaagccacgtaaatctggtgaatggtgatggggctacccccctcatgcttgcagctgtgacggggcagctggccctggtgcagctactcgtggagaggcacgccgacgttgataagcaagactctgtacacggttggactgccctgatgcaggcgacctatcacggcaacaaggagatcgtgaagtaccttcttaaccagggcgctgacgtaacactgcgagcaaagaacggctataccgccttcgacctggtcatgctcctgaacgaccccgacactgagttagtcagattgctcgcttcagtttgtatgcaagtgaacaaagacaaaggaaggcccagccatcaaccgcctctgccacacagcaaggtccggcagccctggagcattccagtgctgcccgatgataaaggtggtctcaagagttggtggaaccgcatgtcaaatagatttcgaaaactgaaactgatgcagacactccctcgcggtcttagttcgaaccaaccactccccttttctgatgagccagaaccggcattggactcaacaatgagagccgctccccaggataagaccagcaggagcgctctgcctgacgcagcccctgtgaccaaggataacgggcctgggagcacccggggagaaaaagaggacacattgctcaccacaatgctgagaaacggagctccactcaccagattgcctagcgataagctgaaagcagtgatcccacctttcttgcccccatcctcctttgagctgtggtcaagtgacagaagtcggacccggcataatgggaaagcagatcctatgaaaaccgcacttccacaacgggctagccgtggtcacccagtcgggggagggggtacagatacgacgccagttagaccagtaaaatttccctcactcccccgatcacctgcatcctctgccaatagcggcaactttaaccattccccacatagcagtggcggatcctcgggggtgggcgtatccagacatggcggtgagcttttgaatcggtcaggcggaagcatcgataatgtcctgagtcagattgcggctcagcgcaaaaaagctgcaggactcctggagcagaagccatcacaccggagcagccctgtcgggccagcaccaggatccagcccctccgaattgccggcttctcctgcaggagggagcgctcccgtaggcaagaaactggagacctccaagaggccgcctagcggcaccagcaccacgagcaagtccactagcccaactcttaccccgtcccccagccccaaaggccacacagccgagagctccgtgtccagcagctcatcccacaggcagtctaagtcgtctggcggtagcagtagtggaacaataacagacgaggatgagctaactggaattctgaagaagctgagccttgagaagtatcagcctatattcgaggaacaagaagtcgacatggaggcgtttctgaccttgactgatggtgacttgaaggaactcggtattaaaacagacggctctagacagcagatcttagctgccatctccgagctgaatgcgggaaagggacgcgagcggcagattctccaggaaactatccacaatttccatagtagttttgaatcatcagctagcaatacccgcgcacccggtaattcaccctgtgcatag

SEQ ID NO: 31440 - DNA, 2319 bp, Artificial Sequence
  Description of Artificial Sequence: Synthetic coding sequence
atgagacatcagaagcgcaacgtgtatcactgcaataagtgcagactgcaatttctgttcgctaaggataagattgaacacaaactacagcatcataaaacattccggaaacctaagcagctggagggtctaaagcccggaaccaaggtcactattcgcgcttcccgcggacaacccagaactgtgcctgtttccagtaacgacacccctcccagcgctctgcaggaggctgcaccccttacaagtagtatggaccccctgcccgtgttcctgtatccacctgttcagagaagtatccagaaacgtgccgtaagaaaaatgagcgtgatgggacgccagacatgcctagagtgcagctttgagatccctgatttccctaaccacttcccgacttatgtacattgtagtctatgccgctactcaacttgttgttctagagcatatgcaaaccacatgatcaataatcacgtgcccaggaagtcccctaaataccttgcactgtttaagaactccgtgtcaggcatcaagcttgcctgtacctcatgcacatttgtgactagtgtcggggatgccatggccaagcacctggtgtttaaccccagccaccggagctcctcaatcctcccgcgtgggctcacatggatcgctcactccagacacggccagacacgggatagagtgcacgaccgaaacgtcaaaaacatgtatcccccaccaagttttcccactaacaaagcggctaccgtgaagtctgccggtgcgacccctgccgagccagaagaactgctcacccctcttgccccagcactgccctcacccgcttctaccgctaccccacctccaacccctactcatccacaggcactagccctccccccactcgccaccgaaggcgctgagtgtctgaacgtggatgaccaggacgagggaagccccgtaacccaggaacccgaactcgcttccggcggaggagggagtggcggagttggaaagaaggagcaactgtctgtcaagaaactccgggtcgttctgttcgccttgtgttgcaataccgagcaagcagctgaacattttaggaacccccaaaggcgaattaggcgctggctaagaaggttccaggcctctcagggagagaacttggaggggaaatatctcagcttcgaagctgaggaaaagcttgccgagtgggtactgacccagagggagcaacaactgcccgtgaacgaggagactcttttccagaaggcaactaagataggcagaagcctggaaggaggtttcaagatctcatacgagtgggccgtccgctttatgctgcgccaccatctgaccccccatgccaggagggctgttgcgcataccctgccaaaggatgttgccgaaaacgctggtctgttcatcgactttgtacagcgacagatccataaccaggacctcccgctttcgatgattgtcgccatcgacgaaatttcgctgtttctggacacagaggtactctcaagcgacgacagaaaggagaatgctctccaaacggtcggtaccggtgaaccatggtgcgacgtggttcttgcaatcctggctgatggaacggtgctgcctaccctggtattctaccggggacagatggatcagcctgcgaatatgcccgactcgatcctgctcgaggccaaagagagcggatatagtgacgatgagatcatggagctgtggtcaacacgtgtttggcaaaagcacacagcttgccaacggtccaagggcatgttggtcatggactgccacagaacccacctgagcgaggaagtgcttgcaatgctatcagcctccagcaccttgcctgctgtcgtgcctgcaggctgctctagtaagatccagcctctggatgtctgtatcaaaagaacagttaaaaattttctacacaagaagtggaaagaacaggcaagggaaatggccgacaccgcgtgcgactctgatgtgctccttcagctcgtgctggtgtggctcggagaggtgttgggagttataggggattgtcccgaattggtacaacggtcatttttagtagccagcgtccttcccggtccagacggcaatatcaatagtccaacccggaatgccgacatgcaagaggagctgattgcctctctggaagagcaattgaagttgtctggtgaacacagcgaatccagcacaccacgcccacgcagttctcctgaggagacaatcgagcccgaatcgcttcaccaacttttcgagggcgaatctgagaccgaaagtttttacggattcgaagaagccgacctggacttgatggaaatctag

SEQ ID NO: 31441 - DNA, 285 bp, Artificial Sequence
  Description of Artificial Sequence: Synthetic coding sequence
atggccatgacagccggaactactacaaccttccctatgtcaaaccacaccagagagcgcgtgaccgtcgccaagttgaccctggagaacttttactccaacctgattctgcagcacgaagagagggagacacgtcagaagaagttagaggtagccatggaggaagaggggctcgcggacgaagaaaagaagctgagaagatctcagcatgcccgaaaggaaactgaatttctccgccttaagcggaccaggctcggcttggatgacttcgagtctcttaagtag

SEQ ID NO: 31442 - DNA, 1047 bp, Artificial Sequence
  Description of Artificial Sequence: Synthetic coding sequence
atggggaaggactattataagattctaggtattccatcaggggctaatgaggacgaaatcaagaaagcttatcgcaaaatggcactgaaataccatcccgataagaacaaggaaccgaacgctgaggagaaatttaaggaaatcgccgaagcctatgacgtgctgtccgacccaaagaagcgtggcctgtatgatcagtacggcgaggaaggccttaaaacgggagggggtacaagtgggggaagtagcggtagctttcactacacctttcacggcgatccccatgcaacatttgctagcttctttggcggatctaacccattcgacatttttttcgcgtcctcccgatcgacacgccctttttctggatttgatccagatgatatggacgtagacgaggacgaagaccccttcggtgcttttggcaggtttgggttcaatggcctcagccgcggacccagaagggcaccggaacctctgtaccctcggaggaaggtacaagatccaccggttgtccatgaactgagggtatccctggaggagatctaccatggttccacaaagaggatgaagataactcgcagacgacttaacccagatgggagaacagtgaggacggaagataagatattacacattgtgatcaaaagaggttggaaggaaggcacaaagattacttttcctaaggaaggggatgcaacgcctgacaatattcctgccgatatagtatttgtattgaaggataaaccccatgcccacttccggcgtgacggcaccaatgtgttatacagcgcactgattagtttgaaagaagctctgtgtgggtgtaccgtaaatattccaacaatagatggcagggtaatccctctaccatgcaatgatgtcatcaagcccggaacggtgaaaaggctgcggggagagggtctgcctttcccgaaagtccctacccagaggggggatttgattgttgaatttaaagtgagatttccagatcggcttactccccagacgaggcagattctgaaacagcacctcccatgcagctag

SEQ ID NO: 31443 - DNA, 888 bp, Artificial Sequence
  Description of Artificial Sequence: Synthetic coding sequence
atgcctgtccacacactatctcctggtgccccatccgctccagctctgccatgtaggctcaggactagagttcccggttatctgctgcggggacccgcagacggtggtgcacggaagccaagtgctgtagaacgactcgaagccgacaaagcaaagtacgtgaagtcgctgcatgtagcaaatacccggcaggaaccagtccagcccctcttgtccaaacaacccctgttttcacctgagacacgccgtactgtgctgactccttccagaagggcgttgcctgggccatgtagaaggccacagcttgacctggatattctatcgtcactcatagatttatgcgatagccctgtgtccccagcggaggcgagccggacaccaggccgtgccgaaggagccggacggcctcctccagccactccgcctagaccccctccctctaccagcgccgtccgtcgcgttgatgtgcgccctctgcccgcttcccctgcgagaccctgcccgagtccaggacctgctgctgccagcagtcccgcacgcccaccgggtctgcaacgctctaagtctgatctctccgagaggttttcgagggcggctgcggacttggaaagattttttaatttttgcggactcgaccccgaggaggcccgtgggctgggtgtggcgcatcttgccagggcatcgtcagacattgtatctctggcaggcccatccgcgggtcctggtagctccgagggcggttgttcccgtcgatctagcgtgaccgtcgaggagagagccagagaacgagtgccctatggtgtctcagtggtggagagaaacgcacgggtgatcaagtggctttacgggctccggcaggccagagagagtcccgcagccgaggggtag

SEQ ID NO: 31444 - DNA, 258 bp, Artificial Sequence
  Description of Artificial Sequence: Synthetic coding sequence
atgccatataacgaagccgagaataagcgtagctaccacctctgcgacttatgtgacagaataattattggcgaccgagaatgggcggctcacatcaaatccaagtcgcacctgaatcagctgaaaaaacgtcgacgactggacagcgatgcagtgaataccattgagtcgcagagcgtcagtccagaccacaacaaggagcccaaggagaaaggtagtcctggtcaaaacgatcaggagctcaaatgttccgtgtag

SEQ ID NO: 31445 - DNA, 396 bp, Artificial Sequence
  Description of Artificial Sequence: Synthetic coding sequence
atggccatgactgcagggaccactaccaccttcccaatgtctaatcatacccgggagcgggtgactgtggccaagttgaccctggaaaacttctattcaaatctgatccttcagcacgaagagcgcgagaccagacagaaaaagctggaggtggctatggaggaggaggggttagccgacgaagagaaaaagctccgtcggtctcaacacgccagaaaggagacagagttcctcaggctgaagcggacaaggctgggtctggatgattttgagtccttaaaagtcatcgggaggggcgctttcggcgaggttcggctggtccagaagaaggatacggggcacatttatgctatgaagatcttaaggaagtctgacatgctggagaaagagcagtag

SEQ ID NO: 31446 - DNA, 21 bp, Artificial Sequence
  Description of Artificial Sequence: Synthetic coding sequence
atggcacacgagatgatctag

SEQ ID NO: 31447 - DNA, 2199 bp, Artificial Sequence
  Description of Artificial Sequence: Synthetic coding sequence
atgggattcagagacgaagcagccggatacttccataaagctgtgaaactgaaccccgacttcagcgatgcgaaagagaacttctatcgggtggctaactggctcgtcgaacggtggcattttataatgctgaatgacaccaaacgaaataccatctataacgccgcaatccagaaggccgtctgccttggctccaagtccgtacttgatatcggggctggcaccggcatcctgagcatgttcgcgaagaaggccggagcacacagtgtttacgcctgtgaattgtccaagactatgtatgagttggcgtgcgacgtggttgcggcaaacaaaatggaagctggaatcaaactcctgcacaccaaatccctggatatagaaatcccaaagcacatcccagagagggtgtccctggtagttactgaaactgtcgatgctggcttatttggcgaaggaatcgtggaaagtctgattcacgcatgggaacatctactgctccagccaaaaaccaagggagagtccgctaattgtgagaaatacggcaaagtcatccctgcctctgccgtcatcttcggcatggcagtggagtgtgccgagattcggcgtcaccatcgggtaggcatcaaagatatcgccggaatacatctgcccaccaacgtgaaattccagtctccggcttattctagtgtcgacacagaagagactattgaaccctataccaccgagaagatgtcgcgagtgcccggagggtatttagccctcactgaatgcttcgagatcatgaccgtagatttcaacaatctgcaggagctcaagagcttggctacaaaaaaacccgacaagattgggatcccagtgatcaaggagggaatcctcgatgcgataatggtgtggttcgtactgcaacttgacgacgaacattctctctctacctctccgagcgaggaaacttgctgggagcaagcagtatatcctgttcaggacctcgccgactactggataaaaccaggagaccacgttatgatggaggtgagttgccaggactgttaccttcgcatccagagtatcagcgtattgggtctcgagtgtgagatggatgtggcgaaatccttcacccagaataaagacctgctatctttgggaaatgaggctgagctgtgtagtgcacttgcaaacttacagacctccaagccagacgcagtggagcagacttgcatcctcgagtcaaccgagattgcacttctgaacaatattccctaccacgagggttttaagatggccatgagcaaagtgctgagctccctgacaccagaaaaactgtaccaaactatggacactcactgccaaaatgagatgtcatctgggaccgggcagtcaaataccgtgcagaatattttagaacccttttacgtgctggatgtctctgaaggcttcagtgtgctaccagtaattgccggtactctggggcaagtcaagccatattccagcgtagagaaggatcagcacaggattgccctggatctgattagcgaggcgaatcacttccccaaggagactctagagttttggttacggcacgtagaagatgagtcggccatgctgcagcgtcctaagtcagataaactgtggtcaataataatactcgatgtcatcgaaccgagtggactgatacagcaggagataatggagaaagccgcaatctccagatgtttattacagtcaggcggtaagatcttcccccagtacgtactcatgttcggtttgctcgtcgagtcacagaccttgctcgaggaaaatgcggttcagggtacagagcgaacgctgggtttaaatattgccccattcatcaaccagtttcaagtgcctatcagagtattcctagacctaagtagcctaccatgcattcccctgagcaagccggtggagctgctgcggctcgacctcatgactccctatttgaatacgagtaatagagaggttaaggtatatgtttgcaaatctgggcgactaacggccattcccttctggtaccatatgtacctcgacgaggaaattagattagatacaagctccgaagctagtcactggaagcaggctgcagtagttctcgataatcccatccaggttgagatgggcgaggagctcgtgctctccattcaacatcataagtcaaacgtttctatcaccgtgaaacaatag

SEQ ID NO: 31448 - DNA, 1554 bp, Artificial Sequence
  Description of Artificial Sequence: Synthetic coding sequence
atgtgctccctggcgtccggggcaactggtgggagaggggctgtggagaacgaggaggacctgcccgagctgtcggactccggggatgaggcggcttgggaagatgaggatgatgctgacctgccacacggaaagcaacagaccccttgcttgttctgtaacaggctgtttacttcagcagaagagactttctcccactgtaagtcagaacaccagtttaatatcgactcaatggttcacaaacacggactggagttctacgggtatataaagctgattaatttcattcggctcaaaaatcccacagtggagtacatgaacagtatctataacccagtaccttgggagaaagaggagtatcttaaaccagtccttgaggacgatctgctgcttcaatttgacgtggaggacctctacgagcctgtgtcagtccctttctcatacccaaacggattgtcagaaaatacctccgtggtcgagaaattaaaacacatggaggcaagagctctctcagctgaagctgccctggctagagcccgagaagatctgcagaaaatgaagcaattcgctcaggatttcgtgatgcacaccgacgtacgaacctgttcaagctcaacaagcgtgatagccgaccttcaggaggacgaagacggagtgtattttagctcctatggtcactacggcattcacgaagagatgctaaaagacaagattagaactgaatcttacagagattttatctaccagaacccccacattttcaaggataaggttgtcctggatgtgggctgcggaaccgggatcctttctatgttcgcggcaaaagccggagctaagaaagtgctgggggttgaccaatctgaaatcttgtaccaggctatggacattattcgactgaacaagctcgaagataccataacactgatcaagggtaaaatcgaagaggtacacttacccgtcgagaaggtggacgtcattatctccgagtggatggggtatttcctcctatttgaatccatgctcgatagcgtgctctatgcaaaaaataaatatttggccaagggagggtcagtctacccggacatttgtacgattagtttagtcgcagtcagtgacgtgaataagcacgccgataggattgccttttgggacgacgtctatggatttaagatgtcttgcatgaagaaggctgtgattccagaggccgtggtcgaagtcctcgacccgaagacattgatttccgagccttgtggcattaaacacattgattgccatacgacgtcaatctccgacttggaattctctagcgattttactcttaagatcacacgcacttcaatgtgcacggctatagccggatatttcgacatctactttgagaagaattgtcacaatcgcgtcgtattctctactggaccacaatctactaagactcattggaaacagacagtttttttattggaaaagccttttagtgtgaaggctggggaagccctgaaggggaaagtgacggtccacaaaaataaacgtgaagttctcatcgtcggcatctag

SEQ ID NO: 31449 - DNA, 1560 bp, Artificial Sequence
  Description of Artificial Sequence: Synthetic coding sequence
atggagcaggaaaaatttgatctacagaagcaacataccgaaaatattcaggagctcctggaggatacaaacgtgcgccttaataaaatggaaagcgagtatatggctcagacccagtccactaatcacatgatcaaggaactggaggctcgcgtccaacagctgactggtgaggctgagaattcaaacctgcagcggcagaagctgatccaggagaaagcagaactggaaagatgctatcaaataacatgttcagagctccaagaagtgaaagccaggcgaaatactctgcacaaagagaaagatcatctggtcaacgactacgaacaaaacatgaagttactgcaaactaagtatgatgcagacataaacctcttgaagcaggagcatgccctctctgcctccaaggccagcagtatgattgaagaactggaacaaaacgtctgccaactgaaacagcagcttcaggaatcggaacttcaacgcaagcagcagttgcgggaccaggagaataagttccagatggagaagagtcatctcaaacacatatacgaaaagaaggcacatgacttgcagagtgagctggacaaaggaaaggaggatacgcagaaaaagatccataagttcgaggaagccttgaaagaaaaggaggagcagttaacccgcgtgacagaagtgcagcgattgcaggctcaacaggccgatgcagcacttgaggagtttaaaagacaggttgagctgaactccgaaaaggtgtacgcggagatgaaggaacagatggaaaaagtggaggccgacctgacacggagcaagtccctcagagagaagcaatcaaaagaatttctctggcagctggaagatatcagacagaggtacgaacagcaaatagtggaactgaagttggagcacgagcaggaaaagacccacctattgcagcagcacaacgctgagaaggacagtctggttagagatcacgagcgcgagatcgagaacttggaaaagcagctgagggcagcaaatatggagcacgagaatcaaatccaagaatttaagaagcgagacgcccaagtgatcgccgacatggaggcccaggttcataagctgcgagaggagcttataaatgttaatagtcagcgaaagcagcagcttgtggaattagggctgttaagagaggaggaaaaacaacgcgcaacacgggaacacgaaattgtcgtgaacaagctgaaggcggagagtgaaaagatgaagatagagctgaagaagacacatgccgctgaaacagaaatgacactggagaaagtgctgcaagacgagctcgaaaacaggtctaaccaggtcaggtgtgctgaaaagaaactgcaacataaagagttggaatctcaggagcagattacatacatcagacaggaatatgagaccaagctcaagggacttatgcccgcttccctgagacaggagctggaagatacaataagtagcttgaaatcacaggtgaatttcctccagaagcgtgcgtcaatcctgcaggaggagttgactacataccagggaagaagatag

SEQ ID NO: 31450 - DNA, 1743 bp, Artificial Sequence
  Description of Artificial Sequence: Synthetic coding sequence
atgaataatatacatgtcgaaaatgagtctctcgacaatttccttaaggaaaccaacaaggaaaacttgttggatatactgacagaacccgagaggaaacctgatccaaagctctataccaggtcaaaacccaagactgatagctacaatcagactaaaaactcattggtgcccaagcaggccctggggaaaagctccgttaacagcgccgtgctgaaagaccgcgtcaataaacaattcgtcggtgagacacagagccgcactttcccagtgaaaagccaacagctgtcccgtggcgctgatctggcgaggcctggcgtgaagccgtctcgaaccgtcccctcacatttcatccggacacttagtaaagttcagtcttcaaagaagccggtcgtcaagaatatcaaagacattaaggtcaatcggtcccagtacgagcgacccaatgaaacaaaaattagaagctatcccgtcacggagcagagggtgaagcataccaaaccccgtacatacccttctttgctgcagggggagtataataaccgacatccaaatattaagcaagaccagaagtcctcgcaggtgtgcatcccacagactagctgtgttctgcagaagtccaaagccatttcacagagaccaaatctgactgtcggaagatttaattctgctatacccagcactccttctatcagacccaacgggacatcgggaaacaaacataacaacaacggatttcagcagaaggcccagacactggatagtaaactgaaaaaggcggtgccacagaaccatttcctgaacaaaaccgcaccaaagacccaggcggacgttacgaccgttaatgggacacagactaatcccaatatcaaaaagaaagcaacggctgaggacaggcgaaaacagttggaggagtggcagaagtccaaaggcaagacatataaacgtccaccaatggaactcaagactaagcgcaaggtcattaaagagatgaatatctcattctggaaaagtatcgaaaaagaggaagaggaaaagaaggctcagctagaactcagttctaaaattaataacacattgacggagtgtcttaacctcattgaggggggtgtgcccagtaatgaaatccttaatattctatcgagcatccctgaggccgagaaattcgctaagttctggatctgcaaggccaagctgctggctagcaagggaacatttgacgtgataggattgtacgaggaggcgattaagaacggcgcaacacccattcaggagctccgcaaagtggttctgaacattcttcaagactctaacaggaccactgaggggatcacaagcgactctctcgtggccgaaacttccattacctccgttgaggagctggcaaagaagatggaaagcgtaaaaagctgtctgtctcccaaggagagagaacaggtgacagcaacacccagaattgccaaagccgaacagcacaactatcctggcatcaaattgcagatcgggcctatccccagaataaacggcatgccagaagtacaagatatgaagttcatcacacccgtgaggcggtctagcaggatcgaaagagcggtgagccggtatccagaaatgctccaggagcatgatctcgtggtggccagcttagacgagttgttggaggtggaggagactaaatgcttcatcttccggaggaacgaggcattacctgtgacacttgggtttcagacgccagagtcatag

SEQ ID NO: 31451 - DNA, 705 bp, Artificial Sequence
  Description of Artificial Sequence: Synthetic coding sequence
atgtacatggatctggtcgacggcatctttctcaatcagataatgctgcaaatcgacccgcgaccgaccaatcagagaataaataagcacgtcaacaacgatgttaacctccgcatccagaacctcacaatattggtgaggaacattaaaacatattatcaggaggttcttcagcaattaatcgtgatgaacttacccaacgtactgatgattggccgagaccccctctcaggcaagagtatggaggagattaagaaggtcctgttgctcgtattggggtgcgcagtgcagtgtgagcgcaaagaggagttcatcgagagaattaaacagctggatatagagacccaggcgggaattgttgcacatattcaggaagtcacgcacaaccaggagaatgtctttgacctacagtggctggagctgccagatgtggcccctgaggagctggaggcactttcacgcagcatggtgttgcatctcagacgactgatagaccagagggatgaatgcactgagctaattgtggaccttactcaggaacgggattacctgcaagctcaacatccaccttccccgataaaatcctcaagcgccgactcaactccctctccaacatcatccctgagctcagaagacaagcagcatcttgcagtggaactcgctgataccaaggctaggcttaggagagtgcgacaggagctatag

SEQ ID NO: 31452 - DNA, 1161 bp, Artificial Sequence
  Description of Artificial Sequence: Synthetic coding sequence
atgactgacatacgtaagattaggttgggagagcgcttggtggaagtattttccgccgagaaagtgtacatggtacgcttgagaaacccgctcggacgccaggagtggagtgggccttggtccgagatttccgaggagtggcaacagctcacggcctctgatcggaagaatctggggttggtaatgtcagacgacggagaattttggatgagtttagaagacttttgtcggaacttccacaagctgaatgtttgtcgaaacgtcaacaatcccatctttggtcgaaaggagctggaatccgttctggggtgttggactgtcgatgacgatcctttaatgaatcggtcagggggatgttacaataatagagacacattcctgcagaatccacagtacatattcactgtccctgaagatggccataaggttattatgagtctccagcagaaagatctgcgcacatataggaggatggggcgacctgataactatataatcggattcgagctgttcaaggtggagatgaatcgtaagttccgactgcaccatttgtacatacaagaacgagccggaaccagtacgtacattgacacccgcacagtgttcttgtctaagtatctgaagaagggaaattacgtacttgtccccacgatgtttcagcatgggcgtacatctgaatttctgcttagaatattttccgaggttccagtacaattaagggagttaaccttggatatgcccaagatgtcatgctggaatctcgcccgtggataccccaaggttgttactcaaattacagtgcactctgccgaggacttagaaaaaaagtatgccaacgaaacagtaaacccctacctggtaattaaatgcggcaaggaggaagtgcgttcccccgtgcagaaaaacaccgtccacgctatttttgacacacaagccattttctataggagaacgaccgatatacccattatagtacaagtatggaacagcaggaaattctgcgaccagttcttgggccaggtgaccctggacgcagacccttctgactgcagggatctgaaatctttgtatcttagaaagaagggtggtccaacagctaaagtgaagcagggccacatctcctttaaagttatcagttccgacgatctcactgaactctag

SEQ ID NO: 31453 - DNA, 966 bp, Artificial Sequence
  Description of Artificial Sequence: Synthetic coding sequence
atgacagagctgtccctgcagaaagagcaactgcagttgaagatcattgagatcgaggacgaggcagagaagtggcagaaagagaaagaccggatcaagtctttcacaactaacgagaaggcgatattggagcaaaattttcgagatctcgtacgggatctggagaagcaaaaagaggaagtgcgagcagccctcgagcagcgggaacaggatgcagttgaccaagtgaaggtgatcatggatgctcttgacgaacgcgcaaaagtcctgcacgaggacaagcaaacgagggaacagctgcatagtatctctgattctgtcctgttcctgcaggagttcggggcacttatgtctaactattccctgcctcctcccttacctacttaccacgtcttgctggagggtgaggggctggggcagtccctcggaaacttcaaggatgacctgctgaacgtctgtatgcgccacgtcgaaaagatgtgcaaggccgacttatcccgcaattttatagagcggaatcatatggagaatggcggagatcaccggtatgtgaataactacacgaactctttcggcggagaatggtctgccccagacaccatgaaacgctattccatgtatctcacccctaagggtggagtacgcacaagctatcaaccctcatctcctgggaggttcacaaaggagacaacccagaagaatttcaacaacctctacggcacgaagggcaactacacttcccgcgtctgggaatactcttcctccatccagaactctgataacgacctgcccgtcgttcagggatcaagctcattctccctcaagggatatccatcactaatgcgaagtcaatctcctaaagcacagccccagacatggaagtcgggcaagcaaacaatgctcagtcactatcgtccattttacgtgaacaagggtaatggcattgggtcgaacgaagccccatag

SEQ ID NO: 31454 - DNA, 687 bp, Artificial Sequence
  Description of Artificial Sequence: Synthetic coding sequence
atgtatagacagagattcctctattccctctatagacacactcactgggtgaggtgcgctaagttcagccctgacggaaggctgatagtctcctgctccgaggataagacgattaagatctgggacaccacaaataagcaatgcgtaaacaacttctccgactctgtcggttttgcgaatttcgtagacttcaatccgtcagggacatgtatcgctagcgctgggagcgatcaaactgtaaaggtttgggatgtgcgtgtcaacaagttgctacagcattaccaggtacatagcgggggagtgaactgcatctcttttcatccgtctggcaattatctgataacggcctcttcagatgggacactcaaaatcctggatctactggagggacgactaatttatacgttacagggccacacaggccctgtcttcactgtcagctttagcaagggaggggaactattcgcaagtgggggtgcagatacccaagtgctgttgtggagaactaattttgatgaattgcactgcaaggggctgacaaagcggaacctgaagagactccatttcgattcccctcctcatttacttgatatctacccaaggactccccacccgcacgaagaaaaggtagaaacggtggaagacttcttcttgcacctcctcaggctgatccagagcctgcggtag

SEQ ID NO: 31455 - DNA, 1686 bp, Artificial Sequence
  Description of Artificial Sequence: Synthetic coding sequence
atgagagccgttcgaaggcatctgtttccccagcattctgcccctggcagaggggtcgtgtgggagtggctctcagatgacggctcgtggacggcctacgaagcaagtgtttgtgattacttagaacagcaggtagccagagggaatcagctggtggatctcgctccgctcggctacaattatacagtgaactataccactcatactcagaccaataaaacgtccagcttttgcaggagtgtaagaaggcaggccggacctccctaccccgtgactacaattatagcccctcctggtcacaccggggttgcttgctcctgccatcagtgtctctctggaagccggactggtcccgtgagcggtcggtaccgccacagcatgaccaacctgcccgcataccccgtgccacaacatccgccacatcggactgctagcgtcttcggtacacaccaagccttcgctccttacaataagccgtcgttaagcggagccagaagtgcaccgagacttaatacaactaatgcatggggggctgcccctcctagtctgggcagccagccattatatagaagctccctgtcccacctggggccacaacacctcccacctggatcctcaacaagcggggcagtttccgctagtctgccttccggaccatcatcgagtcccggatccgtgcccgcaaccgttcctatgcagatgcccaaacccagtcgcgtgcagcaggctcttgccggtatgacctcagtacttatgtccgcgatcgggctgcccgtttgtctcagccgcgcacctcagcccaccagcccgcctgccagccggctagcatctaagtcacatggatctgtgaagcgactcaggaagatgtccgttaaaggggctaccccaaaaccggaacccgaacccgaacaggtgattaagaactacaccgaggagcttaaagttcccccagatgaggactgcattatttgtatggagaaactcagtacagcctccggatactcagacgtcacggactcaaaagctatcggtagcctggcggtggggcatttgactaagtgttcacatgcgttccaccttctgtgtcttctggcaatgtactgtaatggcaacaaggatggctccctgcagtgtccctcgtgtaaaacgatatatggggagaaaacaggcacccagcctcaaggtaagatggaggtgttaagatttcagatgtccctgcccggtcacgaggattgtggaactattctgatcgtctattccatcccacatggaattcagggacctgagcacccaaaccctggtaagccctttacggcaaggggtttccctcgccagtgctacctgcctgacaatgcccaaggcaggaaggtgctggaactgttgaaagtggcgtggaagaggcgcctcatttttaccgttgggacctcgtcaactacgggcgagactgatacagtagtctggaatgagatccaccataaaacagagatggatagaaacatcaccggtcatggctacccggaccctaattacttgcagaatgtgctggctgagttagccgcacaaggtgtgaccgaagattgcctggagcagcagcatgcacgcttgtggtggccacccaggtgtccaatggcaggctgggttgcaagacaggaagtcccctcccctaggggatgggaagtgtgctag

SEQ ID NO: 31456 - DNA, 2565 bp, Artificial Sequence
  Description of Artificial Sequence: Synthetic coding sequence
atgaaggtcgaagcctgtacttgggccggatactcaggcctatacgaggcaatcgaatcttgggatttcaaaaaaatcgagaaactcgaggaatataggctgctactcaagagactgcaacctgagttcaagacccgcatcattcctaccgacatcatctcagatctgtccgaatgcctgatcaaccaagagtgcgaagaaatactccaaatttgttctacaaaggggatgatggcaggagccgaaaagttagtggagtgcctgcttcgatccgacaaagagaattggccaaaaaccctgaagctggccctggagaaagaacgaaataagttttctgagctatggatagtagagaagggcatcaaggatgtggagacggaggacctcgaggataaaatggaaacgagtgatatccagattttttatcaagaggaccctgagtgtcagaaccttagcgaaaattcctgtcctccatccgaagttagcgatacgaacctctactcccccttcaaaccgaggaattatcagttagaactggctctaccagccatgaagggcaaaaacacaattatttgtgcccctacaggctgtggaaagacattcgttagtctactcatttgtgagcatcatctaaaaaagttcccacaaggtcagaaggggaaggtggtctttttcgcaaatcaaattcccgtttacgagcagcaaaagagtgtcttcagcaaatattttgaaaggcacgggtatcgggtcacaggcattagtggagccacagctgagaatgtgccagtcgagcagatcgtcgagaacaatgacatcatcattctgactccgcagattctagtgaacaacttgaaaaagggtacaatcccctccctgtccattttcacgctaatgatcttcgatgagtgccacaacacttctaagcagcatccatacaacatgataatgtttaactaccttgaccagaaactcgggggaagttctggaccgcttccccaggttatcggactgactgcttccgtaggtgtcggagacgcaaagaatacagacgaagctctcgattacatctgtaaactgtgcgcatcgttggatgcaagcgtgattgctactgtgaagcataatctggaggaactcgagcaggtggtatataaacctcagaagtttttccgtaaagtggagtctaggatctcggacaaattcaagtacatcattgctcagctgatgcgggataccgagtccctcgccaagaggatctgtaaagacctcgagaatcttagtcagatccagaatagagaattcggaacccagaagtatgaacaatggatcgtcaccgttcaaaaagcatgtatggtgttccagatgcccgacaaggacgaagaatcgcggatttgtaaggccctgtttctgtatacctcccacttacgtaagtataacgatgcattgatcattagcgaacatgcccgaatgaaagacgcattggattatctgaaagatttcttctccaacgtgcgagcagcgggatttgatgaaatcgagcaggacctgacacagcggttcgaggaaaaactgcaagaattggaatctgtttccagggatccgtccaacgaaaaccccaaattggaagatctgtgcttcattctgcaggaagaataccatctgaaccctgagaccatcacgatcctgttcgttaagactagggcattagtagacgcattaaaaaattggatcgaaggcaaccccaagctgtctttcttgaagcccggtatcttgacgggaaggggtaaaacgaaccagaataccgggatgaccctgcctgctcagaaatgcatcctggatgcattcaaggcttcaggtgaccacaacatactaattgccacgtccgtcgcagatgaggggatagatattgcccagtgtaacctggtcattctgtacgaatacgtcggtaatgtcataaaaatgattcaaacacgaggccgaggaagggctcgaggctctaagtgcttcctcctcacatcgaacgccggagtaatcgaaaaagaacaaattaacatgtacaaagaaaaaatgatgaatgatagtatacttagactccagacctgggacgaggcagtgtttagggagaaaatccttcacatacagacccatgaaaagttcatcagggattcccaggagaagcccaagcctgtccccgacaaggaaaataaaaagttattgtgtagaaaatgcaaagcgctggcctgctacacagctgatgtgagagtgatagaggagtgtcattacacggtgctaggagatgctttcaaggagtgctttgtgtcaaggccgcatcctaaaccaaagcaattctcttcctttgagaagcgcgctaagattttttgtgcccgtcaaaactgctctcatgactggggcattcacgtgaagtacaagacctttgagatcccagtcataaaaatcgagagctttgtcgtagaggatatagcaactggagtccagacactctattccaaatggaaggactttcacttcgagaagatcccgttcgacccagcagagatgagcaaatag

SEQ ID NO: 31457 - DNA, 813 bp, Artificial Sequence
  Description of Artificial Sequence: Synthetic coding sequence
atgcagatcgagcatataattgaaaatatcgtggctgtaaccaaggggctcagtgaaaagttgccagagaagtgggagagtgtgaagttacttttcgtcaaaactgaaaagagtgccgctctgcccatcttttcttcattcgtctcaaactgggacgaagcaacaaagcgatcactgttgaataaaaagaagaaggaggctaggaggaagaggcgggagagaaatttcgagaagcaaaaggagcggaagaagaagcgacagcaggctagaaaaacagcctccgtgctgtccaaagacgatgtggctcctgagagcggcgatacaaccgtaaaaaagcccgaaagtaagaaagaacagaccccagagcacggcaagaaaaagcggggaagaggcaaggctcaggtgaaagccaccaatgagtctgaagacgagatcccccaactggtccctattggaaagaagacaccagcaaatgaaaaagttgagattcaaaagcatgccaccgggaagaagtctcctgcaaaatcacccaacccatctactccgaggggtaagaagcgcaaagccctgcctgcaagtgagacaccaaaggccgcagagtccgagacgccgggaaagtcaccggagaagaaacctaagattaaagaggaggccgtcaaggaaaagtctccttccctgggcaagaaggacgccaggcagacacccaagaaacccgaggccaaattctttactaccccctcgaaatccgtgagaaaggccagccacactcctaagaagtggcccaaaaagccaaaggttccccagtcaacgtag

SEQ ID NO: 31458 - DNA, 1059 bp, Artificial Sequence
  Description of Artificial Sequence: Synthetic coding sequence
atgtcctctagaaagcttagcgggcctaagggtcggcgtctctcaatccatgttgtgacttggaacgtggcctctgccgcaccccctctagacttgtccgacctgctgcaactgaacaatcgtaatctgaacctcgatatatatgtgattggtcttcaggaactgaatagtggaatcatcagcctcctttctgatgccgcttttaatgacagttggtcatcatttctgatggacgtcctttcaccactgtctttcattaaggtctcccacgtgcgtatgcagggtattctgctgctggtgtttgctaagtatcagcaccttccctacattcagatcctctctactaagtctacgccaactggcttgtttgggtactggcttagtattgccaagaagcacgatccactgttgagggaatttcaggagggcaggcttcttttcccaccaacatacaagttcgaccgtaatagcaatgactacgatactagcgagaagaagcgaaagcccgcatggaccgaccgcatcctttggagactcaaacggcagccctgcgccggacctgacactcccatccctcccgcaagccacttttctctgtccctaaggggctatagttcgcacatgacatacggcatcagtgaccataaacccgtgtccggcactttcgacctggaactcaagccgttggtctcagcaccactcatagtactgatgcccgaggacctttggacagtggaaaacgacatgatggtatcatatagcagcaccagtgattttccctcgagcccctgggactggattggcctgtacaaagtcggtttgcgggacgttaatgactatgtcagctacgcatgggttggggactctaaggtgagctgctcagacaacctcaaccaggtttacatagatatatccaacattcctacaacggaggatgaatttctgctctgttactattcaaatagtttaaggtccgtcgtgggcatcagtaggcccttccagatcccccctggtagtctgcgcgaggatcccctgggtgaagctcaaccccagatttag

SEQ ID NO: 31459 - DNA, 375 bp, Artificial Sequence
  Description of Artificial Sequence: Synthetic coding sequence
atgaccggatcatgttgtggttccacctttagcagtctgtcttatggcggaggatgctgtcagccatgttgttgcagagatccgtgctgctgccgcccagtgacatgtcagacgaccgtgtgtcggcctgttacatgcgtgcctcggtgtacacggccaatttgtgaaccatgtcgtcgtccagtgtgctgcgacccctgctcgttgcaggagggttgctgtaggccaattacttgttgcccctccagctgcacggcagttgtgtgcagaccttgctgctgggcaacgacttgttgtcagccacccgtcagtgtgcagtcgccttgtggccagcctaccccttgcagcacaacctgtcgcaccagcagttgttag

SEQ ID NO: 31460 - DNA, 927 bp, Artificial Sequence
  Description of Artificial Sequence: Synthetic coding sequence
atgaaacgtgcacatccagagtatagctcgtccgatagcgagctggacgagacaatagaagtggaaaaagagagcgcagacgagaatggaaacctgagttccgccctcgggagcatgtcgcctaccacatctagtcagatcctggcaagaaaaagacggagaggaatcattgaaaagcgcagacgcgaccgcatcaataattcactcagcgagctccgcagactggtgccaagcgcattcgagaagcaggtgatggaacagggatctgccaaactggaaaaagcggagatcctgcaaatgaccgttgaccacctgaaaatgcttcacaccgcaggcggaaaaggatacttcgacgcccacgcgctcgccatggactaccggagtcttggatttcgcgaatgccttgccgaggtggcccgatacctcagcatcatcgagggcctcgacgcctccgaccctctcagagtgaggctggtgtcccacttaaacaattatgcatctcagcgggaagctgctagtggagcacacgctggcctaggtcacattccatgggggacagtattcggccatcatcctcacatagcacacccactgctgctgccccagaatggccacggcaacgctggtaccaccgcaagccctaccgaacctcaccaccaggggcgtttgggaagcgcacatcccgaagccccagctctccgcgctcctccctctggcagccttggaccggttctgcctgttgtgacaagtgcctctaaactgagccctcctctgttgtcctcagtcgcctccttgtccgcctttccgttttcttttggaagctttcacctgctctcccctaatgccttgtctccttcagccccaacccaggccgcaaatctggggaaaccctaccgtccatggggcaccgagataggagccttctag

SEQ ID NO: 31461 - DNA, 2943 bp, Artificial Sequence
  Description of Artificial Sequence: Synthetic coding sequence
atgacagagggaaggcactgtcaggtccacctgttggatgataggagacttgagttgttagttcagcctaaattgctggcacgtgaacttctggacttggtggcttcacattttaatttgaaagaaaaagagtacttcgggattacctttatcgatgacaccggacagcagaactggctgcagttggaccaccgggtgctggaccatgatctgcctaaaaagccaggccctaccatcttacacttcgccgtgaggttttacatcgaaagcatatcatttctcaaggacaagaccaccgttgagctgtttttcctcaacgccaaagcttgcgtgcacaaggggcagatagaagtggagagcgagacaattttcaaacttgccgctttcattttgcagtcgccaaaggtgagcctcactcacgatgagaatgcacggaaagacttgaaaaccctgcctgcgttcccaaccaaaacactgcaggaacaccctagtctagcatactgtgaagaccgggtgattgaacactacctcaaaatcaaggggctgaccagggggcaggccgttgtccagtacatgaagatcgtggaggcccttcctacttatggcgtgcattattatgcagttaaagacaagcagggcctgccctggtggctaggtatctcatacaagggtatcggacagtacgacatacaggataaagtgaaacccagaaagctgtttcagtggaaacagttggaaaacttatatttcagggaaaaaaagtttgccgttgaagtgcacgatcctaggcggatcagtgtatcccggaggactttcggtcagtcagggctgttcgttcaaacctggtacgccaattctagcctgataaaaagcatctgggtgatggcaattagccagcatcaattctaccttgacagaaagcagtccaaggccaaaataccctctgctcgctcactggatgagattgctatggatctgactgagacagggacccagcgggcatcgaaactcgtaacactggagactaagtcacaattcatcatggcgtcgaatggtagtttaatctcctcaggttcgcaagacagtgaggttagcgaggagcagaagcgggagaaaatactcgaactcaagaagaaggagaaactgcttcaggaaaagctgctgaagaaagttgaagagctgaagaagatatgtcttcgcgaagctgaactgactggaaagatgccgaaggagtaccctctcaatatcggggaaaagccaccccaggttagacggagagtgggcaccgcgtttaagctggacgacaacctgctgccctcagaagaggatcctgcactgcaggaattggagagcaactttctcatccagcagaaactggtggaggccgcaaagaagctggctaacgagccagatctgtgcaagactgtcaagaaaaagcggaagcaagactacaccgatgcaatgaagaagctacaagagattgaaaacgcgatcaacgagtataggatccgctgtggaaaaaaacccagtcagaaggctaccgttcttcctgaagacattataccgagcgaaagcagcagtctgtccgatacaacaacgtatgacgacccttctgatgcttttacatttcctgggcagaggagcagttctgtgcctcacagtcctaggattctgcctcccaaatccctcggcatcgagcgtattcattttcggaaatccagcattaatgaacagttcgtcgatacacggcagagcagagagatgctctccactcacagcagcccatataagacgttggagcgcaggccccaaggcggaagaagtatgcccacgaccccagtattgacaagaaacgcttactcttccagtcatctggaacctgaatcttcttctcagcactgcaggcagcgttctggctccctggaatcacagagccacctgctgagtgaaatggacagtgacaagccttttttctctctctccaagagccagagatcatccagtaccgagatcctggacgatggctcctcctatacaagccagagctctacagagtactattgcgtcactccagtcactggcccatactatacgacccagaccctggatactcgaacccggggaagacggcgtagtaagaagcagaacgtgtccacttccaacagtggatctatgcccaacctagcccagaaagacagccttaggaatggagtttattcgaagagccaggagcctccatcctcaagctattacatcgcaggttacacaccttatgcggaatgtgacttctactattctggaggctacgtgtacgagaacgacacggaaggccagtattcagtaaatccaagctatcggtcctctgcccattacgggtacgagcgccagagggactacagtagatcattccacgaggacgaggtggaccgggtcccacataatccatatgccacactaaggttgccccgaaaggctgctgctaaatcagagcacattacaaagaacattcacaaagctcttgtcgcagaacacctgcgaggctggtatcaacgcgctagcggccagaaagaccagggtcattcaccgcagacgtcattcgactcagaccggggatcccagcggtgcctggggtttgccggacttcaggtaccctgtagtcctagctcaagagctagttcctattcaagcgtcagctcaaccaacgccagcgggaattggcgcactcagctgaccattggtctgtcagattacgaaacccctgcccacagtagctacactagttgttatggaaacgtctacaaccctctcccctctccttccagacagtacacagaaattagtcagctggacggcaccgacggcaatcaactagaggacaatctggagtcatcggagcagcggcttttctggcatgaggactctaagcccggaactctcgtgtag

SEQ ID NO: 31462 - DNA, 2979 bp, Artificial Sequence
  Description of Artificial Sequence: Synthetic coding sequence
atgtacggcagcgcccgaagtgtaggcaaagttgaaccttccagtcagtctcccggtaggtctcccagactccctaggtcacccagattaggacatcggagaaccaattccacaggaggctccagcgggtcctcagtggggggtgggtccgggaagaccttgagtatggagaacattcagtctctgaatgcagcatacgccacctccggccctatgtatctatccgatcacgagaatgttggaagcgagacgcctaagagtacaatgacgctcgggcgaagtgggggtaggctaccctatggggtccgaatgacggctatgggcagttctcctaacatcgcctctagcggcgtggcctccgatacaatcgctttcggcgagcatcatctgcccccagtatctatggcttcaaccgtcccgcattccctgcgccaagcacgggataataccatcatggacctgcagactcaattgaaggaggtccttcgggagaacgacttactgaggaaagatgttgaggttaaggagagcaagctgagcagtagtatgaacagtatcaagacgttttggtcgccagagctcaagaaggagcgggcactcaggaaggatgaggccagcaagatcaccatttggaaggaacagtaccgagtcgtgcaggaggagaatcaacacatgcaaatgaccatccaagctctccaggatgagctacgaatccagagagacctcaatcagttatttcagcaggactcctccagccgaacaggcgagccatgtgtggcggaactcacagaggagaacttccagagactccacgccgaacacgaacgccaagcaaaagagctgtttctgctcagaaaaaccctggaggaaatggagctgcggattgaaacccagaagcagacactcaacgccagggatgaatccataaagaagttgctggagatgctgcagtctaagggactatccgcaaaggccacagaggaggatcacgagagaaccaggcgactggctgaggccgaaatgcacgttcaccatctggagagtctgctagaacagaaggaaaaagagaatagcatgctgcgagaggagatgcacaggcggttcgaaaatgccccagatagcgccaagactaaggcactgcagacagtgatcgagatgaaagattcaaaaatttcttccatggagagggggctgcgggatttagaggaggaaattcaaatgttaaaatctaacggagcactgtcaacagaggagcgggaagaagagatgaagcagatggaggtatataggagccacagcaagttcatgaagaataaaatcggacaagttaagcaggaattatcacgaaaagacacagagcttctggccttgcaaacaaagctagagaccctcactaaccagttcagtgattcgaagcagcatatagaagtcttgaaggagagtctgactgctaaagagcagcgagcagctatactgcagacagaggttgatgctctgcgattacgacttgaagagaaagagactatgctgaacaagaagacaaagcagatccaggacatggctgaagagaaaggtacacaggctggcgagattcacgacctcaaggatatgcttgacgttaaggagagaaaggtgaatgttctccagaagaaaatagagaatctgcaggaacaactgcgtgacaaggagaagcaaatgagttcattgaaagagagagttaaaagtttgcaagccgacaccactaataccgacactgctctaaccaccctggaagaagctttggctgagaaagagaggaccattgagcggcttaaggaacaacgcgaccgcgatgagagagagaagcaggaggagatcgataactataagaaggacctgaaagacctaaaagagaaagtctcactgctgcagggagacttgtctgaaaaggaggcctcccttctggatttgaaggagcacgcatcatcactggcatcttcaggcctgaagaaggactctcgacttaagacactcgaaattgccctggagcagaagaaggaagagtgtctcaagatggaatcccagctgaaaaaggctcacgaagcggcactggaagcacgcgcaagccccgaaatgtccgaccgaatccaacatctggagagagagataactcggtataaagacgaaagctcaaaagctcaggccgaagtagacagactccttgaaatcctgaaagaagttgaaaatgaaaaaaatgacaaagataaaaaaattgccgaactggagagcctgacctccagacaagtaaaggaccaaaacaagaaggtggcgaacctcaagcataaggaacaggtagagaaaaagaagagcgcgcagatgctggaagaagcccgaagacgcgaggataacctgaatgattcttcacagcaactgcaggactcactgcggaagaaggatgatagaatagaagagctggaggaagcccttcgcgagtcagtgcagatcactgccgaaagagagatggttctggcccaggaagaaagtgcgagaactaacgcggaaaaacaggtcgaagagctgctgatggcaatggagaaggtgaagcaggaactggaatcgatgaaagccaagctgtcgagtacccagcaatcactcgcagagaaagaaacccacctcacaaacctcagagctgagcgcagaaagcatctcgaagaggtcctggagatgaaacaggaggctctgttggcagctatttccgaaaaagatgccaatatcgccttactagaactgagctccagtaaaaaaaagactcaagaggaagtggcagcgctcaaaagggaaaaagacagactcgtccagcagctgaaacagcagacccaaaaccggatgaagctaatggctgataactatgaagatgaccacttcaagtcatctcactcgaaccaaacgaaccataagcctagccccgatcaggacgaggaggaaggcatctgggcttag

SEQ ID NO: 31463 - DNA, 3138 bp, Artificial Sequence
  Description of Artificial Sequence: Synthetic coding sequence
atgctgactgtgcaagtgaagacctcaagcgcaattgagctacctgacagcctggccttcctgtggattatcccaatgtggtactgcgaaggaaaggaattggaaaattctccagacattcacattgtacaggccggaaatcttcattccctgactattgcggaggcgtttgaggaggatacaggcagatatagttgcttcgccagcaacatatatggaacagactcgacttccgctgaaatctacattgagggcgtaagcagcagtgactctgaaggggaccccaataaagaggagatgaatagaatccagaagccgaatgaggtctcaagcccaccaacaacgtcagcggtgatacccccagcagtgcctcaggcgcaacatctggttgctcagcctcgggttgccaccatccagcagtgccagagcccaacaaattatttgcagggtctggatgggaaacctatcatcgctgcgcctgtctttacaaaaatgctgcagaacctgtctgcctctgagggacagcttgttgtcttcgaatgccgtgtgaagggggctccatcgcctaaagtggagtggtaccgcgaggggactttgatcgaagactcacctgacttccgcattctgcagaagcgaccagtgtgtatggagcacatagaagagatttgtacactggtgatcgcagaggttttcgccgaggactcgggctgtttcacctgcaccgcctctaataaatacggtactgtttctagcatcgcacagcttcacgttcgtggaaacgaggacctgtctaataatggcagcctgcatagcgctaatagtactaccaacctggcggcaattgagccgcaaccttcacctccacattcggaaccgccatcagttgaacagcctcctaaacccaagctggaaggcgtcctggtgaatcataatgagcccagatcctcaagtagaataggtctgcgggtacactttaacctgccggaggatgacaaaggctcagaagcctcttcggaggcgggagtggtgacgacacgtcaaaccaggcctgatagtttccaggaacggttcaatggtcaagcaactaagacccccgagccgtcaagccctgttaaggaacccccaccagtactggccaaacccaaactggactccacccagcttcagcagctccataatcaggtattactggaacagcatcagctgcagaatcctccgccttcaagcccaaaagaatttcccttctccatgactgttctgaacagcaatgcccctccagccgttaccacctctagcaaacaggtcaaagccccaagttctcagacattctctttggctaggcctaagtatttttttccatctactaacactaccgcagctacggtcgcaccctcttcatctcctgtgtttaccctgtctagcactccacagactattcagcggacggtaagcaaggagtctctgctggtttctcacccctcagtccagaccaagagtcctggtggcctatctatccagaacgagcctcttcctcctggcccaacggaaccgaccccaccccctttcactttctcaatccccagtggcaaccagttccagcccaggtgcgtcagtcccatccctgtgtctcctacaagtcggattcagaaccctgtagcttttctatcttccgtcctgccctccctacctgctattccacccactaacgccatggggcttcccagaagcgctccttcgatgccaagccagggactggccaagaaaaatacaaagtctccccagccagtcaatgatgataacatccgagaaactaaaaacgcggtcataagggacctcggaaagaagataaccttcagcgacgtcaggccaaatcagcaggagtacaaaatatccagtttcgagcagagattaatgaatgaaatcgagttcaggctggaacgcaccccggtcgatgagtccgacgacgaaattcagcacgacgagattcccacaggcaaatgcattgcacctatctttgataagcgtctgaagcatttccgggtcacagaggggtcacctgtgacctttacttgcaagatcgtgggcattcccgtgccgaaagtgtactggtttaaagacggaaagcagatcagcaaacgcaacgagcattgtaaaatgcgcagagaaggagacggcacctgctctttgcatatagaaagtactacttcagacgacgatggcaattataccattatggcagccaatccacaaggcagaatcagctgctccggccatctgatggttcagtccctgcctattcgctcaagactgacgagtgccggtcagtcacaccggggacggtctcgtgtgcaggagagagacaaggagccactccaagaacgcttcttcaggccccactttctgcaggcccctggcgacatggttgctcatgaaggccgactctgccgcctcgattgtaaggtgtcaggcctccctccaccggagttaacttggctcctgaacgggcagcccgtgctgccagatgcgtcacataaaatgctggtgagggaaacgggggtgcactccctgctcatcgaccccctcacgcaacgagacgcaggcacttacaaatgcattgcgaccaacaaaaccggccagaacagcttttctttagagttaagcgtcgtcgctaaggaggttaaaaaggcccctgtgatactcgaaaagctgcagaactgcggcgttcctgaaggtcatccagtacgtctagaatgtcgtgtgatcggtatgccccctccagttttctattggaaaaaagacaacgagactatcccatgcactcgtgagcgcattagtatgcaccaggatacaacagggtatgcctgcctgctaattcagcctgccaaaaagagcgatgcgggatggtatactttatctgctaaaaacgaggccggtatcgtcagttgcacggcccgactcgacatttacgcccagtggcatcatcagattcccccacctatgtctgtgagaccaagtggctcacgatatggctctctgacctccaaaggactggacatcttttcggccttcagcagcatggaatccaccatggtctattcatgttctagcagatccgtggtcgaatcagatgaactttag

SEQ ID NO: 31464 - DNA, 72 bp, Artificial Sequence
  Description of Artificial Sequence: Synthetic coding sequence
gtgcgactggcctggggtttcgtgagcgctttaggctcattccacacggctgacccagaaggggctgcctag

SEQ ID NO: 31465 - DNA, 1608 bp, Artificial Sequence
  Description of Artificial Sequence: Synthetic coding sequence
atggaggcccctaccgtggagacacctcccgatccctctcccccatccgctcccgctcccgcattggtgcctttgcgcgcaccagacgtagctagactgcgggaggaacaggagaaagtcgtcacaaactgccaagagcggatccagcactggaaaaaagttgataacgattataatgctctgcgcgagcggcttagcaccctgcctgataagctctcttataatatcatggtgccttttggaccttttgcctttatgcccggtaagcttgtacacactaacgaagtgacagtattacttggcgataactggttcgccaagtgctcagctaagcaggccgtgggccttgttgaacaccgtaaggaacacgttcgcaaaactatcgacgacctcaagaaggtgatgaaaaacttcgagtctcgcgtggaatttactgaggatcttcagaaaatgtctgatgccgctggtgacatcgtggacatacgggaggaaattaagtgtgattttgagttcaaagcaaaacatcgcatcgcccacaagccccatagtaagccgaagacgtccgatatatttgaggccgacatcgctaatgatgtgaagtctaaagacctgctggccgacaaggagctgtgggcaaggctggaagagctggaacgccaggaggagcttctcggcgaactagatagtaaacctgacactgtgattgccaatggagaggatactactagcagtgaggaagagaaggaggaccgaaacactaacgtgaatgctatgcaccaggtaacagattctcatactccctgtcacaaagacgtggcctcatctgaaccctttagcggtcaggtaaatagccaactcaattgctccgttaacggatcatctagttaccacagcgatgatgatgacgacgatgacgatgacgacgacgacgataatatcgacgacgacgatggcgacaacgatcatgaagctttgggagtgggtgataacagcatcccgaccatttatttctcacacaccgtggaaccaaagcgagtcagaataaacaccggcaagaacacaacgctgaagtttagcgaaaagaaagaggaagctaaaagaaaacggaaaaattcaacaggatctggacactctgctcaggagctccccactatcagaaccccagccgatatataccgggctttcgtagacgttgttaacggagagtatgtgccgagaaaatccatcctgaagagccgcagccgggagaacagtgtttgctctgacacctctgagagttccgccgctgaatttgatgatcggcgtggagtgcttcgcagtatctcatgtgaagaagcaacatgttctgacacctccgagtccattctggaggaggagccccaggaaaaccagaagaagctactcccactctccgtaactccagaagcattttccgggaccgttatcgagaaagagttcgtgtccccatccctcactcctccacccgcaatcgcgcatcccgctctcccaaccatacctgagagaaaagaggtactgttggaggcctcagaagaaacaggcaagcgggtgtctaagttcaaggccgcacggctacagcaaaaggactag

SEQ ID NO: 31466 - DNA, 1731 bp, Artificial Sequence
  Description of Artificial Sequence: Synthetic coding sequence
atggaagggctgcgcagaagacgcggaagagaagccggtcctcctcagcccatggttccgctagcggttgagaaccaggcagggggagagggagccggaggagaattggggatctccctgaatatgtgtctgctgggagctttggtcctcctggggctgggcgtccttttgttttccggcggactgtcagaaagtgagaccggcccaatggaggaggttgagaggcaggtgttacccgatccagaggttttagaagcagtaggagaccgacaggacggcctcagggaacagcttcaagccccagtgcccccagattctgtgcctagcctgcagaacatgggcttgctgctcgacaagctggctaaggagaaccaagacatccgcctgttacaggcacaactgcaagctcagaaggaggagctgcaatcactcatgcaccaacctaaaggactggaagaggaaaacgcacagctccgcggagctctccaacagggagaggcattccagagagctctggagagtgaattgcaacagcttcgggctagactgcagggccttgaggccgattgcgttagggggccagacggcgtatgcttaagcggaggccgagggccacagggagacaaggctatccgggagcagggtcccagagagcaagagcccgagctgtcattcctgaaacaaaaggaacagctggaggctgaagcccaggcactgagacaagaacttgagcgacagaggcgcttgttggggtccgttcagcaggacctcgaaagatccctgcaagacgcgagtaggggagatcccgctcacgctgggctggccgaactcggccacagactggctcagaagctccaggggcttgagaattggggacaggacccaggcgtgagtgcgaacgcatcaaaggcctggcatcagaagagccatttccagaactctagagaatggtctggaaaagaaaagtggtgggatggacaacgtgacagaaaggccgagcactggaaacacaagaaggaggagtcagggagagagaggaagaaaaattggggcggtcaggaagacagggagcccgctggcagatggaaggaaggcagacctagggtcgaagaaagcgggagcaaaaaggaagggaagcgccagggtccaaaagaacctccgagaaaatctgggagctttcattcctctggagaaaagcagaagcagccacggtggagagagggtaccaaggattctcatgaccccctgccctcgtgggcggaacttctgaggcctaagtatagagctcctcagggatgctcaggggtggacgagtgcgcaagacaggagggtctcacgttctttggcacagagctagcaccagtgcgccagcaagaacttgcctcccttctgcggacatacctggcgaggttaccctgggcaggacaactcaccaaggagctgccgttgtccccagcttttttcggcgaggacggcatctttcgccatgatagactgcggtttagggacttcgtagacgcgcttgaggacagtctggaggaagtcgcggtccaacagaccggcgacgatgacgaggtcgacgactttgaagatttcatctttagccactttttcggggacaaagcgctcaagaagcggtcaggaaaaaaggataagcatagccagtccccacgagccgcaggccctagggagggccactctcactcacaccatcaccatcacaggggatag

SEQ ID NO: 31467 - DNA, 2244 bp, Artificial Sequence
  Description of Artificial Sequence: Synthetic coding sequence
atggctaagtataacactgggggaaaccctacggaggacgttagcgtcaacagtcgtccctttcgggtaaccggccctaattcttcctctgggattcaggcacgaaaaaatctattcaacaaccagggaaacgcctctcctccagccggacctagcaatgtgcctaagttcggaagtccgaaacctccagtagcagtcaagcccagcagcgaggagaagccagataaagagcctaagcccccattcctgaagcccacaggtgccggtcagcgttttggtactccagcaagcttgaccacccgtgatcctgaagccaaagttgggttcctgaagcctgtgggtccaaaaccaatcaaccttcctaaggaggactctaaacccacgttcccttggcccccaggtaataaaccatcgctccatagcgtaaatcaggaccacgatctcaagccgcttgggcctaaaagcggaccaacccctcccacaagcgaaaacgagcagaaacaggccttccctaaactcaccggcgtgaagggcaagttcatgtccgctagccaagaccttgaaccaaaacccctgttccctaaacctgcctttgggcagaaaccaccgctatcaactgagaatagccacgaggatgagtctcctatgaaaaatgtaagtagctctaagggaagcccagctccgcttggagtgcggagcaaatctgggcctctcaagcccgctagggaagattccgagaataaggaccatgctggagagatatcctccctgccttttcctggggtggttcttaagcccgcagcttccagaggcggacccggacttagcaagaatggagaagagaaaaaggaggatcggaaaatcgacgccgcaaaaaatactttccagtccaagatcaatcaagaagagcttgcctcgggaacgcctccagctcggtttcccaaggcccctagtaaactgactgtcggaggaccgtggggacagtcccaggaaaaagagaaaggagacaaaaatagcgctaccccgaagcagaagccattgccccctctgtttacgctcggcccacccccacctaagccaaaccgcccacccaacgtggatctcactaagtttcacaaaacctcttccgggaatagcaccagtaagggccagacaagttactcaacgacttctcttcctccccctcccccatcccaccccgcatcccagcccccactgcccgcaagtcatccatcgcaacctcctgtgccttccttgccccctcggaatataaaacctccgttcgatctaaagtccccggtgaacgaggacaatcaggacggcgtcactcactctgacgttgtgattccattagaccacgagcaagattccgaaggagagacgtacgaagatattgaggcctcaaaggaacgcgagaaaaaaagagagaaagaggagaagaaaagattggaactggagaaaaaagagcagaaggagaaggaaaaaaaggagcaagagataaagaagaaatttaaattaaccggccctattcaggtgatacacctggctaaggcctgttgcgacgtgaagggagggaaaaatgagctgagtttcaagcagggggagcagatcgaaatcatccgcattaccgataacccggaaggcaagtggctgggtaggacggctcgagggtcctacggctacatcaaaaccaccgctgtcgagatagattatgactccttgaagcttaagaaggatagcctgggtgcaccatcacgccctatcgaggacgaccaagaggtgtatgacgatgtcgctgagcaagatgacatttccagtcacagccagagcgggagcgggggtatcttcccccctcccccagatgacgatatttacgacggcatcgaagaggaagatgccgacgacgggagcacactgcaggtgcaggaaaaaagcaatacgtggagctggggtatccttaaaatgctgaaggggaaagacgatcgcaagaaaagcatcagagaaaagcccaaggtgagcgacagcgacaacaacgaggggtcatccttccccgcaccacctaaacaactcgacatgggcgacgaggtatacgacgatgtagatacctccgatttccctgtgtcctcagctgaaatgtcacagggcaccaacgtcgggaaggcaaaaactgaggaaaaagacctcaaaaaattgaagaaacaggaaaaagaggagaaggactttcgcaagaagtttaaaaagtag

SEQ ID NO: 31468 - DNA, 1566 bp, Artificial Sequence
  Description of Artificial Sequence: Synthetic coding sequence
atgacctcagcttttaaactggattttctgccagacatgatggtggaaggtcgcttgttggtgccggatcgcattaacgggactgcaaataagatgaacggggcattggatcattctgaccagccagaccctgacgcgataaaaatgttcgtcggacagatacctcgttcctggagcgagaaagaactgaaggaactgttcgaaccctacggggcagtctaccagattaacgtattgagagatagatcccagaatccccctcagagcaaaggttgttgttttgtaaccttttacacccgcaaagccgctcttgaagctcagaatgctctccataatatcaaaaccttgcccggaatgcaccaccccattcagatgaagccagccgatagtgaaaagtctaatgccgtggaggatcgcaaacttttcatcgggatggtgtccaaaaaatgcaacgagaacgacatcagggtcatgttcagtcccttcggtcaaatcgaagaatgcagaatcttgcggggtccagacggtttgagccgcggatgtgccttcgttaccttctcaacaagggccatggcacaaaacgccatcaaggctatgcaccagagccagactatggaaggatgcagcagccccattgtagttaagtttgctgacacccagaaagataaggagcagcggagactccagcagcagttggcccagcagatgcagcaactcaataccgctacctgggggaatctgacagggctcggaggtctgactccacagtacttggccctgctgcaacaggccacctcctccagcaatctgggagctttttctggaatacagcagatggctggaatgaacgcacttcagctgcagaatctggcaacgctcgctgccgcagctgcagctgcgcaaacttctgccacatccaccaatgccaatccattgtccactacaagttccgctctaggggctttaacgtcacctgtcgcagcgagcactcctaactctacagcgggagctgcaatgaactccctgactagcctgggcaccctgcaaggtctagccggagctacagtcggacttaataatattaatgctctcgccgtcgcgcagatgctctcaggaatggctgcactgaacggagggctgggcgctacggggctgactaatggaacggcgggtaccatggatgccttgacacaggcttatagcggcattcagcaatacgccgcagccgcacttcctacactttactcacagtctcttctccagcagcagtcggccgcaggaagccagaaggagggccctgagggtgcaaatttgttcatataccatctgccacaggagttcggtgaccaagatattctgcagatgttcatgcccttcggcaacgtaatcagtgcaaaggtcttcatcgacaaacaaacaaatcttagcaagtgtttcggcttcgtgtcttacgacaatcccgtcagtgcccaggccgcaatccaagccatgaatggattccaaattggcatgaagagactgaaggttcaactcaaaagatccaagaatgattccaaaccatactag

SEQ ID NO: 31469 - DNA, 1710 bp, Artificial Sequence
  Description of Artificial Sequence: Synthetic coding sequence
atgcttcgggatatgactggactgcctcacaatcgaaagtgctttgactgtgaccagcggggtccaacgtacgtaaacatgacggttggttcctttgtatgtacgagttgctccggatccttgcgagggttaaatccgcctcatagggtgaaaagcatctctatgaccacattcacccagcaagaaatcgagttcctacagaaacatggcaatgaggtttgtaaacagatctggctgggcctcttcgacgatcgaagttccgccatacccgatttccgcgacccgcagaaagtgaaggaatttctgcaggaaaagtatgaaaaaaaacgatggtatgtgccccctgagcaagccaaggtggtggccagtgtgcacgcgagcatatcgggctcctctgcttcctctacaagcagcactccagaggtgaaacctctgaagtcattgctgggagattccgctcccacactgcatctgaacaaggggactccgtcacagagcccggtagtaggacgatctcagggccaacaacaggagaagaagcagttcgacttactgagcgacttgggatcggacatttttgccgctcctgcacctcagagtacagctaccgccaatttcgcaaattttgcacacttcaactcccatgctgctcagaactccgctaacgcagattttgctaattttgacgctttcggacagtccagcggaagctccaactttggcggattccccaccgccagccacagccccttccagccacagactaccgcattcaggatgctcagctccagctgctcttttggcgaatttacatccgcctttcctctgcaagccacacactctggttccgccgcttcggtgaatgctaacttcgctcattttgacaatttcccaaaaagttcctccgccgatttcggcacatttaacaccagtcagtcacatcagactgcatcagctgtcagcaaagtgtcaaccaacaaggccggactgcagaccgcagacaaatacgccgctctggccaacctggacaacattttcagcgctggccagggtggtgatcaagggtccggcttcgggacaactggaaaagcgccagtaggaagtgttgtatcggtgccatcgcagtcgagtgcgagtagtgacaagtacgctgcattggccgagctcgactctgtgttctccagtgccgcaacatcctctaatgcctatacttctaccagtaatgcctcgtccaacgtctttggtactgtgcctgtcgttgcatcagcacagacccagcccgcatcatccagcgtcccggctccatttggcgcaacccccagtactaaccccttcgtcgccgcagcaggcccaagcgtcgcatccagcacaaaccccttccaaacaaatgctcgcggagccacagctgccaccttcgggaccgcctcaatgtcaatgccaaccggttttggcaccccagctccgtatagccttcccacatctttcagcgggagtttccaacaacccgcatttcccgctcaggcagcctttccacaacagaccgcttttagccagcaacctaatgggtttgcggcattcggacagacgaaacccgtcgttactcccttcgggcaggtagccgcagcgggagtttcctcaaaccctttcatgacaggggctcctaccggtcagttccctactggtagttcttccactaacccgtttctgtag

SEQ ID NO: 31470 - DNA, 2007 bp, Artificial Sequence
  Description of Artificial Sequence: Synthetic coding sequence
atgagtaaacttgccgctgcccatagaggggctatcagagctctccaaatgttcgtcacccagtttaccgaccggggtgagcatcctctgccggctcgatgcaaagagctgggctccctgatacgccaattaagtctatgttccgtgaagcttgatgctgatccatccgtaccagatgttgttatcgacattctgcagcagatcgaagcactcgaatcgctgctggagaaaaagctgagtcccaaaaaagtgaaaaagtgcttttctgagatacgcagccgttttccaatagggtctcaaaaggcgctcgagcgctggccttccaccagccctaaaggagagcggaggcctttaactgctaaggacactttcccacaagagacatcacggcctagcgttgcgaaacagctgcttgcagataagtaccagccggatacagagctgccggagacacagaggctgcagtccgagcttgacgttctcgatgccgacatcgtgctggaggagggcccttttatcctggaccaatcagcctcctttaaggacgaggtcctcgcagttgcaaaaacaaaagcaggcaagaaaaaacctgtgaccgagaacgtgccttttaggaagaaagacacactagctccggctcggcagcaggggctgcggaaagcagaaagaggtcgccagagtcagcctcattccaaatcccgtgtgcaacagactactgtgtctagtcgactgaagatgaatagacagccagtgaaagaccgcaaggccccttggattccacccaatccaacctctccgccagctagtccgaaatgtgctgcctggctgaaagtcaagacctccccgcgagacgctacaaaagagccactgcaacaggaagacccgcaagaagagtcacatttaacaggagcagtggaacacgaggcagcgagactggcgtggttggacgctgagactagtaagcgtctcaaagagctggaggagttaaaggccaaggagattgactctatgcaaaaacaaaggctggattggctcgacgctgagacctccaggaggactaaggagctgaatgaacttaaagctgaggagatgtatcgcctgcaacagttatctgtctccgctacccacttagcggataaagtggaggaggctgttctcgaccgtctgaagcctctccttgtgaaagcccagcgggttaactcaactacggaggctaatatacatctgaaagacggtagttctgtgaacaccgctaaggcacagcccgctcaggaagtggctgccgttgattttgagagcaacaatatccggcagttagacgacttccttgaagattgtgcatccgaactgtgggctgtgacacacgctaagattttaggtagcgagaccctggccaccgtggaggacagtaaggatagcccagatctcgaaatcatgatgcgtagaatggaggagatggaaaaataccaggagtcagtgcggcagcgctataacaaaattgcctatgccgacccacggctttggatgcaagaagagaataacgaccaaaaaatctcagctattagtgagaagccgttatcaccacatcccatccgcatcactaaaactgtggaccgtaaagaccctgcagtaaatatcatgttggaacggccatgtaatgggaattccctagatgaatcagtcgggacagaggaaggatctgagaagcgcgaggccccactcctgagccttgccgaggacagccagcaaaaagagggtcgcgctccccttttcgttccacctggaatgcaacacagcatcggcgattattgttctcgattcgagcaatacctcaggattatatcacatgaagctgttggctccttcaacccatggcttattgcagagtccttctcagaggaactggtggacgaggccctgggcgcagtggcagccgaactgcaagacatgtgcgaggactacgcagaggctgtttttacttctgagttcctggaggctgcgacttag

SEQ ID NO: 31471 - DNA, 3612 bp, Artificial Sequence
  Description of Artificial Sequence: Synthetic coding sequence
atgcccgctcggattgggtattacgaaatcgataggacgattggcaagggtaatttcgccgtggttaaacgagccacgcacttggtcaccaaggcaaaggtggctataaaaattatcgataagactcagctggacgaggaaaatctgaagaaaattttccgcgaggtacagattatgaagatgttatgtcatccacacattattcggttgtaccaagtgatggaaaccgagagaatgatttacctcgttacggagtacgcatcaggaggtgagattttcgaccatctggtggctcacgggaggatggcagaaaaggaggcgaggcgcaagttcaaacagatcgttacagccgtgtacttctgccactgtcggaacatcgtccacagagacttgaaagctgagaatctcctgctagatgccaacctaaacatcaagattgctgactttgggtttagtaacttgtttacccctggccagctgctcaagacctggtgcggctcccccccatacgcagctccagagctgtttgaaggcaaagaatatgatggccctaaggtggacatctggagcctaggggttgtactctacgtcctcgtgtgcggcgctctgccttttgatggaagcaccctgcagaatttgagggccagagtgctgtccggcaaattcaggatccccttttttatgtctacagaatgtgagcatctgataagacatatgttggtcctcgaccctaataaacgactcagcatggaacagatttgcaaacataagtggatgaaactcggggacgccgacccaaacttcgatagactgatcgctgagtgtcaacagctgaaagaagagcgacaggtagaccccctaaatgaggacgttctgctggcgatggaagatatgggcctggataaagagcagaccctgcaggctgaacaggcaggcacagctatgaacatttcagtgccacaggtgcagctgatcaatcccgagaatcagattgtggagcccgacggtacgttgaatttggatagtgacgaaggggaggagccttcaccagaggcgttggtgcggtatctgagtatgagacggcataccgtgggtgtggcggacccacgcaccgaagttatggaggatctccaaaagctcctgccaggattccctggcgtgaatcctcaggcacccttcctacaggttgccccaaacgtgaacttcatgcacaatcttctgccgatgcaaaacttacagccaactggacagctggaatacaaggagcagtccctccttcagcccccaaccctgcaactgcttaacggcatgggacctctgggccgacgagcaagcgacggcggagctaacattcagctacatgctcagcagctcctgaagaggccaagagggccttcccccctggtcaccatgacacccgcagtgcctgctgttactccggttgacgaagagagttcagacggcgaacctgaccaagaggctgtccagcgatatctagccaaccgctctaaacggcacacactcgcgatgaccaatcccaccgctgaaatcccccctgacctgcaacgacagttgggccagcagcccttccggtctagagtctggcctcctcacttggtgcctgaccaacatcgtagtacgtacaaggattctaataccctgcaccttcccaccgaacgctttagccccgtgcggcgattcagcgacggcgcagcgtccatccaggcttttaaggctcacctagaaaagatgggcaataatagtagtatcaagcagctccagcaggaatgcgagcagttgcagaagatgtacggaggacaaattgatgagagaactctggagaagacgcaacagcaacacatgttgtaccagcaagaacaacaccaccagatcctccagcagcaaatacaggatagtatctgccccccacagccttctccccctcttcaggctgcttgcgagaatcagccagcactgttgacccatcagctacaacgtttaaggattcagccaagttctccacctcccaaccacccaaataatcatctcttcagacaaccatccaattcacctccaccaatgagctccgctatgatccagccccacggagccgcaagcagctcccagttccaaggcttgccaagccgatctgctattttccagcaacagccggagaactgttccagtcccccaaacgtggcactgacatgtctcggtatgcagcaacctgcacagtcgcagcaggtgacaatccaggtgcaggaaccggtggacatgctgagtaacatgccaggcaccgcagccggatcgtcaggtcggggtattagtattagcccctctgccggtcagatgcaaatgcagcatcgtacaaacctaatggccacactgagctatggacatagaccactgagtaagcaactgagcgcagactctgcagaggcgcatagcgcccatcagcagcccccacactacaccacctcagcacttcaacaagcactactgtctccaacacccccagattataccagacaccaacaggtcccgcacattctccagggcctgctgagccccaggcacagtctcaccgggcattctgacattcggctgccgcctacagagtttgcacagctcatcaaaaggcagcagcagcagaggcagcagcagcaacagcaacagcagcagcaggagtatcaagagttgtttcgtcacatgaatcagggcgatgcagggagccttgccccatccctcggcggacagagtatgaccgaacgccaagccctgagctatcagaacgctgactcgtatcaccatcacaccagccctcagcacttgctccaaatccgggcacaggaatgtgtcagtcaggccagctccccaactcccccacacggctatgcccatcaacctgctctgatgcactctgaatctatggaggaggactgttcttgcgaaggcgcaaaagacgggtttcaggatagtaagtcaagctctaccctgaccaaaggctgccacgactcacccctcttactgagtaccggtggtcctggggatccggagtctctgcttggcacagtgagccacgcccaggagttgggaatccatccctatggtcaccaaccgaccgcagctttctcaaagaataaggtgcccagtcgggaaccagttattggcaactgcatggaccgctcgagtccgggtcaggccgtcgagctccctgaccacaacgggctgggatacccggcaagaccgtctgtccacgaacaccacaggccccgtgctctgcaacggcatcatactatacaaaattctgatgatgcatacgttcagctggacaatctgccaggaatgtcattggttgctggtaaggccctatcttccgcacggatgtcagatgcagtcttgagccaatctagcctcatgggttctcagcagttccaagacggcgagaatgaagaatgtggagccagcttaggaggacacgaacaccccgatttgagcgatggtagtcaacaccttaactcatcctgctacccgtccacatgtatcacagatattttgctgtcttataaacacccagaagtgagcttcagcatggaacaggccggagtttag

SEQ ID NO: 31472 - DNA, 2046 bp, Artificial Sequence
  Description of Artificial Sequence: Synthetic coding sequence
atgattgagaagatgcaagggagcagaatggacgaacagagatgttcgttcccgcctccactgaaaaccgaggaagactacataccctatccgtccgtgcatgaggtgctcgggagagaggggccattccccttaatactgctgccacagttcggtgggtattggattgaagggacaaatcacgaaattaccagcattcctgagaccgaacccttgcagagtcccaccactaaagtcaagcttgagtgcaacccgactgctaggatttatcgcaaacacttcctcgggaaggaacactttaattattattccctcgatgctgccctgggacatcttgtgttttctctgaaatatgacgtgatcggtgatcaggaacacctgcggctgttgctacgcaccaaatgtcggacctaccatgatgtgatcccaatcagctgcctcacagagtttccaaatgtggtgcaaatggccaagttggtgtgcgaggacgtcaacgtagacagattttatccagtcctgtatcctaaagccagtcgcctgatagttacctttgacgaacatgttatctccaacaatttcaagtttggggtcatttatcagaagctgggccaaacctcagaggaggaattgttctccaccaacgaggagagtcctgccttcgtggagtttcttgaatttctgggacaaaaggtaaagctgcaagattttaaaggattcagaggaggcctggacgtgacccatggccagacagggactgagtcagtctactgtaactttcggaacaaggaaatcatgtttcacgtgagcacgaagcttccctacacagagggggatgctcaacagctgcaaaggaaaaggcacattggcaacgacattgtagccgtcgtgtttcaggacgagaacactcctttcgtgcctgatatgattgcatctaatttcctccatgcctacgtggtcgtgcaggcagagggcggaggccctgacgggcctctctacaaggtctcagtaaccgccagagatgacgtcccattcttcggaccgcctcttccagaccccgctgtcttcagaaagggacccgagttccaagaatttctcctgacaaaactgattaatgcagaatacgcttgctacaaagcggagaagtttgccaaactcgaggaacggactcgggctgccttgcttgagaccctgtatgaggagctccacatccatagccagagcatgatggggctgggcggtgacgaggacaagatggagaacggcagcggtggcggtggtttctttgaatctttcaagagggtcatccggtcaaggtctcagagcatggacgccatgggtttatctaacaagaagccaaataccgtgagcaccagccatagtggatccttcgcccctaataatccagacttagcaaaggcagccggaatctccctgctgataccgggtaaatcagcttcacgatttggcaggcgtggctctgcaatcgggattggaaccgttgaggaatcactgatcgtgcctgggaagagccctacacggaaaaagtctggtccttttggctctcggagatcctccgctatcgggatcgagaatattcaggaggtgcaggaaaaacgggagagtccgcctgcagggcagaaaacccccgactccggccatgtctctcaggaaccaaagtctgaaaacagctctacacagagcagccccgagatgccgactacaaaaaatagagcagaaactgcagcccagagagccgaggctttgaaagacttttctcggtcgagctcctccgcttcttctttcgcttctgtggtagaggaaacagaaggggtggacggggaggacaccgggttggagtctgtgagttcttccggtaccccccacaaaagggactctttcatatactcaacctggttggaagatagcgtatccaccacatccgggggaagctccccagacgccggtaagctgggcgacccagcttgcccagagatcaagatccagcttgaggcatctgagcagcatatgcctcagctggggtgctag

SEQ ID NO: 31473 - DNA, 675 bp, Artificial Sequence
  Description of Artificial Sequence: Synthetic coding sequence
atgtccgtgggttacgccaacggaattagggtgatgagcatgacccacacaggcgaaccgggtttcatgttatatattcccatcgaatacgccctgcacgtctacaacgaggttatgtcagttggtcagaagtacggaattcggaacgctgggtactatgctctgcggtccctgaggattgaaaaattcttcgccttttggggccaggatattaataatctcaccacaccgctcgaatgcggtcgcgagagcagggtgaagttagaaaaggggatggattttatcggccgagatgctctcctgcagcagaagcagaacggcgtctataaaagactgactatgtttattctggatgatcacgatagcgatctggatctgtggccctggtggggtgagcctatatatcggaacgggcaatatgttggcaaaaccacttccagcgcgtattcttactcgctggagaggcacgtatgcttgggctttgtccacaatttttctgaggatacaggggaagaacaggtggtgacggccgatttcataaatcgaggcgagtacgagattgatatcgcgggttaccgctttcaagcaaaggctaagctttatcctgtggcttccctgtttacacagaaaagacgcaaagatgatatggagttgtcggacttacatggtaagtag

SEQ ID NO: 31474 - DNA, 1590 bp, Artificial Sequence
  Description of Artificial Sequence: Synthetic coding sequence
atgcacttcagcggcctcgaggaagccgtgtaccgcaatatccaggcctgtaaagaactcgcgcagacgacaagaacagcctatggacccaatggaatgaacaagatggttattaaccatctcgagaaactattcgtcacaaatgacgcagctacaattcttcgggaactggaggtacagcatccggctgccaagatgatcgtcatggcctctcatatgcaggagcaagaggtgggcgatgggacaaatttcgtcctcgtgttcgctggagccttgctagagctggctgaggaactcctgcgaatcggtctctcagttagtgaggtgatcgaaggatacgagatcgcgtgccggaaggcacacgaaatattgcctaatctagtgtgctgcagcgccaaaaacctcagggacatcgatgaggtgagtagccttttgagaacatctattatgtccaagcagtacggtaacgaagtcttcctggctaaattgatagcgcaggcctgcgtctctattttccccgactcaggccacttcaatgtggacaacattcgcgtttgcaaaatccttggaagtggcatctctagctcttctgttctacatgggatggtgttcaaaaaggagaccgaaggggatgtgacatcagtcaaggatgccaagatcgcggtatacagttgccccttcgatggcatgatcaccgagacgaagggtacggttttgattaagactgcagaagagctgatgaattttagtaaaggtgaggagaacctgatggacgcccaagttaaggcaatcgccgacactggcgctaatgtggttgttaccgggggaaaggttgctgacatggccctccactacgctaacaagtataacattatgttggtgaggctgaatagcaaatgggatcttcggagactctgcaagaccgtgggggctaccgccctcccacgactgactccgcctgttctggaggaaatgggtcattgtgactccgtctatctgagcgaggtcggagatacacaggtggtagtgttcaagcacgaaaaggaggacggggcaataagcaccattgtgctgcgcggatcaaccgataaccttatggacgacattgaacgcgcagtggatgatggggtcaatacgttcaaagtgcttacaagagataagaggttggtgcccggtggcggagcaactgagatcgagctcgctaagcagattacctcctatggtgagacatgtcctggccttgagcagtacgctatcaagaagttcgctgaggcattcgaggcaattccaagagcactggctgagaattctggggttaaggcgaacgaagtgatatcgaagctttacgcggtccaccaggagggtaacaaaaacgtggggcttgacattgaggcagaagttcctgccgtgaaggatatgctggaagcaggaatcctagatacctacctcggtaagtactgggccatcaaattagccacaaatgccgctgtgaccgtgctccgtgtggaccagatcatcatggcaaaaccggctggtggacccaaaccacccagcggaaagaaggattgggatgacgatcagaacgactag

SEQ ID NO: 31475 - DNA, 2193 bp, Artificial Sequence
  Description of Artificial Sequence: Synthetic coding sequence
atgttcggacggaagagatccgtctccttcggaggatttggatggattgacaagacaatgctggcaagccttaaggtcaagaaacaggaactagctaatagcagcgatgcaacccttcccgaccgcccactgtccccacctctgactgctcctcctaccatgaaaagctctgagttctttgaaatgctggagaagatgcagggcataaagctggaggagcagaaacctggccctcagaagaacaaagatgattatataccctacccctccattgatgaggtcgtggagaaaggcggaccgtacccccaggtgattctcccacaatttggcggatattggatcgaagatcccgagaacgtggggactccaacctcactgggcagcagtatttgcgaggaggaggaggaagataatttatcccccaataccttcgggtacaagctcgaatgtaagggtgaggcgagagcctaccggcgacacttcctaggaaaagatcaccttaacttctactgcaccggcagctctcttggaaaccttatcctatctgtcaagtgtgaagaagctgagggtattgaatacctaagggtcatccttaggagtaaactgaaaacagtgcacgagagaattcctttggctggactgagtaaattgccttccgtccctcagattgcaaaggcattttgtgacgatgcagtgggccttaggttcaacccagtcctttatccgaaggcctctcagatgatagtctcgtacgatgaacatgaagtgaataacacttttaagttcggcgtgatttaccaaaaggcccgtcagacccttgaggaggagttatttggtaacaacgaggaatcgcctgcattcaaggaattcctggacctgctaggagatactattactctccaggactttaaggggtttcggggtggcctcgacgtcacacacggacagacaggcgtagagagtgtgtacaccaccttccgcgacagagagattatgttccatgtttccacaaaactgccctttacagatggagacgcacagcaactacagcgcaaaagacacatcggaaatgacatagtcgcaatcatcttccaggaggaaaataccccctttgttccagatatgatcgcctctaactttttgcatgcctacattgtcgtgcaggtcgaaacgcccggtactgagactccgtcctacaaagtgtccgtcactgcaagggaggacgtacccacttttggcccacccctgccaagtcctccggtttttcagaaaggccctgaatttagagagtttctgctcacgaagcttacaaatgccgagaacgcctgttgtaagtctgataaattcgcaaaacttgaagacagaacacgggcagccctgctcgataacctgcacgacgaactccatgcccatacccaagccatgcttggtcttgggccagaggaagataaatttgagaatggtggccacgggggtttcctggaatcctttaagcgtgcaatcagggtgcgtagccactcaatggaaactatggtgggtgggcagaaaaaatcacactctggaggaatcccagggtcactcagcggaggtatctctcataacagcatggaggtgaccaaaaccacattctccccacctgtggtggctgcaacagtcaaaaatcagtcccgttcccctattaagaggcggagcggcctttttccacgtctgcatactggatctgagggacaaggcgactcccgcgctaggtgcgactctacttcaagcacgcctaagacccctgatggcggacacagctcgcaagaaatcaagagcgaaaccagctccaacccaagctcccctgagatttgccctaacaaggagaaaccattcatgaaactaaaggagaacgggcgtgccatctcccggagtagcagctctaccagcagtgtatcctccactgccggagaaggagaggccatggaggaaggggacagtggaggctcacagccttctaccacttctcctttcaagcaggaggtcttcgtttacagtccgtcaccttcatcggagtcgcccagtcttggcgcagcagctactcccatcataatgagtcgtagcccaacggacgcaaagagccgaaactccccccgaagcaatctgaaatttaggttcgataaacttagccacgctagtagtggagcaggccactag

SEQ ID NO: 31476 - DNA, 2271 bp, Artificial Sequence
  Description of Artificial Sequence: Synthetic coding sequence
atggttgcccctgtcctcgagacctcacatgtgttctgctgccctaacagagtgcgaggtgtcttgaattggtctagcggacctcgcggtttgctcgccttcggtacctcctgttctgtagtgctgtacgaccccctgaaaagagtcgttgtgaccaacttgaacgggcacaccgcaagggtcaattgtatccagtggatttgcaaacaggacgggtcgcctagtacagagctggtgtcagggggttccgacaaccaggtgatccattgggagattgaggacaatcagcttctcaaggcggtgcacctgcagggacatgagggtcctgtctatgccgtccacgcagtatatcagcgacgaacttccgaccccgcattgtgcactcttattgtatccgcagccgcagacagtgccgtgagactctggtccaagaaaggaccagaagtgccaatcctcgcttgtggtaacgatgactgtcgcatccacatcttcgctcagcaaaacgatcaatttcagaaagtgctcagcctctgcggccacgaagactggatccggggagtcgaatgggctgcgttcgggagagatttatttctcgcgtcctgcagccaggattgcctgataaggatatggaaactgtacataaaaagcacctcactggagacacaagacgacgataatatccggctcaaagaaaacactttcacgatcgagaacgagagtgtcaagatagccttcgccgtcaccctggaaacagttctagccggtcacgagaactgggtgaatgccgtccactggcagcccgttttctataaagatggagtcctgcaacagcctgtgcgcctgctgagtgcctctatggacaagacaatgatcctgtgggctcccgacgaagaatctggcgtgtggcttgagcagcgcgagtggactccggaaattgtgattagcggccacttcgacggggtccaggatttagtatgggaccccgagggcgaatttatcataaccgtcggcacggatcaaactacccgcctttttgccccatggaagcgcaaggatcagagccaggtgacatggcatgaaatcgcgagaccacaaattcatggttacgatcttaaatgtctcgctatgatcaatagatttcagtttgtcagcggggctgatgaaaaggtccttagggtattcagtgccccaaggaacttcgtggaaaatttttgcgccattacagggcaatccttgaaccacgttctctgtaaccaggattctgacctgcctgaaggggctacagtaccagcgttaggactgagtaataaagcggtctttcagggtgacattgcttcccaacccagcgatgaagaagaattactcactagcacgggcttcgagtatcaacaggtcgcattccagcctagcattcttacggagcccccaacagaggaccatttgctgcagaacacattatggcctgaagtgcagaaactgtacggacatggatacgaaattttctgtgtgacatgtaacagctcaaagacactcctagctagtgcgtgtaaagccgctaagaaagaacatgccgctatcattctgtggaatacaactagctggaaacaagttcagaacctggtttttcactctctcacagtgactcagatggctttctctcccaatgagaagttcctgctcgctgtgagcagggacaggacttggagcttatggaagaaacaggatacaatttcccccgagttcgagcctgtcttcagcctgtttgcatttacaaataaaatcacttccgtgcacagccggatcatctggagttgcgattggagcccggactcaaaatatttctttactggaagccgggataagaaagtagttgtatggggcgaatgcgactcgacggacgattgcatagagcataacattggtccttgttcaagcgtcttagacgtgggcggagccgttactgccgtgtcagtatgtcccgtgttacatccatctcaacggtacgttgtcgcagttggcctcgaatgtggtaaaatttgcctttacacctggaaaaagaccgatcaagtgcctgagatcaacgattggacgcactgcgtggagactagtcaaagtcagtctcatactctcgcgatccgcaagttgtgttggaaaaactgcagcgggaagacagaacaaaaagaagccgagggcgcagaatggctgcacttcgcctcgtgcggagaagatcataccgtgaagatccaccgcgtcaacaagtgtgcattgtag

SEQ ID NO: 31477 - DNA, 1272 bp, Artificial Sequence
  Description of Artificial Sequence: Synthetic coding sequence
atgaacaggcagccggtgaaggaccgcaaagccccatggattccaccaaatcccacaagccccccagccagcccaaaatgtgccgcttggctgaaagtcaaaacatctcctcgggacgcaacaaaggaacccctgcagcaagaggacccacaggaagaaagtcacctcactggggcagtggagcacgaagccgctaggctggcctggctggacgcggagactagcaagaggctcaaggaactcgaagagctgaaggccaaagaaatcgattccatgcagaaacaaagattagactggctggacgccgagactagtagacgtacgaaggaactcaatgaattgaaggcagaggagatgtaccggctgcaacagctcagcgtgtccgcaacccacctagccgataaagtggaggaagccgtcctcgatcgtctcaagcccctgttggttaaggcccagagagttaacagcaccacggaggccaatatccacctgaaggacgggagctcagtcaacacggctaaggcccagcccgctcaggaagtcgccgctgtagacttcgagtcaaacaatatccggcagctggatgactttttggaggattgcgccagcgaactgtgggcggtgactcacgccaagatcttaggatccgagactttggctaccgtggaggatagtaaagattcccccgatctggagataatgatgcgacgcatggaagaaatggagaaataccaggaaagtgtgcggcaacggtataacaaaattgcatacgccgatcccagactgtggatgcaggaggagaacaatgaccagaagatctccgccatctcggaaaaaccactctcccctcatcccattcgcataaccaagaccgttgacaggaaggaccccgctgttaatatcatgcttgagagaccatgtaatggcaattcgctggacgagtctgtggggacagaagaaggttcagaaaagcgcgaggcacctctcctcagcttggcggaagacagtcagcagaaggaaggccgtgcaccattgttcgtcccgccaggcatgcagcactcaattggagactattgttccaggttcgagcagtacttgcgcatcatctcgcatgaagccgtggggagtttcaatccctggctaatcgccgaaagtttttccgaggaactggtagatgaagcgctgggggctgtggcagcagagctccaggatatgtgtgaagactatgcggaagctgtattcaccagcgagttcctggaagctgctacatag

SEQ ID NO: 31478 - DNA, 777 bp, Artificial Sequence
  Description of Artificial Sequence: Synthetic coding sequence
atggctcgcctgcaggaggagcatggcgaccagctactttccattcgctgtcaacatcaagagcaagttgaagatttgactgcttcccatgatgccgcactgctcgaaatggagaacaaccacaccgtggccataaccatactgcaggatgaccacgaccataaggtacaggaactgatgagtacacacgagctggaaaagaaggagctggaggagaatttcgagaaattgcgactgagcctacaggatcaggttgatactcttacctttcaaagtcaaagccttcgggacagggcacgccgatttgaagaggcactgaggaagaacacagaggaacagctagaaattgcactggccccttaccagcaccttgaggaggacatgaaatcgttgaagcaagtgcttgaaatgaagaatcagcagatccacgaacaggaaaagaagatcctggagttagaaaagctggctgagaaaaatatcatattggaagagaaaattcaggtgttgcaacagcagaatgaagacttaaaggcaaggatcgaccagaacacagtggttacgcggcagctttcagaagaaaatgccaacctgcaggagtacgtggagaaggaaactcaggagaaaaaaaggctcagtcgaacaaatgaagagcttttgtggaagttacagaccggcgatcccacctctcctatcaaacttagtcctactagtccagtgtatcgagggagtagctctgggcctagttcccctgctagggtcagcaccaccccacggtag

SEQ ID NO: 31479 - DNA, 1053 bp, Artificial Sequence
  Description of Artificial Sequence: Synthetic coding sequence
atgtgcccaaccacgacttggcctagagggcgtcgttggagccggaacctgcgtgacacccaggccgttcgtcattacaaaatttggagacgagctggagggaggctccatctgaacgaggcagtctcattcctttccctgccagaactcgtgaattatcaccgcgctcagtccttaagccatgggctgagacttgcagcaccctgccgtaagcacgaacctgagcccctgccacattgggacgactgggagcgaccccgagaggagttcacactctgccgaaaactgggatcaggctacttcggggaagtgtttgagggtctgtggaaagatagggttcaggtggctataaaggttattagcagagacaacttgttgcatcagcagatgctccagtccgaaatccaggcaatgaagaagctgcggcacaagcatattcttgcactgtacgccgtggtctctgtcggcgacccagtatacattatcacagaactgatggccaaaggatcactgcttgagcttcttcgcgattccgacgaaaaggtactgcctgtgtccgaattattggatattgcgtggcaagtggccgagggaatgtgttacctggaaagccagaactacatccatcgggacttggctgccagaaatattctcgtcggagagaacaccctgtgtaaagtgggggattttggtctggctagattgataaaagaagatgtgtacctgagccacgatcacaatatcccatacaagtggacagcacccgaggccctctcaagggggcactactccaccaaatcagacgtgtggtcattcggtattctgcttcacgagatgttcagccgcggacaggtcccctatccagggatgagtaaccacgaggcctttctacgagtggatgccggttatagaatgccctgccccctcgagtgtcctcctagtgtgcacaaactgatgcttacctgctggtgtagggatcctgaacaacggccatgcttcaaagctctgcgcgagcgccttagcagcttcactagctatgagaaccctacgtag

SEQ ID NO: 31480 - DNA, 3480 bp, Artificial Sequence
  Description of Artificial Sequence: Synthetic coding sequence
atggtgtcctcttctcctagtaccccgtctaatatcccccagaaaccttcacagccagcagcgaaggagccgtctgccacaccgcctattagcaatttaaccaaaacggctagtgagtctatatccaacctgagcgaagcagggtcaattaagaagggcgagcgtgaactgaagataggcgatcgggtgctggtagggggtaccaaggcgggagtagtgagattcctaggagagaccgattttgcaaaaggcgaatggtgcggtgtcgagttggatgaacctcttggcaagaatgatggcgctgttgccggtacacggtattttcagtgtcagcctaagtatggtctcttcgcccctgtacataaggtgacaaaaattggctttccatcaaccacgccggcaaaggccaaggccaacgcggtgcggcgagtaatggccactacgtcagcgagcctgaagaggtctccgagcgcttcatcgctgtcatcaatgagttcagtggcttccagtgtgagttccagaccaagtagaaccgggctactgacagagacatccagcaggtacgccaggaaaatcagtggtacaaccgctcttcaggaagctctgaaggagaagcaacagcacatcgagcagctcctggctgagcgtgacttggaacgcgctgaagtcgccaaggcaactagtcacgttggcgaaattgaacaggaactcgcattagctcgagacggacacgatcagcacgttctcgagctcgaggccaagatggaccagctccgaactatggttgaggcagcggacagagagaaggtggaattattgaaccagctcgaggaggaaaagcgtaaagtggaggaccttcagtttagggttgaagaggagtcaatcacaaagggagatctggagacacagacaaaactggagcatgctcggattaaggagctggaacaaagcttattgtttgaaaagacaaaggcagataaactacagcgagaactggaggatacacgggttgccacagtcagtgaaaaatctagaataatggaactagagaaagatctggccctgagagtgcaggaggtggccgagctgcgccgacggctggaatcaaacaagcccgctggcgacgttgacatgtctctctcactactgcaagaaatcagtagtctgcaggagaaactggaggtgaccaggaccgatcatcagcgggaaataaccagtcttaaagagcactttggcgcaagggaggaaactcaccagaaagaaattaaagctctgtatactgccacagaaaagctgagcaaagagaatgagagcctgaagagcaagttggagcatgcaaataaggagaattccgatgtcattgctctttggaaatccaagctggagaccgcaattgccagccaccagcaggccatggaggagctgaaggtgagcttctcaaagggcctaggaactgagactgctgagttcgccgagctgaaaactcagatcgaaaagatgcgtcttgattaccagcatgagatcgagaacctccagaatcaacaggacagcgagagagctgcacacgcaaaggaaatggaggcgctacgggctaagctgatgaaagtaataaaggaaaaggagaattctctggaggctattcgctcaaaactcgacaaggccgaggatcagcacctagtggaaatggaagacacgttaaacaaactccaggaggccgagattaagaaagaaaagttcgcagaagcttccgaagaagctgtatcagttcaacgctccatgcaggaaacggtgaacaagctccatcagaaggaggaacagtttaacatgctatcatccgatctggaaaaattaagagagaaccttgccgatatggaagccaaattccgggagaaagatgagagggaggaacagttaattaaagccaaggagaagttagaaaacgacatagccgaaatcatgaaaatgtccggagacaatagctcgcagctaactaagatgaacgatgagctgcgcttgaaggagcgcgacgtcgaagaactgcagctgaaactgacaaaggctaacgaaaacgcgtccttcctgcaaaaatcaatcgaagatatgactgtcaaagctgaacaaagtcagcaagaggcggctaaaaaacacgaagaggagaagaaggagctggagaggaagctgagtgaccttgaaaaaaaaatggaaactagccacaaccaatgtcaggaactgaaggcaagatatgagagggccaccagcgagactaaaacgaaacacgaggaaatcctgcagaaccttcagaagactttactagatacagaggataagctgaaaggagctcgcgaggaaaattctgggctgctgcaggaacttgaggagctgcgcaaacaggccgataaagctaaggcagctcagacggctgaagacgcaatgcagataatggaacagatgactaaggagaaaaccgagactttggccagcctggaggacactaagcagacgaacgctaagctgcagaatgagctggacactctgaaagaaaacaacttaaagaacgtagaagaattgaataaatctaaggagctcctgacagtggaaaatcagaagatggaagaatttcgcaaagaaattgagacactgaaacaagccgctgcacagaaatcccagcaactttctgctctgcaggaggaaaacgtgaagctggcggaggagttggggcgaagtagggacgaggttacctcccaccagaagttggaggaggagcgctcagtcttgaacaaccagctgctggagatgaaaaaaagggagtccaaatttattaaggacgctgatgaagaaaaggcttctctgcagaagtcaatctccatcacctcagccctgttgacggagaaagatgctgaacttgagaagctacgaaacgaggtgaccgtacttaggggcgaaaatgcttctgccaagtcgctccactccgtcgtgcagaccctagagtctgacaaagtcaaacttgagctgaaggtgaagaatctcgaacttcagctaaaggaaaacaagaggcagctgagctctagttctgggaatacagacacccaggccgatgaggatgaaagagcccaggaatcccagaatcagatcgactttttaaattctgtgatcgttgacctgcaacggaaaaaccaggatctaaagatgaaagttgagatgatgagcgaagccgctttaaatggtaacggtgatgatctaaacaactatgattctgacgaccaagaaaaacagagtaagaagaaaccaagactgttctgcgacatctgtgactgcttcgatttgcatgacacagaagactgtcctacacaggctcagatgagcgaggacccaccccactctacccaccatgggagtcggggtgaggagcgcccatactgtgaaatttgcgaaatgttcgggcattgggccactaattgcaacgacgacgaaacattctag

SEQ ID NO: 31481 - DNA, 756 bp, Artificial Sequence
  Description of Artificial Sequence: Synthetic coding sequence
atgaccaccgagcagcgacgcagtctgcaggcctttcaagactacattcgaaaaaccctggacccaacctacatcctgagctatatggctccctggtttagagaggaggaggtgcagtatatccaggcagagaaaaataataaaggccctatggaggcagccacgctttttctgaagtttttactagagctgcaggaggaagggtggtttaggggcttcctggatgccctggatcacgctggatatagcgggttgtatgaagccatcgaaagttgggactttaagaaaatcgagaagctggaagagtaccgcctgctcctcaagagactgcagccagagttcaagacacggataatccccacagatatcataagtgatctgagtgaatgcctgatcaatcaagagtgtgaagagatcctgcagatctgctctaccaaaggtatgatggcaggggcagagaagctggtcgagtgtcttctacgaagtgataaggaaaattggcccaagacactaaaactggcattggaaaaggaaagaaataagtttagcgaactgtggatcgtggaaaaaggaatcaaagatgtggagacggaagacttggaagataagatggagactagcgatatccaaatattttatcaagaagatcccgaatgtcagaacttaagcgaaaacagctgtccaccttctgaggtcagtgacaccaacctgtattcccctttcaagccaattaagaaaaagaaaaaaaagaagtag

SEQ ID NO: 31482 - DNA, 3189 bp, Artificial Sequence
  Description of Artificial Sequence: Synthetic coding sequence
atggtaagcagtgcgcagatggggttcaacttgcaggccttgctcgagcagttgagccaggatgagttatctaaattcaaatacttgatcaccaccttcagtcttgcccacgaacttcagaagatcccacataaagaggtcgataaagccgacggaaagcagctggtggagatcttgacgacccattgcgacagttactgggttgaaatggcctctttacaggtgttcgagaaaatgcatcggatggatctatccgagagggccaaagatgaggtccgggaagccgctctgaaatcatttaataagcgcaaacctttaagtttgggcataacccgcaaggaaaggccacctctcgacgtggacgaaatgctggagagattcaagactgaagcccaggcctttacggagaccaaaggcaacgtcatctgtttagggaaggaagtttttaaagggaagaagcctgacaaagataaccggtgcagatacatcctcaagactaagttcagagagatgtggaagtcatggcctggagactcaaaagaggtccaggtaatggccgaacgctacaagatgcttataccctttagtaacccaagggtattgcccggtccattttcctatacagtggtcctgtacggtcccgctggactaggaaagaccactctcgctcaaaaattgatgctggattgggccgaagataaccttattcacaagttcaaatatgctttctacctgtcatgcagagagctatcgcgcctaggaccatgtagcttcgccgaacttgtgtttcgggactggcctgaactgcaggatgatataccacacatcctggctcaggccagaaagatccttttcgtgatcgacggattcgatgagctgggcgcagcacctggcgctctcattgaggacatctgtggggattgggaaaagaagaagcccgtaccggtgctcctggggtcccttttgaaccgcgtgatgctgcccaaagcggctctgctggtgacaacccgcccacgggcactcagggatctgcgtatcctggcagaagagccaatctatattagagtcgaaggtttccttgaggaggacaggcgtgcttattttctcagacactttggcgatgaggatcaggcgatgcgcgctttcgaacttatgcgttcaaatgcggctctttttcagctgggctccgctccggctgtatgttggatagtgtgcacaactttaaagctgcagatggagaagggtgaggatcctgttccaacgtgcctgactagaaccggcttgtttctccgatttctttgttctaggttcccgcagggcgctcagctccgcggagcacttcgtacactgagcctgctggcagcgcaaggcctgtgggcccagaccagcgtcctgcatcgggaggacttggagcggctgggcgttcaagagtcagacctccggctgttcctcgacggtgatatcctgagacaggacagagtgtccaagggctgttactcttttattcacctgagtttccaacagtttttaacggccctattctacacactggaaaaagaagaagaggaagacagagatggccacacttgggatattggcgatgtccagaaactgctgtctggcgtcgagagactgagaaaccctgacctaattcaagcagggtattattctttcggtctggccaacgaaaagcgcgcaaaggaactggaagctaccttcgggtgcaggatgtctcccgatatcaagcaagagctgctcagatgtgacataagttgtaaaggcggacattcaactgtgacagatcttcaggagttacttgggtgcctctatgaatcccaggaagaagaactggtgaaggaggtaatggcccagtttaaggaaatttccctacatctgaatgcagtagacgttgtgcccagctcattctgtgtgaagcactgccgaaacctacagaaaatgtctctccaagtgattaaggagaatcttcccgagaatgtgaccgcaagcgaaagcgacgctgaggtggagcggtcccaagatgaccagcacatgttgcccttttggaccgacttgtgttctatctttggatcaaataaagatctcatgggtctcgccatcaatgacagcttcctgagtgcctctctcgtccgcatcctgtgtgaacaaattgcttccgacacgtgccatctgcagagggtcgtatttaagaatatcagccccgctgacgcacacaggaacctctgtctggccctcaggggccacaaaactgttacttacttaaccctgcagggaaatgatcaagatgacatgtttccggcactgtgcgaagtccttcggcaccctgagtgtaatcttagatatctgggcctggtgtcttgtagtgcgacgacccagcaatgggccgatttaagcctggcattagaggtgaaccagagcctcacttgtgtgaatctgtctgataacgaactactcgacgaaggcgctaaactgctttacactacccttaggcaccccaaatgcttcctgcagcgactgtccctggagaattgccacctgacagaagctaactgtaaggatctggccgcagttctcgtagtgtcacgtgaactgactcatctgtgcctggcaaagaatccaataggaaacaccggggtgaagtttttgtgtgaaggccttagatatccagagtgtaagctgcagacattagtcttatggaactgtgatataacctctgatggttgctgtgaccttaccaaactgctgcaggagaagtcttccttgttgtgtctggatctgggactgaaccacatcggagtgaagggtatgaagtttctttgcgaggctcttaggaaaccactgtgcaacctgagatgcctctggctttggggatgttcaattccccctttctcctgtgaagatctctgttctgccttaagttgcaatcagtcgctggtaacactcgatctcggacagaatccactgggcagttcgggggtcaagatgctgttcgaaacgctgacgtgtagtagtggcactctgagaacattgaggctgaagattgatgattttaatgatgagctgaacaaattgctcgaggagatcgaagagaagaacccacagcttataatcgacaccgaaaaacaccatccttgggccgaacgccctagttcccatgacttcatgatctag

SEQ ID NO: 31483 - DNA, 363 bp, Artificial Sequence
  Description of Artificial Sequence: Synthetic coding sequence
atgtggagtattgagaatattgcctttggcagcggaggaggcctgctgcagaagctcacaagagacctgctcaattgctcttttaaatgtagctacgtcgtcacaaatggactcgggatcaatgtttttaaggacccagtagctgatcccaacaaaaggtctaaaaaagggaggctctctttgcaccgcactcccgctggtaattttgttacgctggaggagggcaagggcgacctcgaggagtacggacaggatctgcttcatactgtcttcaagaacggaaaagtgacgaaatcgtatagttttgacgagatacggaagaatgcccagttaaacatcgagttagaggccgcacaccactag

SEQ ID NO: 31484 - DNA, 936 bp, Artificial Sequence
  Description of Artificial Sequence: Synthetic coding sequence
atgtaccacttggacaaccacccagagaagcaattctcgactgacgtactaaaacaagctattgagctctcgcccgataatcagtatgtgaaggttttgttgggtctgaaactccagaagatgaacaaggaggcggaaggcgagcagtttgtcgaagaggccctcgaaaaatccccctgtcagaccgacgtcctgaggtccgcagcgaagttctatcgcaggaagggggacttggataaagcgatagaattgttccaacgagtgcttgaaagtactccgaacaatgggtacctgtaccaccagataggctgttgctacaaggcaaaagtcaggcaaatgcaaaatacaggggagagtgaagctagtggaaataaagaaatgatcgaggcccttaagcagtacgctatggattatagtaacaaagcccttgagaaaggtttaaatccgctgaatgcatattccgacctagccgaatttttagagaccgagtgttatcagactcctttcaataaagaggtgcctgatgccgaaaaacaacagtcccaccagagatactgcaatctgcagaaatacaacgggaaatctgaagatacggcagttcagcatggcttagagggcctaagtatctcgaagaaatcaaccgacaaggaggagatcaaggaccagcctcagaacgttagcgagaacctgctgccgcaaaacgctcctaattattggtacttgcagggactcattcataaacagaacggggatcttctgcaggccgcaaagtgctacgagaaggagctgggacgattgctgcgcgatgcaccttcaggtatcgggagcatctttctgagcgcaagtgaacttgaagacggaagtgaagagatgggacagggcgctgtgtcctctagtccaagggagttactctctaacagtgagcagctcaactag

SEQ ID NO: 31485 - DNA, 3267 bp, Artificial Sequence
  Description of Artificial Sequence: Synthetic coding sequence
atgtacggttcagctagatccgtgggaaaagtcgagccatcaagccaaagccccggtagaagccctagactgcccagatccccgagactcggacaccgcagaaccaacagcaccggcggttcatcagggtcctccgttggcggagggtctgggaagacgctgagcatggaaaacattcagtcccttaatgccgcttacgctacctcagggcctatgtacctctcagatcacgagaacgtgggcagcgagactcccaaaagtaccatgacattgggacggtccggaggacgtcttccttacggcgtgaggatgacggccatgggctcctctccaaatattgcatcaagcggagttgctagtgatacaatagcatttggggaacaccatttgcctcctgtgagcatggccagtacagtgccccatagcctgcgccaagctcgcgataacacaatcatggacctgcaaactcagctgaaggaggtcctacgggagaatgacctgctgcggaaagacgtggaggtgaaagagtccaagttatcttcctctatgaattctattaaaacattctggagccccgaattgaaaaaagagagagcactgcgcaaggatgaggctagcaagatcaccatttggaaggagcagtaccgggtcgtgcaggaggaaaatcaacacatgcagatgaccatccaggccctccaggacgagcttaggatccagcgggacctaaaccaacttttccaacaggactcttccagccgcactggcgagccttgcgtggctgagctgaccgaagaaaattttcagcgcttacacgctgagcacgagcgccaggccaaagaactttttctcctgcggaagacccttgaagagatggaactacgtattgagactcagaagcaaacgctgaatgcacgtgatgagagcatcaagaagcttctggagatgctgcagtccaaaggcttgagcgctaaagccaccgaagaggaccatgagcgcacacggaggttggcagaagctgagatgcatgtgcaccacctggaatcccttttagaacaaaaggagaaggagaactcaatgctgcgtgaagagatgcaccgtcgcttcgagaacgctcctgactcagcaaagaccaaagctctgcagaccgttatcgaaatgaaagattcaaagatctcctccatggagcgcggtcttcgggaccttgaggaggagattcaaatgctcaagagcaacggggctctgagcaccgaggagagggaagaagagatgaagcaaatggaggtgtatcggtctcactcaaaattcatgaagaataagatagggcaggttaagcaagagctgtcccgcaaagatacagagcttctcgcactgcaaacaaagttggagacattaacaaatcagtttagtgactcgaagcagcatatagaagtgttgaaggagtctttgacagcaaaggagcaacgggctgctatcttgcagaccgaggtggacgccctgcgactcagactggaagaaaaggaaaccatgctaaacaagaagactaaacagatccaagacatggccgaagagaaaggcacccaggccggagagatacacgatttgaaggacatgctggatgtgaaggaacgcaaggtcaatgtgctgcagaaaaagattgagaatctgcaggagcagctgcgcgataaggagaagcaaatgagctcactgaaagagcgagtcaagtcccttcaggcggacaccaccaatactgacaccgcgctaacaacattggaagaggcgctggccgagaaggagagaaccatcgagaggctgaaagagcagcgggatcgtgatgagcgcgaaaagcaggaggagatcgacaactacaagaaggatctgaaggacctcaaggagaaagttagcctgttgcagggcgacctctccgagaaggaggcctcgctgctcgatctgaaggagcatgcatcctcgttggcaagctctggcttgaaaaaggattcaagactcaagactctggaaatcgccctggagcaaaagaaggaagaatgtttaaagatggagagccagctcaagaaagcacacgaggctgctctggaagctagagcttcccccgaaatgagcgaccggatccagcacctcgaacgcgagatcacacgatataaggacgaaagctcaaaggcccaagccgaagtggatcgcctgctcgaaatcttgaaggaagtcgagaatgagaagaacgataaggacaagaaaatcgctgagttggagcggcaagttaaggaccagaacaagaaggtggcaaacctgaagcataaggagcaggtcgagaagaagaagagcgcgcagatgctggaagaagcgaggagaagagaagacaacctgaatgactcctcccagcagctccaagacagcttacggaaaaaggatgaccgcattgaggaactggaggaggcacttagggagtcagtccagatcacagctgagcgagagatggtcttagctcaggaggagagcgccagaacaaacgccgaaaaacaggtcgaggagctgttaatggccatggaaaaggtcaagcaggaattagagagtatgaaggccaagttgtcctcaacacagcagagtctggcagaaaaagagacccacctgacaaacctccgggctgagcgacggaaacacttggaggaagtcctcgagatgaaacaggaggcgcttctggccgctattagcgaaaaagatgcaaacattgctctgctggaactctcttcctccaagaaaaaaacccaggaggaggttgccgctcttaagcgagaaaaggacagactggttcagcagttaaagcagcaaactcagaataggatgaagctcatggcagataattacgaagacgaccacttcaagtccagccattccaatcaaacaaaccacaagccaagccctgaccagatcattcaaccattgttagagctcgatcagaacaggtcaaagctgaagctgtacattgggcatctgacaactctatgtcatgatagagatcctctgatcctacgcggactaacccctcctgcctcatataacttggacgatgaccaggcagcctgggaaaatgaattgcagaaaatgactcgaggccagctgcaggatgagctggagaagggcgagagggacaatgctgaactgcaggagttcgcaaatgccatcctgcaacagattgctgaccactgtcctgatatattagagcaggtagtgaacgcactggaggaaagctcatag

SEQ ID NO: 31486 - DNA, 1485 bp, Artificial Sequence
  Description of Artificial Sequence: Synthetic coding sequence
atgaaattagttaacctctataagggtgccgtgctgtacctgcttagaggtcggaagaccttcctgataccagtgcttttcaataattatataactgctgcacttaaacttctcgaaaagttgtacaaggtcaatttgaaagtcaaacatgtcgagtacgataccttttacatcccagagatttccaacttggttgacattcaggaggattatttaatgtggtttttgcaccaggccggaatgaaggccagaccctctatcatacaggacacagtgacattatgttcctatccttttatatttgacgcccaggctaagactaaaatgttgcagacagatgctgaattacagatgcaggtggccgtcaacggcgctaatctgcagaacgtgttcatgctactgaccctggaacctttgctggcgaggagccctttcctggtgctacatgtgcgtagaaataatctcgtgggcgatgcactccgcgagcttagcatccactctgacatcgacttaaaaaaaccgcttaaagtcattttcgatggcgaggaggccgtggatgctggcggtgtgaccaaggagttcttcttgctgcttctgaaagagcttttgaaccccatctacggaatgtttacttattaccaagattcaaatttactgtggttttccgacacatgcttcgtagagcacaactggtttcacctgattggcataacttgtggattggcaatttataacagcacagttgttgacctccattttcctctggcgctgtacaagaagcttctaaatgtaaaaccaggtttggaagacctgaaagagctttcgcccaccgaaggtcgtagtctccaggaactcctggattaccccggtgaagacgtcgaggaaacattctgtctgaactttactatttgccgcgagtcttacggggtcattgaacaaaaaaaactcatccctggaggtgacaatgtgacagtgtgcaaagacaatcggcaagagtttgtggatgcatacgtgaactatgtttttcagatctcggtacacgaatggtatacagctttttcatcagggttcctcaaggtgtgtgggggaaaggtgctagagctgttccagccatctgagctgagggccatgatggtcgggaattcaaactataactgggaggagttggaggaaacagccatatacaagggggactattccgccacccatccaaccgttaagttgttttgggaaacattccacgagtttccattggaaaaaaagaagaagttcttattatttctcactggaagcgatagaatacctatttatggaatggctagcctgcagatcgtaatccagagcacagcatcaggagaagagtacctgccagtcgcccatacttgttataaccttcttgatctgccaaagtacagctccaaagaaatcctgtctgctcgactcacacaggctctcgataattatgaaggcttcagcttggcttag

SEQ ID NO: 31487 - DNA, 2370 bp, Artificial Sequence
  Description of Artificial Sequence: Synthetic coding sequence
atgtgtcctagtagtcagtcccccaggcctccactgctgcgtcctccgtgcagttaccgagaggtcccttcatctgtacagtcccccgcacagcagcaggtgccggctcggcctggagctcctagcgtgcaagttccctcaccatttcttctccagaaccagtatgagccagtgcaacctcactggttttactgcaaagaggtggagtacaagcaactgtggatgcccttctcagtctttgatagcctcaacctggaggaaatttataactccgttcaaccggatcccgagagtgtggtcctggggaccgatggaggtaggtatgacgtgtacctgtacgacagaatacggaaagccgcatactgggaggaggagcccgcagaggtgcgcagatgcacttggttttacaagggggacacagactctcgcttcatcccctacacggaagagttctcagagaagttggaagcggagtataagaaggccgttaccacaaatcaatggcaccgccgactggaattccctagtggggaaacaatcgtcatgcacaatcccaaggtgatagtccaatttcagcctagttcggtacccgatgaatggggcacaacccaggatggccagacaagacccagagtggtcaaacggggtatagacgataacctcgatgagatcccagacggggagatgccgcaggtcgatcatctagttttcgtggtgcacgggatcggtcccgtttgtgacctgcgattccgctctattattgaatgcgtggatgattttcgcgtagtatccctcaagttgctgagaacccacttcaaaaaatctttggacgatggcaaagtgagcagggtggagttcctgcctgttcattggcattcttctctggggggagacgcgaccggggtagacaggaatataaaaaaaattactctgccgtccatcgggcgattccgccacttcacgaatgagacactattagacatactattttacaactcccctacatactgccaaacaattgtggaaaaggtgggtatggagatcaatcatctgcacgctctgttcatgagtagaaaccctgacttcaaggggggagtatccgtggctggccactctctggggagcctcatactgtttgatattctttctaaccagaaagacctaaacctaagcaagtgcccagggcctttagcagtggctaacggagttgtgaaacagttgcatttccaagagaagcagatgcctgaggagccaaaactgacacttgatgaatcttatgacctagttgtcgaaaacaaagaggtgctgactctacaggaaacactcgaagcattgtccctgtcggaatatttttcaacctttgaaaaggagaagatcgatatggagtccctgctgatgtgtacagtggatgacctgaaagagatgggcatacctctaggaccgagaaagaaaattgctaatttcgtcgaacacaaagcagccaaattaaaaaaagccgcatctgagaagaaagccgtcgcagctacgtccaccaaggggcaggagcaatcagcccagaaaacaaaggacatggcctcgctgccatctgaaagcaacgaacccaaaagaaagctacccgtgggagcatgcgtgtcgtccgtgtgtgtgaactacgagagctttgaggtgggcgctggccaggtttctgttgcatacaacagtcttgactttgaacctgagatcttcttcgcgctgggctcacccattgcaatgttcctcaccatacgcggtgtagaccgaatagatgaaaattattccctgccaacttgcaaaggcttctttaacatttatcatcctttggatcctgtggcttataggctggagccgatgatcgtcccggatctggatctgaaagcagtgctgatcccacaccacaaaggcagaaaaagacttcacctggagttgaaggaatccctgtctcgcatgggatctgatctgaaacaaggcttcatctcttcactgaaaagcgcgtggcagacactgaatgaatttgctagagctcataccagcagcacccagctccaggaggaattggaaaaggtcgccaatcagatcaaggaggaagaggagaaacaggttgtggaagccgagaaggtcgtggagtcccctgatttctcaaaggatgaggactacctggggaaagtcggcatgctgaatggtggccgtcgtattgattatgtactgcaggaaaaaccaattgagagctttaacgagtacttatttgcccttcagagccacctgtgttactgggaaagtgaagacactgcacttcttttgctgaaggaaatttatcgtactatgaacatcagccccgaacagccccagcactag

SEQ ID NO: 31488 - DNA, 828 bp, Artificial Sequence
  Description of Artificial Sequence: Synthetic coding sequence
atgtccgcagaggtcaaagtgaccggacaaaatcaagagcagttcctgctgctcgcgaagtcagccaagggggctgctcttgccactttgatacaccaggttctggaagcccctggagtgtacgtctttggggagctgctcgatatgccaaacgtaagggagctggccgaaagtgactttgcaagcacctttaggttgctgacagtgtttgcctacggcacttatgctgactacctcgccgaagcaaggaacttgccaccattgacagaggcacagaagaacaagctacgccatttgtccgtggtcacactggccgcaaaagttaaatgtattccatacgccgtgttgctcgaagctcttgcactccgcaatgtgcggcaactcgaggacctcgtaatcgaagctgtgtacgccgatgtgctccggggtagtctggatcaacgtaatcaaagattagaggttgactacagcattggcagagatatccaacggcaggaccttagcgccattgccaggactctgcaggagtggtgtgtggggtgcgaagttgtgctgagcgggattgaggaacaagtttcccgggctaatcaacacaaagaacagcagctagggttgaaacagcagattgagagcgaagtggcaaacctgaagaaaacaatcaaggtgaccaccgccgctgcggctgctgcgacatcccaggaccccgaacaacatctaaccgagttaagggagcccgctccaggcactaaccagagacagccctcaaaaaaagcctctaaagggaagggactgcgaggctctgccaagatctggagcaagtccaattag

SEQ ID NO: 31489 - DNA, 240 bp, Artificial Sequence
  Description of Artificial Sequence: Synthetic coding sequence
atgaacggcacactcgatcaccctgaccagccagacctagacgcgattaagatgttcgttgggcaggtgcccagaacctggtcggaaaaagacctgagagagctgttcgagcaatacggagccgtatatgagatcaacgtgctacgggaccgctcccagaaccctccacaatctaaaggatgctgttttgtgaccttctatacaaggaaggctgctttggaggcccaaaatgctttgtag

SEQ ID NO: 31490 - DNA, 738 bp, Artificial Sequence
  Description of Artificial Sequence: Synthetic coding sequence
atggttctcttgcatgtaaaaaggggagacgagtctcagttcctgctgcaggccccaggcagcactgagctcgaagaactgaccgtgcaggtggcacgcgtttacaatgggaggctcaaggtgcaacgtctgtgcagtgagatggaagagctggcagagcatggcatttttctgccacccaatatgcagggcctcaccgacgatcagattgaagagcttaagctcaaggatgaatggggagagaaatgcgtaccgagcggtggcgcagttttcaaaaaggatgacataggcagacgaaacggccaagcaccaaatgaaaagatgaaacaagtgctgaaaaaaacaatcgaggaggcaaaggcaataatttctaaaaaacaggtagaggctggtgtgtgcgttacaatggaaatggttaaggacgccctcgatcagcttcgaggcgcagtgatgattgtatacccaatgggactgccgccttatgatcctattaggatggagttcgaaaacaaagaggacctgagtgggactcaagccggattgaatgttatcaaagaagcagaagcccaattgtggtgggccgcaaaagagctgcgcagaacgaagaagctttcagactacgtgggtaagaacgagaaaacgaagataatcgccaaaatacagcaggtgtcaacattttgcttcaacgtgtctgtagtgttcgtgatcagtctgcagaccgacaagaacgtgcaatag

SEQ ID NO: 31491 - DNA, 396 bp, Artificial Sequence
  Description of Artificial Sequence: Synthetic coding sequence
atggctatgaccgcaggaaccacaactacattcccgatgtccaatcacaccagagaacgtgtgacagtagctaaattaacccttgagaatttctactcaaacctgatcctccagcatgaggagcgagagaccaggcagaaaaaattggaagtggctatggaagaagaggggctggctgacgaagagaagaagctgaggaggtctcaacacgccaggaaagaaacagagttcctgaggctaaagaggactcgcctcggtttggatgatttcgagagcctaaaagtaatcggcagaggggcattcggagaagtgcggttggtgcaaaaaaaagataccgggcatatatatgccatgaagattctgcggaagtcagatatgttagaaaaagagcagtag

SEQ ID NO: 31492 - DNA, 2517 bp, Artificial Sequence
  Description of Artificial Sequence: Synthetic coding sequence
atgaccggagccgaaatcgaaccatctgcacaggcaaagcctgaaaagaaagcaggagaggaggtgattgctggacccgagagagaaaacgatgtaccattggtggtccgaccaaaggtccgcacacaagctaccacaggcgctcggcctaaaaccgaaacgaagtcagtccctgctgccagaccaaaaactgaggcgcaggcgatgagtggggctcgcccaaagactgaggttcaagttatggggggtgcccgtccaaagactgaagctcaaggtataaccggggctcgccctaaaacagacgccagggccgtcggaggagcacgatcaaagacggatgcgaaggccatcccaggagccaggccaaaagatgaggcccaggcttgggctcaatcagagttcggcactgaggcggtgtcccaggcagaaggagtgtcccagactaatgcggttgcctggcccctggccactgcagagtccggctctgtgactaagagtaaaggcctgtcaatggacagagaattggttaatgttgatgcggaaaccttccctggaacacagggacaaaaaggcattcagccttggttcggccctggagaggagactaacatggggtcttggtgttactcaaggcctagagcaagggaggaggcctccaatgagagcggcttctggagcgcagatgaaactagcaccgcttccagtttctggaccggcgaagaaacctccgttaggtcttggcccagagaggaatcaaacacgcgatcacggcacagagcgaagcatcagaccaaccccagaagtcggccaagaagcaaacaggaagcatatgtggactcatggtccggatccgaggatgaagcctcaaaccccttctcgttttgggtcggggagaataccaataacctcttccgtccacgggtccgcgaggaggcaaacattaggtcaaagctgcggaccaatcgggaggattgcttcgaaagcgagtctgaagatgagttctacaaacagtcttgggtcctccccggagaagaggcaaattcccggtttagacaccgagacaaggaggatcctaacacggcgctgaagctgcgggctcagaaggatgtggatagcgaccgggtgaaacaggagcctaggttcgaggaagaggtgatcattgggagctggttttgggccgagaaagaagccagcctggaaggaggagcttccgcgatttgcgaatcggagccagggactgaagagggcgcaatcggcggaagtgcttactgggcagaggagaaatcatctcttggcgctgtggccagagaggaggccaagcccgaaagtgaggaagaggccatcttcggctcctggttttgggaccgggatgaggcttgttttgatctgaatccttgccccgtatacaaggtgtctgaccgtttccgggacgccgcagaagaattaaacgcctcttccagaccccaaacatgggatgaagtgaccgtcgaattcaaaccaggcctgttccacggtgtcggttttcggtccacttctcccttcgggatacctgaagaggcctctgaaatgctggaagccaaaccaaagaatctggaattaagtcccgaaggcgaggaacaggaatctttgctccagccagatcaaccctcccctgaatttactttccagtacgacccatcttacaggtctgtgcgggagatccgagaacacctgcgagcccgtgagtccgctgaatctgagagttggagttgctcttgcatccaatgtgaactgaaaataggctccgaagaatttgaagagttcctgctgctaatggacaaaatccgcgacccatttatacatgaaatctctaaaattgcaatgggaatgcggtccgctagtcaatttactcgcgattttatacgggatagcggcgtggtctccctgatcgagacactgttgaactacccatccagccgcgtaaggacgtcatttctagagaatatgatccatatggcaccgccatatcctaacttgaacatgatcgagacattcatctgtcaggtatgcgaggaaacactggctcattctgtggatagtttggaacagctgaccggcatccgcatgctgcgccatttgactatgaccatagattaccacaccctcattgctaactatatgtccggattcctgtcgctcctcaccacagccaacgcaagaacaaagttccacgtgttgaagatgcttttaaacttaagcgagaatccggctgtggctaagaaattattctcagccaaagccctgtctatattcgttgggctctttaacattgaggagacaaacgacaatattcagatcgttatcaagatgtttcagaatatcagcaacataatcaagtctggcaaaatgtcactgattgacgacgatttttctttggaacctctcattagcgcatttagagaatttgaagaactcgccaaacaattgcaggctcagattgacaatcagaacgaccccgaagtagggcagcaaagctag

SEQ ID NO: 31493 - DNA, 1215 bp, Artificial Sequence
  Description of Artificial Sequence: Synthetic coding sequence
atggacttcaatatgaaaaaacttgccagcgacgctggaattttttttacacgggcagttcagtttactgaagagaaattcggccaggccgagaaaactgaacttgatgcacattttgaaaacctgctggctcgcgcagattctacaaaaaactggaccgaaaagattcttagacaaaccgaggtactgctacagccaaatccttccgcccgagtggaagaatttctgtatgagaagctcgatcgaaaggtcccctcaagagttactaacggcgagttattagcccaatatatggccgacgctgcttctgagctgggaccaacaaccccctacggcaagacacttatcaaggtggccgaagccgagaagcagctgggcgcagcagaacgggatttcatccacaccgcaagtatctctttcctgacgccgctgcgcaactttcttgagggggactggaagaccatcagcaaagagcggaggctgctgcagaatagaagactcgatctcgatgcctgtaaggcacgcctaaaaaaggccaaggcagccgaagcgaaagctaccgcagaggggccaacagtccccgactttcaagaaacgcgcccacgcaattacattctgagcgcatcagcctctgccctgtggaatgatgaagttgataaggcagagcaggagctgcgggtggctcagacggaatttgacagacaggcggaagtgactcgcttgttattggagggtattagttcaacccatgtgaaccacctcaggtgcctccacgagtttgtcaaaagccagactacttactacgcccagtgctatagacacatgctggatctacagaaacagcttgggtcttcccagggcgctatctttccaggtacgttcgtaggcactacagagcccgcatcaccccctttatcgagcacatcccctactactgccgctgcgaccatgccagtcgtgcctagcgtggcttcccttgcgccacccggtgaggcaagtttatgcctggaggaagtagcaccacccgcaagcggtacgaggaaagctcgggtgctctatgactacgaggcagctgattctagtgagttggccttactcgccgacgaacttattactgtgtacagtctcccaggcatggatcccgactggctcatcggggagaggggcaacaaaaagggcaaagtcccggtgacctatctggagctgctgtcatag

SEQ ID NO: 31494 - DNA, 495 bp, Artificial Sequence
  Description of Artificial Sequence: Synthetic coding sequence
atgacatgctgccagacaagcttctgcggctacccatcgttcagcattagcgggacttgtggaagttcgtgctgtcagcctagttgctgcgagacctcgtgttgccaacctcgaagctgtcagacctcgttctgcggatttccaagtttttctacctcgggcacctgctcatcatcttgttgccagcctagctgctgtgagaccagctgttgtcagcccagctgctgccagatatccagttgtggaacaggctgcggcattggtggcggtatttcgtacggtcaggaagggtcctctggcgctgtgagcacacggatcaggtggtgtaggcccgactctcgagtggagggcacatacctgccgccatgctgcgttgtgagctgcacaccaccatcatgttgccaattgcatcacgcccaagcatcctgttgtcggccttcatattgtgggcagtcctgctgtagacctgtttgctgttgtgagccaacgtgctag

SEQ ID NO: 31495 - DNA, 846 bp, Artificial Sequence
  Description of Artificial Sequence: Synthetic coding sequence
atgctgacaaagctccaaatcaagcagatgatggaggcggctacccgacagatagaagaacgtaagaaacaacttagctttatttcccccccaactccccagcccaagacgccttcttcttcccagccggaacggttaccgatcggaaataccatccagccttcccaggctgccacattcatgaatgatgccatcgaaaaagcaagaaaagcagcggagctccaggcacgaatacaggctcaactggccctgaaacccggtctgattgggaacgctaacatggtagggctcgcaaacttacacgctatgggcattgccccacccaaagtcgagctgaaagatcaaacgaagcctaccccattgatcctggacgaacaggggaggacagtggatgccacaggcaaggaaattgagctgacacatcggatgccaaccttgaaagctaacattcgcgctgtcaaaagagaacagtttaagcagcagctgaaagaaaaaccaagtgaggatatggagagcaatacgttttttgacccaagagtctccatcgcaccaagtcagcgccagcggcgaaccttcaagtttcatgataagggcaaatttgagaaaattgcacagaggctaagaacaaaggcacaacttgaaaagctgcaggctgagatcagtcaggcagctcgaaagacagggatccacacgagtaccaggctggccttgatcgcaccaaaaaaagagctcaaggaaggagatataccagaaattgaatggtgggacagttacatcatcccaaatggatttgacttaggcaagtcacaggaacgtagactgttttggaatcataagtcctgctag

SEQ ID NO: 31496 - DNA, 693 bp, Artificial Sequence
  Description of Artificial Sequence: Synthetic coding sequence
atgcggggacacgagtcttccgtgttctctatatccgtgcacgcctccggaaagtatgctattactacatcaagcgacacagctcagctgtgggatctcgatacttttcagcgtaagcggaagcttaatattaggcaatccgtgggtatccagaaagtgttctttctgccactgtccaatacaatcttatcttgctttaaagacaattcaatctttgcttgggaatgtgatactctcttttgtaaataccagcttcctgcccctcccgaatcaagctcgattttgtataaggtgttcgcagtaaccagggacgggaggatactggccgcaggaggcaaatcaaaccatctccatctgtggtgcctggaggctcggcagctattccgaattatccagatgcccaccaaagtacgagccatcagacatcttgagtttctccctgacagttttgacgccggaagtaatcaggtgctgggggttctctcacaagacggcatcatgagatttatcaatatgcaaacttgcaaactgctctttgagatcggaagcctcgatgagggtatctcttcttcggccattagtccccacgggagatacattgcaagcataatggagaacggtagcctcaatatctactccgtgcaagctcttacccaagaaatcaataaggaagaagtccgcgcacagaattag

SEQ ID NO: 31497 - DNA, 1212 bp, Artificial Sequence
  Description of Artificial Sequence: Synthetic coding sequence
atggactcaacaatggacgatgccgtggctggagattttgctctgattaataagctggacatacagtgtgacctgaagacactttcagatgatatcaaggagagcctggagtccgaaggcaaaaattcaaagaaagaggaaccccaagagctgctccaatcacaagattttgtcggagagaaattgggctcgggtgaacctagtcatagtgtgaaagttcacacggtccccaagcccggaaagggcgcagatctgtcaaagcccccttgtaggaaagcaaaagaaattcgtaaggaaaggaaaagactcaagctaatgcagcaaaatcctgctggcgagctggagggattccaggcccaaggacaccccccatctctttttccgcctaaggccaaatccaatcagcctaagagccttgaggatctcatattcgagtcactgcctgaaaatgctagccacaaacttgaggtgcgcgtggtacgaagctctcctccctcttctcagtttaaagcgaccctactggaatcctaccaggtatacaaacggtaccagatggtgatccataaaaacccccctgacacacccactgaatcccagtttacgcgcttcttgtgctcttccccactcgaggccgagacacctcctaatggcccagactgtggttacggatcctttcatcagcaatattggctggatgggaagattatcgctgtaggcgtgattgacattctgccgaactgtgtttcatctgtttatctatattacgacccggattactcctttctgagtctcggcgtgtatagtgcgttgcgggagatagccttcactaggcagctgcatgaaaagacttcccagctttcttattattacatggggttctatatacacagttgtcctaaaatgaaatacaaaggccagtaccgcccatcagatttactgtgtcccgagacctacgtgtgggtgcctatagagcaatgcttacccagccttgaaaactccaaatactgtcgatttaatcaggatcctgaagcagtggatgaggacaggagcacagaacctgataggctccaggtgtttcacaagcgggctatcatgccttatggcgtatacaagaagcagcagaaagatcccagtgaggaagctgcagtgctgcaatacgccagtctggtggggcaaaagtgctctgaacgtatgctactcttccgcaactag

SEQ ID NO: 31498 - DNA, 909 bp, Artificial Sequence
  Description of Artificial Sequence: Synthetic coding sequence
atgccactatacgagggcttaggctccggtggagaaaagacggctgtggtcatcgaccttggtgaggctttcacaaagtgcgggttcgccggtgagactggtccaagatgtatcattcccagcgtgatcaaaagggcagggatgcccaaaccggtaagagtggttcaatacaacattaacactgaggagctttattcctatctgaaggagttcatccatatcctgtattttcgccacctccttgtgaatccacgagatcgcagggtggttatcatcgagtccgtcttgtgcccttcccacttcagggagacactgacccgggttctgttcaagtactttgaggtgccttctgtgcttttggcgcctagtcacctcatggccctactgactctgggtataaacagcgcaatggtgttggactgcgggtacagggaaagtctggtcctcccaatatatgaagggatccctgttctgaattgttggggcgctctgcctctcggtggcaaagccttacacaaggaactggaaactcagctgctcgagcagtgtaccgttgatacgtccgtggcaaaggagcagagtctgccgagcgtgatgggaagcgtacctgagggtgttctagaggacattaaggctcggacctgctttgtcagtgacctgaaacggggattaaagatccaggctgctaagtttaatatcgatggtaacaacgagcgaccgtctcctccacctaatgtagattatccattagacggcgagaaaatcctgcacatcttgggatcaatcagggactccgtggtggagatcttgtttgaacaggacaatgaggagcagtctgtggccaccctgattctggattccctgattcagtgttgttcatgctgccctggatggtcagctatggcctag

SEQ ID NO: 31499 - DNA, 378 bp, Artificial Sequence
  Description of Artificial Sequence: Synthetic coding sequence
atgtcctcctgtgtaagtagccagccatccagcaacagagccgcacctcaggatgagctcggcggaaggggtagcagcagctcagagagtcagaaaccctgtgaggctcttcgtggtctttcaagtctcagcatccatctgggcatggaatccttcattgtggtgacagaatgtgagccagggtgtgcagtggacctcgggctagctcgagatcgacctctggaagccgacggtcaggaagtgcctctcgatacttccgggagtcaagctcgcccacacctcagcggaagaaaactttcactgcaggagcggagtcaggggggactcgccgctggcggttccctcgacatgaacggaaggtgtatatgtccatcctag

SEQ ID NO: 31500 - DNA, 1161 bp, Artificial Sequence
  Description of Artificial Sequence: Synthetic coding sequence
atggcggactcactggaatctaccccccttccaagcccagaggacaggttggccaaattgcaccctagcaaggagttgcttgagtattatcagaaaaaaatggccgaatgcgaggcggagaacgaagatctccttaagaaactggagctgtacaaagaggcctgcgaaggtcagcacaagctcgaatgcgacctacagcaaagagaagaggaaattgctgagctccagaaggccctgtcagatatgcaggtgtgtcttttccaagagcgggaacacgtgctgcggctgtactccgagaatgaccggctgaggatccgtgaattggaagacaagaagaaaatacaaaacttactcgctctggtcggcacggatgctggcgaagtgacttacttctgtaaagagccacctcacaaagtcaccatcctgcagaaaactatccaggctgtgggggagtgtgagcagtccgagtcaagtgcattcaaagcagacccaaaaatctcgaagcgcagaccttcaagagaacgaaaggagtcttccgaacactaccaacgcgatattcagacactcatactgcaagtggaggcactccaggcccagctcggcgaacaaaccaagctgagtcgcgaacagattgaaggactgattgaagaccggcgaatacatctggaagaaatacaggtccagcaccagcggaatcagaacaagataaaggagcttaccaagaacttgcaccacacacaggaacttctttatgaatccactaaggactttctacagctgcggagcgagaaccagaataaagagaagtcctggatgctggaaaaggataatttgatgagtaagataaagcaatacagagttcagtgtaaaaagaaggaggacaagataggaaaggtgcttcccgtgatgcatgaatcccaccatgctcaaagtgagtatatcaaaagccttaaggataaacttgtacaggagaaaaaactatccaatatgtatcaggagcagtgcattagcctggaagaggagttggcgagaattagggaagaggagggtatgagacgtgaaattttcaaagaccgaacaaacaaaatgggaaaaaggcttcagatcatgacaaagcggtacgaggccttagagaggcggaggatccttgaggttgaatag

SEQ ID NO: 31501 - DNA, 999 bp, Artificial Sequence
  Description of Artificial Sequence: Synthetic coding sequence
atggagtacctcggagggggtagtgctcttgacctgttaaagcccggtcccctcgaagagacatacatcgccaccattttacgcgagatcctgaaggggctggactatctgcactctgagagaaagattcatcgcgacataaaggccgcaaatgtgctcctgagtgagcagggcgatgtcaagcttgcagacttcggggtggctggtcagctgacagacactcaaatcaagcgcaacacctttgtcggcacgccattctggatggcccctgaggtgattaagcagagtgcctacgattttaaggccgacatctggtcccttggaataaccgcaatcgaattggcaaagggagaaccccctaattccgacttgcacccaatgagagtgctctttctgataccaaagaatagtcctccaaccctggagggacaacactctaagccattcaaggaattcgtggaagcatgtctaaataaggatcctagattcagaccaactgccaaggagttactgaagcataagttcatcacaaggtatactaagaagaccagttttctcactgaattgatcgacaggtataaacgatggaagtccgaaggccatggcgaggagtcatcctccgaagattccgacatagatggagaagcagaagacggagagcagggccctatctggacttttcctcctaccatccgcccaagtcctcatagcaagctgcataaagggaccgccctgcatagctctcaaaaacccgctgagccagtaaaacgacagcctaggagtcagtgcttgagtaccttggtgaggccagtttttggcgagcttaaagagaaacataaacagtccgggggatctgtcggggctctggaggagctagagaacgccttttcgctggcagaggaatcctgccctggtatttctgataagctgatggtgcacttggttgaacgggtccagcgtttttcacacaatagaaatcacctgacaagcaccaggtag

SEQ ID NO: 31502 - DNA, 1524 bp, Artificial Sequence
  Description of Artificial Sequence: Synthetic coding sequence
atggaagaggtggaacggcaagtccttcctgatcccgaggtactcgaggcagttggcgatcggcaggacgggctgagagagcagcttcaagcccctgtcccaccagactccgtgccaagtttacaaaatatgggcttactgctcgataagctggccaaggagaatcaagatattcggttgttgcaggctcagctgcaggcccagaaggaagaacttcagtcactcatgcatcagcccaaggggctggaggaagaaaacgcacaactcagaggggctctacagcagggcgaggcttttcagcgggctctcgaaagtgagctgcagcaactcagagcacggctgcagggcctggaagccgactgcgtgcggggacctgacggtgtctgcctcagcgggggtagaggccctcagggcgacaaggcaatcagggaacaggggccacgtgagcaggagccagagctgtctttcctcaagcagaaggaacagctcgaggcagaagcacaagccctacgtcaagaattggagcggcagagacgactcctggggtccgtgcagcaggatcttgagcggtcattgcaggatgcgtcgcggggagatccggcacatgctggactggctgaactaggccaccgacttgcacagaagctccagggtcttgagaactggggccaagacccgggagtctccgccaatgcatcgaaggcttggcaccaaaagtctcatttccagaatagcagagagtggtctggaaaggaaaaatggtgggacgggcagcgggaccgtaaggccgagcactggaagcacaaaaaggaagagtcagggagggaacggaagaaaaactggggaggacaggaggacagagagccggcaggacggtggaaggaagggaggccccgtgttgaggagtcaggcagtaaaaaagagggaaagcgacagggccctaaggagccacccaggaagagcggcagcttccacagcagtggggagaaacaaaagcagccgagatggagggagggcacgaaggattcccacgacccactgccctcctgggctgagctgttgcgacctaagtacagggccccacaaggatgctctggcgtggacgaatgcgccagacaagaaggcctaacattctttgggaccgaactcgcaccggtgaggcagcaggaacttgcatcactcctccggacttatttggccagactgccctgggctgggcagctcactaaagagctgcctctgtctcctgccttcttcggcgaggacggcatatttcggcacgatagacttcggtttcgcgacttcgtcgacgcactggaggacagtctggaggaggtcgctgtgcagcagaccggtgatgacgacgaagtcgatgatttcgaagatttcattttctcccattttttcggggataaggcgctgaagaagcgcagtggcaagaaagataaacactcccaaagtccgcgagctgccggacctagggagggacacagccatagtcatcaccaccaccaccgtggttag

SEQ ID NO: 31503 - DNA, 2472 bp, Artificial Sequence
  Description of Artificial Sequence: Synthetic coding sequence
atgactcttctaagttctcaatccagctcactggtggccccaagcggctctgtgtccgctgaaaatccagaacagaggatgctagagaagagggctaaggtgatcgaggaactgctccagactgagagagactatataagggatctcgagatgtgtatcgagcggattatggtgccaatgcagcaggcacaggtccctaacatagatttcgaagggctattcggtaacatgcagatggtgattaaggtgtctaagcaactcctcgcggcactggagattagcgatgctgtcggacccgtctttttgggccaccgcgacgagctggaggggacttacaaaatttattgtcagaaccacgacgaggccattgctctgctggagatttacgagaaggatgagaagatccaaaaacacctccaggactcactggcagacttaaaatcgttgtataatgaatggggatgcactaactacattaacctaggcagcttcctgatcaaacctgtgcagcgagtgatgagatacccccttctactgatggagctgctgaacagtacccctgaatctcatcccgacaaggtgcccttaacgaatgcagtgcttgcggtcaaagagatcaatgttaatatcaacgagtataagaggaggaaagatctggtgcttaagtacagaaaaggggatgaagactccctcatggagaagatcagcaagctcaatattcacagcattattaaaaaatccaacagggtgtccagtcacctcaaacacctgacggggtttgcacctcagatcaaggacgaggtctttgaagagaccgaaaaaaactttagaatgcaggaaagacttataaaaagctttatcagggacctctccttatatctacagcacatacgagagagcgcttgtgtcaaggtggtggccgcagttagtatgtgggatgtatgtatggagcgcggtcatagggatttagagcagttcgagcgcgttcatcggtacatatcagaccagttatttactaacttcaaggagaggaccgaaagactcgttatctctccattgaatcagctgctgtctatgttcaccggtccccacaaactcgtccagaaacgattcgacaaacttctggatttttataattgtaccgaaagagccgaaaagttgaaagacaaaaaaaccttggaagagttacagtccgctcgcaacaactacgaggcactgaatgcccagttactggatgagctgcccaaattccatcagtatgctcagggcctgtttaccaactgcgtccacgggtatgccgaggctcactgtgattttgttcaccaagctctggagcaacttaaaccgttgctgagcttgctcaaagtagcgggtcgcgaggggaatcttattgctatttttcacgaggaacactctcgagtgctgcaacaactgcaggtatttacatttttcccggagtctttaccggcaactaagaagccctttgaacggaaaactattgatcggcaatccgcaaggaaaccgcttctaggcctgccatcctacatgctgcagtcagaggaattgcgggcatcccttctggcacgctacccacctgaaaagctcttccaggccgagagaaattttaatgctgcccaggatctggacgtgtctctgctggagggagaccttgttggagtaatcaaaaagaaagatccgatgggctcgcagaacaggtggctgatcgataatggagtgacgaaaggcttcgtttatagctctttcctcaagccatacaacccaaggagaagccacagtgatgcctctgtgggaagccattcaagtaccgaatccgagcatggcagtagttcccccagattcccgaggcaaaattccgggtcgactctgacattcaatccatctagtatggcggtgtctttcaccagcggaagctgtcagaagcagccacaggacgcctccccaccacccaaggaatgtgatcaaggaaccttgagcgcttctctgaatccatccaacagcgagtccagtcctagccggtgccctagtgatccagacagcacatcacagccaagatccggagactccgccgacgtggctcgggatgtcaaacagcctacagcaactccaagatcgtatcggaacttccggcaccccgaaatcgtgggctactccgtccccggacggaacggacagtcccaggacctggtgaagggttgtgccaggactgcgcaggcaccggaagaccgaagcacagaaccagatggaagcgaggccgagggcaatcaagtgtactttgccgtatacacgttcaaagctcggaatcccaacgaactgtctgtgtccgccaaccaaaaattgaaaatccttgagtttaaggatgttacagggaatacagaatggtggctggccgaagtgaacggtaaaaaggggtatgttcctagcaattatattcgtaagacagaatacacttag

SEQ ID NO: 31504 - DNA, 492 bp, Artificial Sequence
  Description of Artificial Sequence: Synthetic coding sequence
taggataagtttcgcgcttctcccgattgcattacgatattatgtaagcccaacggacaggcgatcgcgtggtacacgcccatccattggaagcaggcttgggagaaactcgatgccgatgtcgaattcaatagatgtagcgtggtcagtcctacatttcggaaacgcgtcttccagtggaccgcctctaccgctacaattactaaggaaaagcaggatcagccaaaaaaagacatctccaattaccaggttgaacaggcacaggtgcttctgaaacgggaaaaggagattccacctacagtgtttcctaatcggagcccttggtgccaaaacccctacgtgtccgcacacccatactgcccactgatcgaaccacataacaccagcaccgctgggggaagactggaccggcagccacgtacaaggtctacgcgacctaaccgggcttctggaagcaagaaaaaaaagacctccgagtctcagaagcagtag

SEQ ID NO: 31505 - DNA, 771 bp, Artificial Sequence
  Description of Artificial Sequence: Synthetic coding sequence
atggccacgcagagaaaacacctggttaaggactttaatccgtatatcacttgctatatttgtaaaggttacttaataaaaccaaccacagttacagagtgtctgcacacgttctgcaagacatgcatcgttcagcacttcgaggatagcaatgactgcccaagatgcggaaatcaggtgcatgagacaaaccccctagaaatgctgagactagataatacgttagaggagatcatcttcaagctggtgcctggattgagagaacaggaattagagcgcgaatctgaattctggaaaaagaacaagccacaggaaaatgggcaggatgacacatccaaggcggataagcccaaggtggatgaagagggcgacgagaacgaggatgacaaagactatcaccgctctgaccctcagatcgccatttgtctggattgtctccggaataatggtcagtcaggtgacaatgtggttaaaggcctaatgaagaagttcattcgatgtagcacacgcgtcacagtcggaaccataaagaagttcctgagcctgaagttgaagttgccttccagctacgaactagacgtgttgtgcaacggggagatcatgggtaaggaccacaccatggagtttatctacatgactagatggcggctgcgcggagaaaattttcggtgcttgaactgctcggcaagtcaggtttgttcccaggatggccctctctaccagtcttacccaatggtgctgcagtaccgacctcgtatagatttcggctag

SEQ ID NO: 31506 - DNA, 2793 bp, Artificial Sequence
  Description of Artificial Sequence: Synthetic coding sequence
atgtctgaatttcgtatccatcacgacgtcaatgaactcctctccctgctcagagtacacgggggtgatggggcagaggtttacatcgatctcctgcagaagaaccggacgccgtacgtcacgactaccgtgtcagcacacagtgcaaaggtaaagatcgctgaattctcacgtacccccgaggacttcctcaaaaaatacgatgaacttaagtccaagaatacccgtaatctggatcccctcgtgtacttgcttagcaaattaactgaggacaaggagacgctccagtacctccaacaaaacgctaaggaaagggcagagctcgctgctgccgctgtgggtagcagtaccacttccattaacgtgcccgctgctgctagtaagatatccatgcaggaactggaagaactgcgcaagcaactcggttcagttgcaacaggcagtacactgcaacagtccctggagctgaaaagaaaaatgctgcgtgataaacaaaataaaaagaattctggtcagcatctgccaatatttcccgcttgggtttacgagagacccgcactaataggggacttcttgattggtgctggcatcagtaccgacacagcactgcctattgtgttgctgagatggaacctggcattgtccccccgacttaagtgttccggcgtgattagtgctcattgtaatctacacttaccaggaacgcttcccctcgctagtcaggagagcgccgtggtcgaggacctactctatgtcctggtgggagttgatgggaggtatgtcagcgcccaacctctcgccggacgacaaagccgcacgtttctggtcgacccaaatttagatctgagtatccgggagctggttcatcgaatcctccccgttgctgcctcatacagcgccgtcacaaggttcatcgaggagaaatcctccttcgaatacggacaggtcaaccatgctctggccgcagctatgaggactcttgtgaaggagcacctcatcctggtctctcagttagaacagctccataggcaaggcctcttaagtcttcagaaactgtggttctatattcagcctgcaatgaggacgatggacatcctcgcatccttggctacaagcgtggacaagggggagtgcctgggtggcagcacgctgtccctgctgcacgatcgatctttctcctacactggcgactctcaggcacaggaattatgtctgtacctgaccaaagccgcaagtgcgccatactttgaagttctagagaagtggatatacaggggtatcattcatgacccgtattcagagttcatggtggaagagcacgaactccgaaaagagcggattcaggaggattataacgacaaatactgggatcaaaggtataccattgttcagcaacaaatcccatcgttccttcagaaaatggctgataagatactgtccaccggcaagtacttaaatgtcgtgcgggaatgtggccatgatgttacatgcccagtcgccaaagaaatcatatacaccttaaaggaacgtgcatacgtagagcaaatcgagaaagcgttcaactacgcaagcaaggttctgctcgatttccttatggaagaaaaggagttagtggcacacctgaggtccattaagagatactttctgatggaccagggtgatttcttcgttcattttatggacctggcagaagaagagcttcggaagccggtggaggacatcacaccaccccgtctggaagctctcctggaactcgcgctcaggatgtcaacagcaaacaccgacccctttaaggacgacttgaagatcgatcttatgccacacgacctgataactcaactgctcagggtgttagcaattgagacaaaacaggaaaaggccatggcccacgcagatcccacggagcttgcactgtctggcctggaagccttctcttttgattatatcgttaaatggccgctgtccctcatcataaacaggaaggctttaactaggtaccagatgctctttagacacatgttctattgtaagcacgtggaacgccagctgtgcagtgtgtggattagcaacaaaaccgccaagcagcactccttacactccgcacaatggtttgctggggcttttacgcttcgccagagaatgctgaatttcgtgcagaatatccagtattatatgatgttcgaagtcatggagcctacttggcacatcctggaaaagaacttgaaatcagcaagcaatattgatgatgtcctaggccatcacactgggttcctggatacatgcctgaaagactgcatgttgaccaatcctgagttacttaaagtattttctaagttaatgtccgtctgcgtgatgtttacaaactgcatgcagaaatttactcagtcaatgaaattggacggcgagctgggcggtcagactttggagcactccaccgtcctgggactccccgcaggggctgaagagagggctcgcaaagaactcgccaggaagcacctggctgagcacgccgacaccgtgcagctggttagtggatttgaggctacaattaacaaattcgacaaaaacttctcagcccacctcttagacctgcttgccaggctgtcaatctactccacaagtgactgtgaacacggcatggcgagcgtaatctcccggttggactttaatggattttacaccgagcgtctggaacgattgtcggccgaacgcagccaaaaagccactccacaggtgccggttttacgcggaccgccagctccagcccctcgcgtagccgtgactgcccaatag

SEQ ID NO: 31507 - DNA, 129 bp, Artificial Sequence
  Description of Artificial Sequence: Synthetic coding sequence
atgtgcctcctgcctatcagagtgaaggaggcagaggaggtctgtcgacagaaaaagggcaaatctctgtacaagataaaaccgcgacacgacagtgggattaaagcgaaaattagtatgaagacatag

SEQ ID NO: 31508 - DNA, 456 bp, Artificial Sequence
  Description of Artificial Sequence: Synthetic coding sequence
atggattgccgcgaaatggatttatacgaggattaccagtcgcccttcgacttcgacgctggcgttaacaagtcttacctgtatctgtccccctcaggaaatagttcccctcccggatctccgactctccagaaattcggcctgctgcggactgacccggtgcccgaagagggcgaggacgtggctgctacgatatctgccactgaaaccctttctgaggaagagcaggaagagctccgcagggagctggccaaagtggaagaggaaattcagaccctctctcaagttctagccgctaaagagaagcacctcgcagaaattaagagaaagttgggcataaatagcttgcaagagcttaaacagaatatagccaaaggctggcaagacgtcaccgctaccagcgctaggtcaaagctgcttgcagcagagacagaactgttgtgtttactctactag

SEQ ID NO: 31509 - DNA, 627 bp, Artificial Sequence
  Description of Artificial Sequence: Synthetic coding sequence
atgagcgcaggcggtgacttcggaaacccgctcagaaaattcaagctcgtgttcctgggcgagcaatccgtgggcaagacttccttgattacaagattcatgtatgactccttcgacaatacgtatcaagctactatcgggatcgacttcctgtctaaaacgatgtatctcgaagatcgcacagtccgcctgcagctgtgggacacagcagggcaggagagatttaggagcctcattccttcatatatccgggatagcactgtcgctgtcgtggtctatgacattacaaatctcaactcattccaacagacctctaaatggattgacgatgttcgcactgagagagggagcgacgtaataatcatgttggtcgggaacaagacagacctggctgacaaaaggcagattaccatagaggaaggagagcagagagccaaggagctgtctgtaatgtttatcgagacctcggctaagacaggatataatgtgaaacaactgtttaggagagttgctagcgcactgcctggcatggagaacgtgcaggagaaatccaaggagggcatgatcgatatcaaactggacaagccccaggaaccccctgcctccgagggaggatgctcttgttag

SEQ ID NO: 31510 - DNA, 1575 bp, Artificial Sequence
  Description of Artificial Sequence: Synthetic coding sequence
atgaagcggtcatccgtttccagcggaggcgctggaaggctgagcatgcaggagctcagatcacaagatgtgaacaagcaggggttgtacacccctcaaaccaaggaaaaaccaacttttggtaagttgagcatcaacaagcccacctcggagcgcaaggtaagtttgtttggcaaacgcacttcagggcatggctctagaaactcacagctcggtatttttagcagcagcgaaaagattaaggaccctagacctttgaacgacaaagcattcatccagcaatgcatcaggcagctttgcgagtttctgaccgagaacggctatgcacataacgtgagcatgaagagcctacaggctcctagcgtcaaggattttctgaagatttttacctttctatacgggttcctttgcccgagttacgagttgccagataccaagttcgaagaggaagtgcctcgcatctttaaggatctgggttacccattcgctctgtctaagtcatcaatgtacacagtgggggctcctcacacttggcctcatattgttgccgcactggtgtggctgatcgactgcataaagatccacaccgccatgaaggagtcttctccattgtttgacgacgggcaaccctggggcgaggaaaccgaagatgggattatgcacaataagctctttctcgattacaccattaagtgttacgagagtttcatgtcaggtgctgactccttcgacgagatgaacgcggaattacagagtaaactgaaagatctttttaacgtcgatgcctttaagttggagtcactggaagcaaagaatagggcactgaatgaacagatagccagactggagcaggaaagggagaaggagcccaatcgtcttgagtctctccgcaagctcaaggcctccttgcaaggcgatgtgcaaaaatatcaagcatatatgtctaatctggagtctcactcagcaatcctggaccagaagctgaacggacttaatgaagagatagctcgtgtggagctggaatgtgaaacaatcaaacaagagaacactagactgcagaacataatagataaccagaagtatagcgtggctgacattgaacgcatcaatcacgagaggaacgaactccagcagaccattaacaagctcactaaagatctcgaggccgaacaacagaaactctggaatgaagagctcaagtatgcacgaggaaaggaagccatagaaacccagctagcggaatatcacaagcttgccagaaagctaaaattaatccccaaaggggctgagaactctaagggctacgactttgaaattaaattcaacccagaggccggagccaactgtctggtgaagtaccgtgcccaggtttacgttcccttaaaagaactactgaatgagacggaagaagagattaataaggccctcaataaaaaaatggggctggaggacacactggagcagctgaacgccatgattacagagagtaagcgctctgtgcgcacccttaaggaagaggtgcaaaaacttgacgacttataccaacagaagattaaaaaagagaggaagaaatag

SEQ ID NO: 31511 - DNA, 1248 bp, Artificial Sequence
  Description of Artificial Sequence: Synthetic coding sequence
atgatgctgggcccagaaggaggcgaggggttcgtggtcaaattacgaggactgccgtggtcatgtagcgtcgaggacgtgcagaacttcctgagcgactgcactattcatgacggagcggctggtgtgcattttatttacacgcgtgaaggtcggcagtccggggaagcgttcgtggaactgggcagtgaggacgacgtaaagatggccctgaaaaaggatcgtgagtctatgggccatagatacatcgaggtgtttaaaagccacagaaccgagatggactgggtgctgaaacactctggcccaaattcagcagattccgccaacgatggttttgtgcggttgagaggcttgcctttcggatgcacgaaagaggagatcgtgcagttcttcagcggcctcgagattgtgcctaacggcatcacgttgccagtcgacccagaaggaaagataactggagaagcattcgttcagtttgcttcccaagaacttgccgagaaggctctgggcaaacacaaagaaaggatcgggcaccggtacatcgaggttttcaaatctagtcaagaagaggtcaggtcctatagcgacccccctctcaagtttatgagcgttcagaggccagggccatacgataggcctggaacagcgagaaggtacatagggattgtgaagcaggcaggtctggagcgaatgaggcccggagcatacagcactggctatggtggttacgaggaatactcaggactctctgatggatatggatttactacagatctgtttgggcgagacctgtcctactgtttgagcggcatgtacgatcaccgatacggcgactccgagttcactgtccagtctaccaccggtcactgtgtgcatatgaggggcttgccgtacaaggcgacggagaacgatatctacaacttcttttcaccattaaatccagtccgggttcacatcgagatcggcccagacggtcgagtgactggtgaggctgacgtcgaattcgctacccatgaagaggcggtagccgctatgtctaaggatagggctaacatgcagcatcgctacattgagctgtttctcaattccactacaggcgcttccaacggtgcctatagttcccaggtgatgcaaggtatgggggtcagtgcggcacaagccacttactcgggcttagaatcccaatcagtgtcaggatgctatggagccggatatagcggccaaaatagcatgggcggatatgattag

SEQ ID NO: 31512 - DNA, 1512 bp, Artificial Sequence
  Description of Artificial Sequence: Synthetic coding sequence
atggctagtaaccataaaagctcggcagcccgtcccgtgagccgtggcggtgtcggactcactggccgaccaccttctggcatacgcccattgagcggcaacatacgagtggctaccgcaatgcctcctggtaccgccagacctggatcacgtgggtgcccgattggcacaggcggagtcttgtcgtcccagataaaggtggctcatcggcctgttactcagcagggtctgaccggaatgaaaactggaactaagggcccacagcgccagatattggataaatcctactacctgggtctcctgagatctaagatatctgaactcacaaccgaagttaataagttacagaaggggattgaaatgtataaccaggagaattccgtctacttatcgtacgagaagcgcgctgagactttagctgtggagattaaagagttgcagggccagcttgctgattataacatgctcgttgacaagttgaacacaaacacagaaatggaggaggtcatgaacgactacaacatgctcaaggcacagaatgatcgggaaactcagtctttagatgtaatctttacagagaggcaggctaaggaaaaacaaatccggtcagtggaagaagaaatagagcaggagaagcaagctacagatgatataatcaagaatatgagtttcgagaatcaggttaagtacctcgagatgaagacaactaacgaaaaattacttcaggagctcgacaccctgcagcagcaacttgactctcagaacatgaagaaggaatcgctggaggcagagatcgctcattcgcaggtcaagcaggaggcagtactgctccatgagaaactctatgagcttgagtctcatagagatcagatgatcgctgaagacaaatcaatcggctcacctatggaggagagggagaagctcttgaaacaaatcaaggacgataatcaggagattgcctccatggagcgccagctgaccgacaccaaagagaagattaatcaattcattgaggaaatacgtcaactcgacatggatctcgaggagcaccagggagagatgaatcagaaatacaaagagcttaaaaaaagggaagagcacatggacacctttattgagactttcgaagagacgaaaaaccaagagttaaagaggaaggcccagatcgaggccaatatcgtcgcactattggagcactgctcgagaaacataaatcgcattgaacagatcagcagcatcaccaatcaagaattgaaaatgatgcaggacgaccttaattttaaatccaccgaagttcagaagtcccagagtaccgctcaaaacctaacttctgatatccagcgcctgcaactcgatttacaaaagatggagctcctagaaagcaagatgactgaggaacagcatagcttgaaatctaagatcaagcagatgaccaccgatctggagatctacaatgatctgccagcactgaagtccagcggggagaagaagaaaaagaagaagaaaaaatag

SEQ ID NO: 31513 - DNA, 1461 bp, Artificial Sequence
  Description of Artificial Sequence: Synthetic coding sequence
atgacctgtgggtcttattgcgggggtagggccttttcgtgtatcagtgcttgcggccctaggcccggtcgctgctgcataaccgcggcaccttatcggggaattagctgctataggggcctcacaggagggttcgggtcccacagtgtgtgcggcggattcagagcaggctcttgcggacgctcgtttgggtataggagtgggggtgtgtgcgggccaagcccaccctgtatcaccaccgtgtcagttaacgaaagtctgctgactcctctcaacttggaaatcgatcccaatgcccagtgtgttaagcaggaagagaaagagcagataaaaagtttaaattcccgattcgccgctttcatcgataaggtgagattcctggagcagcagaacaaactgctggaaactaagctgcagttctatcagaatagggagtgttgccagtccaacttggaaccgctctttgaaggatacattgagacccttcgtagagaggctgaatgcgtggaggcagatagcggcagactggcttcagaacttaatcacgtccaggaggtgctggaggggtacaagaaaaagtacgaggaggaggtgtcactgagagcaacagctgagaatgagttcgtagccctgaagaaggacgtagattgcgcatatttgaggaagtccgatctggaggcaaatgtcgaggccctgatccaggaaatagacttcctaaggaggttgtacgaggaagaaatccgtgtgctgcagtctcatatctctgatacctctgttgtcgtgaaactcgataatagtagagatttgaacatggactgcatcattgctgagataaaagctcagtatgacgacatagtgacgcgctcaagagccgaagccgagagctggtatcggtcaaagtgtgaagagatgaaggctaccgtgatacgccatggcgaaactctgcgcaggactaaggaagaaataaatgaactcaaccggatgatacagcgtctcacagccgaggtcgaaaatgctaagtgtcagaactcaaaactggaagctgctgtggcacaaagtgagcagcagggcgaggccgcattatctgacgctaggtgcaagctggccgaacttgagggggcactccagaaggccaagcaagacatggcttgcctcatccgcgagtaccaggaggtcatgaactcaaaactgggactcgacatcgagatagcaacttatcgtcggttgctcgaaggagaggagcagagactttgtgagggagtgggatctgtcaacgtgtgcgtctctagcagtcggggaggagtggtgtgtggtgacctgtgcgctagcaccacagcacccgtggtgtctacacgagtgagcagtgtaccatctaacagtaatgtcgtcgtgggaaccacaaacgcttgtgctccatctgctcgtgtcggtgtctgtggaggcagttgcaagcgctgctag

SEQ ID NO: 31514 - DNA, 1011 bp, Artificial Sequence
  Description of Artificial Sequence: Synthetic coding sequence
atgtgtacaatgcacaaggacgaaaaagccaagcgggaggtctcttcctggacagtggaaggagatattaacacagatccttgggccggataccggtacaccgggaagctgagacctcactatcctctgatgcccactcggccagtaccaagttacatccagaggcctgactacgccgaccaccctctgggaatgagcgagagcgaacaggcgttgaaggggacatctcagatcaagcttctgagtagcgaagatattgaaggcatgcggctggtctgccgactggccagagaggtgctggatgttgccgcaggaatgattaaacctggtgtgacaactgaggagattgatcacgccgtgcacctggcctgcatagccaggaactgttaccccagccccctgaactactataacttccctaagtcctgttgcacctcggtgaacgaggttatatgtcacggcattccagacagaagacctctgcaggagggcgacatcgtgaatgtggacatcacactgtatcgaaacggctatcatggagacctcaacgagactttcttcgtgggagaggtggatgacggggctcgcaagttagtgcagactacatatgagtgtctgatgcaggcaatcgatgctgtaaaacccggtgtccgctatcgggaattgggtaacatcatacaaaaacacgcacaggccaacgggttcagcgtggtcaggtcctactgcggacatggtatccacaagctgtttcacactgctccgaacgtgccacactacgccaagaacaaagccgtcggcgtgatgaaatccgggcatgtcttcacaatagagcctatgatctgtgagggtggttggcaagatgagacttggcctgacggttggactgccgtgactagggacggcaagaggagcgcccagtttgaacataccttgcttgtgaccgacaccggctgtgaaatactgacccggagactggattccgcccgaccccacttcatgagtcagttctag

SEQ ID NO: 31515 - DNA, 3102 bp, Artificial Sequence
  Description of Artificial Sequence: Synthetic coding sequence
atggctggcatgattgaccgcttttcaccagctaatacaggaatccgatcttgggacgttgaccctggggtgtgtaatcttgacgaacagctgaaagtttttgtaagccgtcactccgccaccttctccagcattgtgaagggccaacgatccctgcatcataggggggacaaccttgagacgctggttctgctgaacccatccgataaatctctctatgacgagctcagaaatctcttactggaccccgcatcccataaacttctcgtgctggctggcccatgtcttgaggaaaccggtgagctgctgctccagaccggtggcttttctccgcatcacttccttcaggtgcttaaggaccgagagatccgagacatcttggctactaccccgcctccagtccagcccccaattcttaccattacctgtccaacgttcggagattgggcacaacttgctcccgcagtacccggattgcagggcgcactcaggttacagctgcggctcaatcccccagcgcagctccctaactctgaaggcttatgcgagtttcttgagtacgtggcagaatcccttgaacccccttcaccgttcgaactgttggaaccccctacctccgggggatttctccgcctgggaagaccgtgttgctacatttttccaggcggtctgggagatgcagctttttttgctgtgaatggctttacagtgctggtgaacggcggaagcaaccccaaatccagtttttggaaactcgtgcgccacctcgacagggtcgacgccgtgctggtgacccatcccggtgccgattcccttcctggtctgaattcactcctgaggagaaagctggcagagcgctccgaagttgccgctggaggcggaagctgggacgatcggctccgcagactcatctctcctaaccttggcgtggtgttttttaacgcctgtgaagccgcatcacggctggcaagaggcgaggacgaggcagagctcgctctatcactcttggcccagttaggtataactcccctgccgttgtcccgtggccctgttcccgcaaagccaactgtcctgttcgaaaagatgggcgtcggcaggctcgacatgtacgtgttgcatcctccgagcgctggcgcagagaggacacttgctagcgtctgcgccctgctagtctggcaccccgcaggccctggcgagaaggttgtgagggtactctttccgggatgcacacctcctgcgtgtctgctggacggtttagtgcggctgcagcatttgagattcttacgagagcccgtggtaactccccaggacctggagggacccggacgggctgaatctaaggaatccgtgggatctagagacagctctaagagagagggcctgcttgctacgcaccccagacctgggcaggaacggcctggtgtggcccgtaaagagcccgcacgtgcagaggcccctagaaagaccgagaaggaggccaaaaccccccgtgagctcaagaaggatcccaagccatcagtgagtaggacccagccacgggaggtgcggagagccgcaagctcagtgcctaatcttaagaaaactaacgcgcaggcagcaccaaagccacgtaaggctccttccacaagccactcgggcttccccccagtcgcaaacggcccacgctcccccccatctctcaggtgcggtgaagcttcgcctccgtcggccgcatgtggctctcctgcgtcccagctcgtggccactccatctttggagctgggacccatccctgctggcgaagagaaggccctggagcttcctttagctgcgtcttctatccctcgcccacgcaccccttcgcctgaaagccaccggagccctgctgagggtagcgaaaggttatctctctccccactgcgcggaggtgaggcaggccctgatgcttcgccgacggttacaacacccaccgttacaaccccctctctaccggctgaggtgggatccccacactctacagaggtggacgaatctctctcagtgagctttgagcaggtgctgccaccaagtgcaccaacttctgaggccggactgtccttgcctctcagaggaccacgggctcggaggagcgcaagtccacacgacgttgatttgtgcttggtgagcccttgtgagtttgaacacaggaaagcagtcccaatggcacctgctcccgcttccccaggctcaagcaacgacagcagtgcgcgatctcaggagcgcgctggtggtctgggtgcggaggaaacccctcccacttcggtgtccgagtccctgcctacactgagcgattctgacccagtgcccctggcacccggtgcggcagacagcgacgaggacaccgaaggttttggggtgcctcgccacgatccacttcctgaccccctgaaggtaccgcctcccctgccagacccgagttctatttgcatggtggatccagaaatgctgcctcctaaaaccgccaggcaaaccgaaaacgtgagtaggacccgaaagcccctggccaggcctaacagccgcgctgccgctcccaaggcaacccctgttgcagccgcaaagaccaagggtcttgccggaggagaccgtgcttcccggccactgagcgccaggtccgaacccagcgagaaagggggacgggcaccactctccagaaaatccagtacacccaagacagcgacccgtggaccttctggttccgcctcaagccggccaggagtgtccgccacacccccaaaatctccagtgtatctcgacctggcttacctacctagtggctcatccgcacatctggtggacgaagaatttttccaacgcgtgagggcactctgctatgtaatctctggtcaggaccagcggaaggaggaagggatgcgcgctgtacttgatgccctgctggctagcaagcagcactgggaccgggacctgcaggtgacgttgattccaacttttgattcagtggcaatgcacacctggtatgccgagacacatgcaaggcatcaggcacttggaattacagtcctcggctccaactcaatggtgtcaatgcaggacgatgccttcccagcgtgcaaggtggaattctag

SEQ ID NO: 31516 - DNA, 2223 bp, Artificial Sequence
  Description of Artificial Sequence: Synthetic coding sequence
atgagggatctcgaggggtatagagaaacaagataccagctcctccaacttaggcccgctcaaagagccagctggatagggtacgcaatcgcctaccacttactggaagactacgagatggccgctaagattcttgaggagttccgtaaaacacagcagacctcaccggacaaagtggactacgaatacagcgaactgctgctgtaccaaaaccaggtgctacgtgaagctggtctgtaccgagaggcccttgagcatctgtgcacttatgagaagcaaatctgcgacaagctagccgtggaggagaccaaaggcgaactcctgcttcagctatgccgcctcgaagatgcagctgacgtctatcgcggacttcaggagcggaatcccgaaaattgggcctattacaagggtcttgaaaaggccctgaagccagcaaatatgctggagcggctgaagatctacgaagaggcctggactaagtacccgcgaggcctggtgcctcggagattacccctgaactttctgagtggggagaagttcaaagagtgtctggacaagttcttacggatgaacttcagcaagggatgcccacccgtgtttaatacactaaggtccctgtacaaggacaaggagaaggtggccataatcgaagagctcgtagtcggctacgagacgtccctaaagtcttgtaggttgtttaaccccaatgatgacgggaaggaggaaccaccgacaaccctcctgtgggtgcaatactacctggcacagcactatgacaagattgggcagccctccatagctctggagtacattaacacagcaattgaatctactcctaccttaattgaactattcctggtcaaagcgaagatttataagcacgccggaaatataaaagaagctgccaggtggatggatgaagcgcaagccttggatacagccgaccgttttatcaactctaaatgcgcgaagtacatgttgaaggccaacctcatcaaagaggccgaagagatgtgctccaagtttactcgggaagggacctccgcggttgaaaacctaaatgaaatgcagtgcatgtggtttcagactgaatgcgctcaagcatacaaagctatgaataaattcggcgaggcgctgaaaaaatgccacgagatagaacgacatttcatagagattaccgacgatcaatttgattttcatacctactgcatgcgcaaaataacacttaggtcctatgtggacctcctgaagcttgaagacgtgctgcggcagcaccctttctactttaaagccgctagaattgccatcgagatctacctgaaactgcatgataatccattgacggatgaaaataaagagcacgaggctgacacagccaacatgtccgacaaggaactcaaaaaactgcggaacaagcagagacgggctcaaaagaaggcgcagatcgaggaggagaagaagaacgctgagaaagagaaacaacagaggaaccagaaaaagaagaaagatgatgatgacgaagaaatcggtggccctaaagaagagctgattccagaaaagctggccaaagtagagacacctctggaggaagctataaagtttcttactccactgaaaaatttggtgaaaaataagatcgaaacgcacctgtttgcgtttgagatctacttcaggaaggaaaagttccttctaatgctgcagtccgtgaaaagggcctttgcgatagattcctcccatccttggttgcatgagtgtatgataagactcttcaacaccgccgtgtgcgaatctaaggatctttcggacactgtgaggacagtccttaaacaggaaatgaacagactgtttggtgctacaaatcctaagaactttaacgaaacgtttctcaagaggaactccgacagcctgccccaccgcttgtccgctgctaaaatggtgtattatttggatccatctagccagaaaagggcaatagaactggcgacaacactggatgaaagcctcaccaatagaaacctgcaaacatgtatggaggtgctcgaggcgctgtacgatgggagcttgggcgactgcaaggaagcagccgagatctaccgtgcaaactgccataaactcttcccatatgcacttgcattcatgcctcctgggtatgaagaagacatgaaaatcactgtcaatggtgattcaagcgcagaggctgaagaattagccaatgaaatctag

SEQ ID NO: 31517 - DNA, 183 bp, Artificial Sequence
  Description of Artificial Sequence: Synthetic coding sequence
atgtcttgtacaattgaaaaggcgctggcggatgccaaggctctcgtcgaaagactgagggaccacgacgatgccgcagaaagccttatcgaacagaccaccgccctgaacaagcgggttgaagccatgaagcagtatcaagaagaaattcaggaactaaacgaagtagccagacatcgctag

SEQ ID NO: 31518 - DNA, 1419 bp, Artificial Sequence
  Description of Artificial Sequence: Synthetic coding sequence
atgggtaaggaacaggaactgctagaggccgctagaactggccacctgcctgccgtggaaaaacttttaagcggaaagcggttaagtagtggcttcggcggaggaggaggcggtggtagtggcggtggaggcggaggcagcggtgggggaggcggaggcctgggatcttcctctcacccgctgtcaagtctacttagtatgtggcgcggaccgaatgttaattgcgttgatagcacgggatacacacctctgcaccacgctgccctgaacgggcacaaagatgtggtcgaggtgctgttgcggaacgacgctctgactaacgtggctgatagtaaagggtgttatccattacacttagctgcgtggaagggagatgcccaaatcgtccgtctactcattcaccagggcccttcccacacccgtgtcaacgaacaaaacaatgataacgagaccgctcttcactgcgcggctcaatacggccacaccgaagttgtgaaggttttgctggaagagttaaccgaccccactatgcggaataataagttcgagactccactggatttggcagcgctgtacggtagactggaggtcgtgaaaatgcttctgaacgcccatccaaatctcctgtcctgtaacaccaaaaaacacactcccctccacctggccgctcgtaacggacacaaagctgtggtgcaggtccttctggatgccggaatggacagcaactaccagaccgagatgggttccgccctccatgaggctgccttgttcgggaagactgatgtagtacaaatcttgctggcagccggtactgatgttaacatcaaagacaaccacgggctcacggcccttgataccgtccgagagctgcctagccagaaaagccagcagatcgccgctctgatcgaggaccatatgaccggcaagcggtctactaaggaagtcgacaagacacccccaccacaaccacccctcatatcctccatggattctatttcccagaaaagtcagggcgatgtcgagaaggcggtaacggagctgatcatcgattttgacgctaatgctgaggaagaggggccttatgaggcactttataacgccatcagctgccacagcttggacagcatggctagcgggagatcctctgatcaggactcaaccaacaaggaggccgaagctgccggagtcaaaccggcaggggtgcgtcctcgtgagagaccgccacccccagcaaaacctccacctgatgaggaggaggaagatcacatcgataaaaaatactttcccctgactgcatctgaggtcctcagcatgagaccaaggattcacgggtccgccgcacgcgaggaagacgaacacccctatgagctgctgctgacggcggagacgaaaaagaaaaagaagaagaaaaagaaatag

SEQ ID NO: 31519 - DNA, 1392 bp, Artificial Sequence
  Description of Artificial Sequence: Synthetic coding sequence
atgtccggtgggactccttatatcgggtccaagatcagtctgatcagcaaggcggagattcgatatgagggcatactgtacacgattgacactgagaattcaaccgtggctctagctaaagtgcgctcattcggcacagaagatcggcctacagacagaccgatacccccacgcgacgaagtcttcgagtacatcattttccgaggatccgacattaaagacctgaccgtgtgtgaacccccaaagccacagtgctctctgcctcaggacccggctatcgtgcaaagttcactgggctcttcgacctcaagcttccagtctatggggtcatatggaccatttggccgaatgcccacctatagccagtttagcccatcctcactggtcggacagcagtttggtgctgtgggggtcgctggaagttcactgacctcctttgggacagaaacttcgaatagtggcacccttccacaatcatcagctgtaggctccgcttttacccaggacacacgctcactgaaaacccaactcagccagggtaggtcatcccctcagctggaccctctccggaaaagcccgacaatggaacaggctgtgcagaccgccagtgctcatcttcccgcaccagcggctgtcggtaggcgctcacccgtctcaactcgtccactcccctcagctagtcagaaggcgggtgagaatcaagaacatcgccgagcagaggtccacaaggtgtcacggcctgagaatgagcagttgcggaatgacaataaacgccaggtagccccaggtgccccatccgctccccgtagggggagaggcggtcacaggggtgggcgagggaggttcggcatccgccgtgatggtcctatgaaatttgaaaaggatttcgactttgagagcgctaatgcccaattcaataaagaagaaatcgatagggaattccacaataaactgaaactaaaagaggataagttagaaaagcaagaaaagccagtaaacggggaagacaagggagatagtggagtagacacccagaactccgagggcaatgcggacgaggaagatcccctcggccctaactgttactacgacaagaccaagagtttttttgacaatattagctgtgatgataacagagaacgaaggcccacttgggctgaagaacgcaggctgaatgcggaaactttcggcattccgctgcgccctaaccggggtcggggagggtatcgaggacgtggaggtctggggtttaggggtggcaggggcagagggggtgggaggggcggaacattcacagctcctcgaggattccggggaggattccgcggtggcaggggcggaagagagttcgcagactttgaatatcgcaaagacaacaaggtggcggcttag

SEQ ID NO: 31520 - DNA, 1287 bp, Artificial Sequence
  Description of Artificial Sequence: Synthetic coding sequence
atgggcggaggcgttggggcttccagctcagggggtggcccaggcggtagcggcggtggcggaagtggtgggcctggagcaggaacctccttcccaccacccggagtaaaattgggccgtgattcaggcaaagtcacgaccgtcgtggcaacccttggccagggcccagagcgatcccaggaggtggcctacaccgatatcaaagtcatcgggaacggctcttttggcgtcgtgtatcaggctaggttagccgagacccgggagctcgtggcgatcaagaaggtattacaggacaagcggttcaaaaacagagagctgcagatcatgaggaagctcgaccactgtaacatcgtgcgcctgagatattttttttatagcagcggagaaaagaaggatgaactgtacctcaatctggtgctggaatatgtgcctgagaccgtgtacagggtagctcgacactttaccaaagctaaacttactattccaattctgtatgtgaaagtgtacatgtatcagttattcagaagcctcgcttatatccacagtcagggagtgtgtcaccgcgatattaaacctcagaaccttctggtcgacccggacaccgcagtgctgaaactttgcgacttcgggtcagctaagcaactggtgaggggcgagcccaatgtcagctatatttgctctaggtactacagggccccagagctaatttttggagccaccgattacacttctagcatagacgtgtggtctgcaggatgcgtgctcgctgagctgctgttgggacaacccatctttcccggtgacagtggagtggaccaactcgtggagataatcaaagtgttagggactccaacaagagagcagatccgtgaaatgaaccccaactataccgaattcaagttcccgcagattaaggcccatccctggaccaaggtatttaaaagcagaacccccccagaggctatcgccttgtgctccagtctgctggagtacacccctagtagtcgcctgtcaccgctagaggcctgtgcacacagcttcttcgacgagctgcggtgcctcgggacccaactacctaataatcgcccattacccccactgttcaacttctcagccggtgaactgagtattcagccatccctcaacgcgatcctgattcccccacacctcagaagtccagcaggaacaactactttgacaccgagctctcaggcactgaccgaaactccaacctctagtgactggcagtctacagacgccactcctaccttgacaaattcttcctag

SEQ ID NO: 31521 - DNA, 657 bp, Artificial Sequence
  Description of Artificial Sequence: Synthetic coding sequence
atggacgcagagcaccccgaactgaggtcatacgcccagtcacagggatggtggactggcgagggggagttcaattttagcgaggtgttctcccccgtcgaagaccatctggactgtggcgctggcaaagacagcctggaaaagcaggaggagagtatcactgtgcagactatgatgaacacactgagagataaagcatccggcgtgtgcattgatagtgaattcttccttacaaccgcatccggtgttagtgtgctgcctcagaaccgaagctccccttgtattcattacttcacaggaacgccagatccttcaagatccatttttaaaccctttatctttgtggacgacgttaagttggtcccgaaaactcaaagcccctgctttggagacgatgatccagcgaaaaaagagcctcggtttcaagagaaaccagaccgtcgccacgagctgtacaaggcccatgagtgggccagggccataatagaaagcgatcaggagcaaggaagaaaattacgaagcaccatgcttgaactggagaagcagggtcttgaagcaatggaagagatcctgacttcgagcgaaccgctcgaccctgccgaggtgggcgacctattctacgactgtgtggacactgagattaagttcttcaagtag

SEQ ID NO: 31522 - DNA, 573 bp, Artificial Sequence
  Description of Artificial Sequence: Synthetic coding sequence
atggccttactggcggaacatctgttgaaacccctgccagccgacaaacaaattgaaactggcccattcttggaggcagttagtcacttaccaccttttttcgactgcctggggagccctgtgttcactccaattaaggctgacatttccggcaacatcacaaagatcaaagctgtatatgataccaaccccgctaaattccgtacgctccagaatattcttgaagtcgaaaaggaaataggactaaggttcatccaagtgttcttacagtcgatttgcgacggcgagagggacgaaaatcaccccaatttgattagggtcaacgccacgaaagcgtacgaaatggccctgaagaaatatcatggctggatcgtacaaaaaattttccaggccgcattatatgcagccccttacaaatccgatttcttgaaggctctgtctaaaggccagaatgtgacagaggaggagtgcctggaaaagatacggctctttttggtgaactacaccgcaactattgacgtgatctatgaaatgtatactcagatgaatgccgaactgaattacaaagtatag

SEQ ID NO: 31523 - DNA, 762 bp, Artificial Sequence
  Description of Artificial Sequence: Synthetic coding sequence
atgtcgatttgttcttcactggctaggaagttcccgaaattgaccatcattggagaagaagaccttccatctgaggaagtcgaccaagagctcatagaagattctcagtgggaggagattctcaagcagccttgtcccagccagtatagtgcaatcaaagaggaggatctggtggtatgggtggacccactggatgggactaaggaatatactgagggtcttttggataacgtcactgtgctaatcgggattgcctatgagggaaaggcaatcgccggtgtgatcaatcagccgtattacaactacgaggccggacccgacgccgtgttaggcagaactatctggggcgtactgggcctgggcgcttttggcttccagttgaaggaggtccctgcaggtaagcacattatcaccacaacacgctcccactccaacaaactcgttactgactgcgtcgcggctatgaacccagatgctgttctgagggttggtggtgccggtaacaagattatccagctgatcgaaggaaaagcgtccgcttatgtattcgcctcccctggttgcaaaaagtgggacacctgtgcacctgaagtgatcctccacgctgtcggcggaaaactgaccgacattcatggtaatgtgctgcagtatcacaaggatgtcaagcatatgaattccgcaggagtgttggctacgctccgcaattatgactattatgcttcccgcgttcccgagtctataaagaacgctcttgtcccgtag

SEQ ID NO: 31524 - DNA, 1590 bp, Artificial Sequence
  Description of Artificial Sequence: Synthetic coding sequence
atgggagcctatcttagtcagcccaacaccgtgaagtgttcaggcgacggagtgggggtgagtatggaggatgcccataactgcatcccggagctggattctgagaccgcaatgttctccgtgtacgacggccatggcggagaggaggtggctctgtactgtgccaagtacttgcctgacattatcaaggatcaaaaagcttacaaagaaggcaagctgcaaaaagccctagaagacgcttttctggccatcgatgccaagcttaccaccgaggaagtaatcaaagagctggctcagatcgctggtcggccaaccgaagacgaggacgaaaaagagaaagttgccgacgaagacgacgttgacaacgaagaagcagctctcctgcatgaagaggcgacaatgacaatcgaagagttgctcactaggtatggacagaattgtcataaagggcctccacattcaaagagcggcggtggcacaggtgaggaaccaggatcacagggtctcaatggagaggccggacctgaggactcaacgcgggaaactccatctcaggaaaacggtccgactgctaaagcatataccggcttctcaagcaattctgaaagaggcacagaagccggacaggttggtgagcctggtatacctaccggcgaagcgggaccctcatgtagctctgcctccgataagcttccacgcgtggcaaagtcaaagtttttcgaggacagcgaggatgaatcagatgaggcggaggaggaagaggaggattcggaggagtgttcagaggaggaggatgggtacagctcggaggaggccgaaaacgaggaggatgaagacgacacagaggaggccgaagaggatgacgaagaagaagaagaggagatgatggtcccagggatggaaggcaaggaagaaccaggcagtgatagtggtacaaccgctgtggtggccctgatccgaggaaagcagctgatcgtggcaaacgcaggagatagcaggtgtgttgtatccgaggccggtaaggctcttgacatgtcttatgatcacaagccggaggacgaggtcgagctggcccgaataaaaaatgcgggtggcaaagtcactatggacgggagggtgaatggcggactaaaccttagccgcgcaatcggtgatcatttctataaaaggaacaagaacttgccccctgaagagcagatgatctcagctttaccagacatcaaagtgctgactctgacagatgaccatgaattcatggtgattgcttgcgacggcatctggaacgtcatgtccagccaggaagtggtcgacttcatccagtcgaagatcagccaacgcgatgagaacggcgaattaaggctactctcctccattgtcgaagaactgttagaccagtgtctggcgcctgatacctcaggggacggcactgggtgtgataacatgacctgcattatcatctgcttcaaacccaggaacaccgcggagctgcagcctgagtctgggaagagaaagctagaagaagttctttccaccgaaggcgctgaggaaaatggcaattccgataagaagaagaaggcaaaacgagactag

SEQ ID NO: 31525 - DNA, 1293 bp, Artificial Sequence
  Description of Artificial Sequence: Synthetic coding sequence
atgaccttcgagctctatgatgagtggattcaggcgagtaacgttcaagagcaggataagaagctgcaggctctctggaacgcatgcgaaaaacttccaaaggccaatcataacaacatcagatacttgattaagtttctgtctaagctctccgagtaccaagatgttaataaaatgactccctccaacatggccatcgtcctggggcctaacctactgtggccccaagccgaaggaaatatcaccgagatgatgacaactgtaagcctgcagattgtaggcatcatcgagcctatcatccagcatgctgactggttttttcccggtgagatcgagttcaacataaccgggaattatgggtcgcccgtacacgtgaatcataacgccaactattcaagcatgccatcaccagatatggatcccgctgatcggcgtcaaccggagcaggccaggcgtcccctgtccgtggcaacggacaacatgatgctggagttctataaaaaggatggtatgggggtgcgtgtaatggatactaactgggttgcaagaagaggtagtagcgccggtcgcaaggtgagttgcgccccaccatccatgcagcctcccgcaccacccgcagaactggctgcacctctcccctctccactgccggagcaacccctcgatagcccggcagccccagctctgagtccttcaggcctcgggcttcaaccagggccagaacgaacttccaccacaaagagtaaagagctgtcccctggttccgcacagaaaggatcacctggcagttcccagggcacggcatgcgctggtacacagcctggcgctcagcccggagcacagccaggcgcatctccctcaccatcacaaccccctgcagatcagtctcctcacacactccggaaagtgtccaagaagcttgccccaataccaccaaaggtaccattcgggcagcccggtgctatggccgaccaaagtgccggacagccaagccccgtaagtctgtctccaacaccaccatccaccccctcgccttatggtttatcatacccccagggatacagtcttgccagtgggcagctcagtcccgctgctgcaccacctctggccagcccaagcgtgttcacctccacactctctaaatccagaccgactcccaagccacgacaacggcctacactgccacctccacagcctcccacagtgaatttgtccgcctccagtccccaatcaaccgaggcaccgatgctagacggcatgtctcccggtgagtctatgtctacagcggtctag

SEQ ID NO: 31526 - DNA, 846 bp, Artificial Sequence
  Description of Artificial Sequence: Synthetic coding sequence
atgcccggaccccgacggctcaggtcacccggtgggagcggatgttcttcccggggatcaggacctcgattaagtactcgcaggtggcgcccatgctgctactgtggcggatctggcgtttggcttctgcggaccccaccatcccccagcgcctggcctgcgaggcggtgccccaggcacagattcgaattctgcgagccagcatttgtagtgggcaactgtcttcagattgccagcgacagtcaccagtacgacagaatatactgtggtgctggcgtgcagaaagaccacgaaaattacatgaagattctcctgaaagtcgggggtatcttggttatgcccatcgaagaccagttaacgcagattatgcgcactggtcagaacacctgggagtctaaaaacatcctggccgtttcgttcgctcccctcgttcagcccagtaaaaatgataacggaaaacctgacagcgtcggacttcccccttgtgcagtaaggaacctgcaagatttggctcggatctatattcgacggacactgaggaactttatcaacgatgagatgcaagctaaaggaataccacagagagccccaccaaaacgaaaaagaaaaagggtcaaacagcgaatcaacacgtatgtgttcgttgggaatcagttaatcccacagcctctggattctgaggaagacgagaagatggaggaggacaacaaagaggaggaggagaaggaccacaatgaagcgatgaagcccgaggagcctccgcagaatctcctcagggagaaaatcatgaaactgcccttacccgaaagtcttaaggcctaccttacatatttcagggacaagtag

SEQ ID NO: 31527 - DNA, 1251 bp, Artificial Sequence
  Description of Artificial Sequence: Synthetic coding sequence
atgtctcccgctatgttgtccgtgttggtgaaaatgatgctggcccaagctcaggagtccgtattcgagaagattagccttcccggtatcaggaacgaattctttatgctggtcaaagtggctcaggaggctgctaaggtgggcgaggtttatcagcagctccatgccgctatgtcccaggcacctgtgaaggagaacataccttatagttgggcttccctggcttgcgttaaggcacatcactacgctgccctcgcgcattacttcactgctatactgctaatcgaccatcaggtgaagccaggaaccgaccttgatcatcaagagaagtgtctgtcgcagctgtacgatcacatgccagagggcctgacccccttagccaccttaaagaatgatcagcagagacgccagctgggaaagagccacctgcgtagagccatggcccaccacgaggagtctgtacgggaggctagcctctgtaaaaagttacggtcaatagaagtactgcagaaggtcctgtgcgctgctcaggagagatccaggctgacgtatgcccaacatcaggaggaagacgatttactaaatctgatcgatgcccctagcgtcgtggctaaaacagagcaggaggtggacatcatcctcccccaattctcgaaattgactgtcaccgatttcttccagaagctaggaccactgtctgtgttctctgctaataagaggtggacaccacctaggagcattagattcacagcagaggagggagacctgggatttaccttacggggtaacgcgcctgtgcaggtccactttctagatccatactgtagtgcttctgtcgccggtgcaagagaaggggattatatcgtttctatccagctggtagactgcaaatggctcaccctgtctgaagtgatgaaactgctgaagtccttcggtgaggacgaaattgagatgaaagtggttagtctccttgacagcacaagttccatgcataataaatccgctacttactccgtgggtatgcagaagacctattcaatgatttgccttgcaatcgatgatgatgacaaaacagataagaccaaaaaaatcagcaagaagctatcctttttgtcttggggcaccaataaaaaccggcaaaagtccgcaagcactctgtgcctgcccagtgtgggggcagcaagacctcaagttaagaaaaagttgccctctccatttagtctccttaattcggactcaagctggtactag

SEQ ID NO: 31528 - DNA, 6200 bp, Artificial Sequence
  Description of Artificial Sequence: Synthetic coding sequence
atgtgctcaacaccaggaatgcccgcaccaggagcatcattagccctgcgtgtgagtttcgtagatgtgcatcccgacgtaattcccgtgcagctgtggggactggtgggcgagcgcaggggagagtatctgcggctgtcgagagagatccaggaggccgcagccacaagggggcagtgggctctggggtccgcttccgcaagccctggggagctgtgcctggtacaggtgggactgctatggcacaggtgcagagtagtctcccggcaggcccaggaaagcagagttttcctcctcgatgaggggcgtaccataaccgccggagccggaagcctagctccaggccgaagagaattcttcaatctgccctccgaagtcctgggctgtgtgctggcgggactggtgcccgcaggctgcggtgctggctcaggagaacccccacaacactggcccgcagatgcggttgacttcctctccaatctacagggcaaggaggtgcatggatgtgtcctcgatgtgttgttgttacacaggctggtcttgctggaagtccctgatgtttttcagcagatgcgcgagctcggcctggctcggagagtcccagactccttgtttagaagcctgttggagcgctatctgaccgcagcgacagcgtccgtcggctctggtgttcccgtgctaagcagagtcccactaaagcagaaacagccaggcctggactacttttacccacagctgcagcttggcgtcaccgaagcagtagtgataacacaggtttgtcacccccatagaattcactgtcagctcagatctgtctcgcaggaaatccataggctcagcgagtctatggcacaggtctatcgaggtagtacgggcaccggggacgagaacagcacctcagcaacatgggaagagagggaggagagtcctgataagcccggttctccttgtgctagttgtggcctcgacgggcactggtatagagcactgcttttggagacctttagaccccagagatgtgctcaggtgctgcacgtcgattacggcaggaaagagctggttagttgcagctccctgagatatctgctgcccgagtacttccgtatgccagttgtcacctacccttgcgccttatacgggttatgggacggcggacgcggatggagccgtagccaggttggcgatctcaagaccctcatcctgggcaaggccgtgaacgccaagatcgagttctactgcagctttgaacatgtatattatgttagcctttacggtgaagatgggattaacctaaatcgcgtgtttggtgtgcagtcctgctgcctcgctgatagggtgctgcaatctcaggcgacagaagaagaggagcctgaaacttcccagagccaatcacccgcagaggaggtggatgaagaaatttccttacctgctctgagatccattcgcctgaagatgaacgctttctacgatgcacaagtggagtttgtcaagaaccccagtgagttttggatacgacttaggaagcacaatgttacgttctccaaattaatgaggcgaatgtgtggcttctattctagtgcttccaaacttgatggggtggtcctgaagcctgagcctgatgacctgtgctgcgttaaatggaaggaaaacggatattacagagcaatcgttaccaaattggacgataagtcagtggacgtgttcctcgtcgatcgcggtaacagcgagaatgtcgattggtacgacgtccgcatgttgctcccacagtttaggcagctgcccatcttggctgtaaaatgtacactggctgacatatggccgttaggcaagacttggtcccaggaggccgtgtcattttttaagaaaaccgtccttcataaggaacttgttatccacattctcgacaagcaggatcatcagtatgtcatcgagattctggatgagagcaggactggcgaggaaaacatttctaaagtgattgcacaagctgggtatgcaaagtatcaagagttcgagactaaagaaaacatactggtcaacgcccactccccagggcacgtcagcaaccacttcacgactgagagcaataagatcccattcgcgaaaactggggagggagaacagaaagctaagagagaaaataaaactacatctgtgtctaaagccctgagcgatacaacagttgttaccaatgggtcgaccgagttggttgtgcaggaaaaagttaaacgggcatctgtatatttcccattaatgcaaaattgtttagaaataaagcctggctcgtcttcaaaaggagagttagaagtgggcagcacagtggaggtgcgcgtctcatatgttgagaaccccggttacttctggtgtcagctgacccgaaacatacaggggcttaaaacactcatgagtgatatccaatactactgcaagaacaccgctgcccctcaccagcggaataccctcgcctgtctggccaagaggacagtgaaccgtcagtggtcccgcgctctaatctccggcatccagtccgtagagcatgtcaatgtgacgtttgtggattatggcgaccgcgaaatggtttcggtgaaaaatatctattctatcagcgaggaatttttgaaagtgaaggcacaggcattccgatgcagtctttacaatctcattcagccagtcggccagaatccttttgtgtgggacgtgaaagcaattcaggctttcaatgagtttatcgataacgcctggcagaagaacctcgagctcaagtgtacaatattcgctctggctagtatcaatgaagagctgttcaatatcgtggacctgctgacccctttccagtcagcatgtcactttctcgtagagaagcggttggctaggcctgtgaagctccagaaaccactggagagttccgtccagctgcacagttacttctatagcacccacgatatgaagatcggctcagaggaactggtttatattacacacatcgacgatccctggaccttctattgtcagctggctaggaacgccaatatcctcgagcagctatcctgcagcattacccagttaagtaaggtgctgctgaaccttaagacatcacccctgaacccaggcaccctctgccttgctaagtacacggacggtaactggtatcgaggtattgtcatcgagaaggaaccgaaaaaagtgttcttcgtcgactttgggaatatttacgttgtgaccagcgatgacctgttacccatcccttcggatgcctatgacgttctcctgctgccaatgcaggctgtccgctgttccctatctgacatcccagatcatatccccgaagaagttgtggtgtggtttcaagaaacgatactggacaaatcactgaaggccctggtcgtggcaaaggaccccgatggcacactcatcattgaattgtacggggataacatccagatctccgccagcatcaataaaaagttgggcctcctgtcctacaaggacaggattcggaaaaaggagtccgaggtcctgtgctcaaccacagagacactcgaggagaaaaacgaaaacatgaagctgccctgcaccgagtatctgtccaagtccgtcgggtataagttacctaacaaggaaattctcgaggaaagctacaagccccagatcaacagcagctataaggagctgaaattactgcagtctctcactaagaccaatctggtgacccagtatcaggactctgtcggcaacaaaaactctcaggtgttccctttaaccacggagaagaaagaagagatctctgcagaaacaccacttaaaaccgctcgagtcgaggccacactgtccgagaggaagatcggtgacagctgtgacaaggacttgcctctgaagttctgcgaattccctcaaaagacaatcatgcctggatttaaaaccaccgtgtacgtgagtcacatcaatgatctttcagacttctacgtacaactgattgaggatgaagcggagatcagccacctcagtgagagattgaatagcgtgaaaacccgtcccgagtattatgtgggaccgccactccagcgcggtgatatgatatgcgctgttttcccagaagacaacctctggtaccgcgcagtcatcaaagagcagcagccaaacgatctactatcagtccaattcattgattatggaaacgtgagtgtcgtgcataccaataaaattggcaggctggatctggtaaatgcaatcctccctggactttgcatccactgctcgctgcagggctttgaggtgccagacaacaagaactcaaagaagatgatgcactattttagccagcgcacaagtgaagctgccatccggtgtgagttcgtgaaattccaggatcgctgggaggtaatattggccgatgaacacggaataattgccgacgatatgatctcccgctacgcgctgtccgaaaaaagccaagtggaattaagcactcaggtcattaaaagtgcctcgagcaagtcagttaacaaatccgacatagacacgtccgtgttcctgaattggtacaaccccgagaagaaaatgatacgggcatatgccactgtgatagatggacccgagtacttctggtgtcagtttgcagacacggagaaactgcaatgcctggaagtggaggtgcaaactgccggtgagcaggtggccgaccgacggaattgtattccttgcccgtatatcggtgacccatgcattgttagatatagagaggacggccattactatcgagctctcataaccaatatatgtgaggactatctggtctctgtgagactggtcgactttgggaatattgaggattgtgtagacccaaaggctctgtgggccatcccgagtgaactgctctcggtcccaatgcaggcatttccttgttgtctatctggattcaatataagtgaaggtttgtgttctcaggaggggaacgactacttttacgagataatcactgaagacgtgctggaaatcaccattctcgagatcagacgggatgtgtgcgatattccattagccattgtggaccttaagagcaagggaaaatctatcaacgagaaaatggagaaatactctaagacaggtattaaatcagccttgccatacgagaacattgattcagagatcaaacagactctgggcagttataatcttgacgtgggcctgaaaaaactttctaataaggccgttcagaataaaatctacatggagcaacaaacagatgaactggctgagattactgaaaaggatgtgaatataatcggtactaaaccctccaattttagagacccgaaaacagacaatatttgcgaaggcttcgaaaatccgtgcaaagataagatcgacaccgaggaactagaaggcgaactggagtgtcacctggtggacaaagccgagttcgacgacaaatatctgattactggattcaacaccctgttgccccacgcaaatgagacaaaagagatcctggagctgaactcattggaggtgccactgagcccagacgacgagtctaaagaatttctagaactggagtctatcgaactccaaaactctctggtggtggatgaggaaaaaggtgagttgtctcccgtacccccaaatgtgcccctatcgcaagagtgtgtaacgaaaggcgcaatggagttgttcaccttgcagctccccctgagttgtgaagccgagaaacagccggagctggaactgccaactgctcagctcccattagacgataagatggaccccctctcattgggagtgtctcagaaagcccaggaaagcatgtgcactgaggacatgcgaaagtcgtcctgcgtggagtctttcgatgaccaacggagaatgagtttgcacctgcacggcgcagactgcgaccctaagacacaaaacgaaatgaacatctgtgaggaggagttcgtcgaatataagaaccgggatgccatctccgctttaatgcccctatttagcgaagaagaaagttcagacggctccaaacataacaacggactgcctgatcacataagcgcccagctccagaatacctatacactgaaagcctttacagtgggtagcaaatgcgtggtctggtccagtctcagaaatacatggtctaagtgtgagatcctggaaacagccgaggagggaactcggaaacgtggcctggaggtcatggagattta

SEQ ID NO: 31529 - DNA, 264 bp, Artificial Sequence
  Description of Artificial Sequence: Synthetic coding sequence
atgtcatcatgtgtctcatctcaaccgtctagcaatcgcgcagcaccacaggatgagctcggtggacgcggaagttcttccagcgaatcccagaagccttgcgaggccctccgtggattaagttctttaagtatccacctcggaatggagtcctttattgtcgtgacagagtgtgagcccggttgtgctgtggacttgggtctggcacgtgaccgccctctcgaagccgacggacaagaagtgcccctcgatacaagcggttag

SEQ ID NO: 31530 - DNA, 2469 bp, Artificial Sequence
  Description of Artificial Sequence: Synthetic coding sequence
atggccgcagaaggggaccccgagtggggccctacacctccaagtacatctgcaactacggcggcacgccgagctgtcaacaaggtggtttacgatgatcatgaaagcgaggaggaggaggaggaggaggatatggtcagcgaagaggaagaggaagaggacggcgacgctgaggagacacaggacagcgaggacgacgaggaggacgaaatggaggaggatgatgacgatagcgactaccctgaggagatggaagacgacgacgacgatgcctcatattgcaccgagtcaagcttccggtctcattccacctactcctcaacacctgggaggagaaaaccgagggttcacaggccccgtagcccaattctagaggaaaaggacatccctccactagagttccccaagtcctcagaggacctgatggtcccgaatgagcacattatgaacgtcatcgctatctacgaagtgctgcgcaatttcggaaccgtactgaggttaagcccgttcagattcgaggacttttgtgctgccctggtgagccaagaacagtgtaccctgatggctgaaatgcatgtggtgttgctgaaagctgtactgcgtgaggaggacacctccaataccactttcggtcctgccgacttgaaggacagtgtgaatagtacactatactttatcgatgggatgacttggcctgaagtgctcagagtctattgcgagtctgataaggaatatcatcacgtgctgccataccaagaagcagaagactacccctatggtcccgtcgagaacaaaattaaggtgcttcagttcctagtagaccagttcttgactactaatattgcccgagaggagctcatgtcagagggcgtgattcagtacgacgatcattgtagagtgtgccacaagctaggagatttactgtgttgtgagacttgctctgcggtctaccatctcgagtgtgttaaacctcccctggaagaggtgcccgaggacgagtggcaatgtgaggtttgtgttgcacacaaggtccccggagtcacggactgcgtggcagagatacagaaaaataagccatatatcaggcatgaaccgattggatacgatagaagtaggagaaaatactggttcctcaataggcgactgattatcgaggaagatacagagaacgaaaacgaaaaaaaaatatggtactacagcactaaagtgcagttggccgaactcattgattgcctcgataaagattattgggaagctgagctttgtaagatcctggaagagatgcgagaagagatccatcggcacatggatattactgaagatttgaccaacaaagccagaggcagcaataagtcttttctcgccgcagcgaacgaggaaatcctggaatctatcagagcaaagaaaggagacatcgacaatgttaaaagccccgaggagaccgaaaaagataagaatgaaactgagaatgattcgaaggacgccgagaagaacagggaggagtttgaagaccaatcactcgagaaagattcagatgataaaaccccagatgacgaccctgaacagggcaagagtgaagagcccactgaggtgggcgacaaaggtaattcggtttcagcaaatctaggcgacaacaccaccaacgcaacttccgaggagacctctccgagcgaaggcagaagccccgttggctgcttatccgagacccccgattcttctaacatggcagaaaagaaagttgcttccgagctgcctcaggacgtccccgaagaacccaataaaacctgtgagtcttccaatacatctgctaccaccacaagcatccagccaaatttagagaatagcaattcaagttccgagttaaactcttcacagtctgaatctgctaaggccgcagatgaccccgagaacggtgaacgagagagccatactccggtatcaatccaagaggagattgtgggcgacttcaagtctgagaagtctaacggggaactttctgagagtccaggagctggcaaaggcgcttctggtagtaccaggatcataacccgtctccgaaaccctgactccaaactgagccagctcaagtcccaacaggttgctgccgctgcacacgaggctaacaaactgttcaaagaaggtaaggaagtgcttgttgtgaatagtcagggggaaatcagtaggctttcaaccaagaaggaggtgattatgaagggaaatataaacaactacttcaagctcggacaggaggggaaatatcgtgtctaccataaccagtattccaccaactcattcgctctcaataagcatcagcatagagaggatcatgataagcgacgccatctggcccataagttctgcttgacgccagcaggggaattcaaatggaacggttccgtgcacggatcaaaggtgttgaccataagcactttaaggctcaccattacccagtatggcgagaacttatag

SEQ ID NO: 31531 - DNA, 552 bp, Artificial Sequence
  Description of Artificial Sequence: Synthetic coding sequence
atgttgcagcaaacttggacatccaggtgtcttatgaaattctatgctgtcgtagccactagccccgcttcctgggagtctcacaagatcgccgaacggatcgaacagcggattcttaatagtaaccctgtgatggaggccttcggcaacgcctgtacactgcgcaataataattcctccagattcggaaagtttatccagctgcagctaaacagggcccagcagatgactggggcagcagtccagacctacctgctcgagaagacccgcgtggcctgtcaggcaagctccgaaagaaatttccacatcttttaccaaatatgtaaaggggctagcgaggacgagcgcctgcagtggcacctgcccgagggcgctgctttcagctggctgcccaacccagaacgatctcttgaagaggactgtttcgaagtgaccagagaggctatgcttcacctgggcatcgacacacccacacaaaacaatatctttaaagtaaggagaaaggctacccccctgaagtttgggcgagatgacgggcagccttttgcctag

SEQ ID NO: 31532 - DNA, 744 bp, Artificial Sequence
  Description of Artificial Sequence: Synthetic coding sequence
atgcttaaatttctggtctggttcctgcaatggtgcgtgtgtgtactggttcagcccgctaaagagctactgcactgcctgaaaatgcagatgagaatttccaagtacaccaagtgtctccaagcacagattgcgatcaccgtgcctaaaacctggaaaaaacctaaggatcggactcggaccaccgaagaaatgcttgaggccgaactggaactcaaggcagaggaagagctcagtattgataaagtactggaatcagaacaggataaaatgtcccagggttttcaccccgaacgtgatccaagcgatctgaagaaggtaaaggccgtcgaggagaacggagaagaggccgaacctgttcgaaatggggctgaaagtgtatctgagggggaaggcatcgacgccaattcaggtagcaccgactcatcaggggatggcgtaacgtttccattcaaacccgaaagttggaaaccaacagacacagaggggaagaagcagtacgacagagaattcctgctggatttccagtttatgccagcgtgtatccagaaacctgagggcctcccaccaatctcagatgtggtgctggataagattaaccagcccaaactgccaatgcgcacacttgatcctcggattttaccccgaggtcccgatttcactccagcctttgccgattttggcagacagacgcccggtgggaggggagtgccagtctctgcctcatctctgcaacttacgtag

SEQ ID NO: 31533 - DNA, 981 bp, Artificial Sequence
  Description of Artificial Sequence: Synthetic coding sequence
atgctcggaggcgtgggcgaggaaaatgaaaaactctggagttttacgaagaaggcttcccacatccagctcgactcccttcccgaggtcccactgctggtcgacgttccctgcttgtcagcacagcttgatgactctatactgaacattgtgaaagaccacatcttcaaacacgggacagtcgcctcaagaccccctgtacagatagaagagctcatagaaaaacctgggggtatcatcgtgcgatggtgtaaggtggacgatgattttactgcccaggactatcggcttcagtttcgaaaatgtactagcaaccacttcgaggatgtctatgtcggatctgaaacagagttcattgtcctacacatcgaccctaatgtagattaccaatttagggtttgtgcgaggggcgacgggcgacaggaatggagtccctggtcagttcctcaaattggccattccaccctcgttccccacgagtggaccgctgggttcgagggctattccctgtcgagtcgtcgtaacattgctttgaggaatgatagtgagtcaagcggtgtgctgtattcccgagcccctacttacttctgtggacagacacttactttccgggtggagactgtcggccaacccgatagacgggatagtatcggggtatgcgccgaaaagcaggacggttacgattccctgcagagagatcaggcagtatgtatctccacgaatggcgctgtattcgtgaacgggaaggaaatgactaaccagctgcccgcagtgacaagtgggtctaccgtaacttttgacatcgaggctgtcacgctagggaccacttctaacaacgagggcggacactttaaactgcgggtgaccatttctagcaataatcgcgaagtcgtgttcgactggctgctcgaccaatcctgcggctccctctatttcggctgcagttttttttatcctgggtggaaagtgcttgtcttttag

SEQ ID NO: 31534 - DNA, 2436 bp, Artificial Sequence
  Description of Artificial Sequence: Synthetic coding sequence
atggtatcagaggaagaggaggaggaggacggagacgcagaggagacgcaagactctgaggacgacgaagaagatgaaatggaggaagacgacgatgacagcgactacccagaagaaatggaggacgacgacgatgacgctagctattgcaccgagtcgtcattccgctcgcacagcacatactccagtactcccggacggcgtaaacctagggtccataggccacgaagccccattttagaagagaaggacatcccacccctggagttccccaaatcaagcgaagatctgatggtacctaatgagcatatcatgaacgtcatcgccatctacgaagtattgaggaatttcgggaccgtgctgcgattgagcccattcagatttgaggatttctgcgccgctctagtgagtcaggagcagtgcaccctaatggccgaaatgcacgtggtcctgctcaaggcagttcttcgcgaggaggacacttctaacacaacgtttgggccagccgacctaaaggactccgtgaacagcacgctgtacttcattgacggtatgacgtggcctgaagtgcttcgcgtgtactgtgagtctgataaggagtaccatcacgtcctaccataccaggaggcggaggattacccttacggccctgttgagaacaagattaaagtactgcaatttcttgtagatcagttccttaccacgaatattgcccgagaggagcttatgtccgagggcgtgatacagtatgacgatcattgtcgcgtctgccataagttgggcgatttgttatgttgtgagacttgcagtgcagtgtaccatttagagtgcgtgaaaccccctttggaggaagtccctgaagatgaatggcaatgcgaggtttgcgtggcacacaaagttcctggcgtgactgattgtgtggctgagatccagaaaaataagccatatatacgccacgagcccattggatacgacagatctcgtaggaagtactggtttctgaaccgccgacttataattgaagaagacacggagaatgaaaacgaaaaaaagatatggtactatagcactaaggtgcagttagcagagcttattgattgtctcgacaaagactactgggaagctgaactttgcaaaattctggaagagatgcgagaggagatacatagacacatggacatcactgaggatctgactaataaagcaagagggtccaataagagcttccttgccgcagccaacgaagagatcctcgaatcaatacgagcaaagaaaggagatattgataatgtcaagtcacccgaggagaccgagaaggataagaatgaaactgaaaacgacagcaaagacgccgagaagaatagggaagaattcgaggatcagtcactcgagaaagatagcgatgacaaaactcctgacgacgaccccgagcaggggaagtcagaggagcccactgaggtcggggataaaggcaactccgtttctgccaatctgggcgataacaccaccaatgccacatcagaagagactagtccgtccgagggcagaagccctgtcggctgcctttctgagacacccgattctagtaacatggccgaaaaaaaagtggccagcgaactgccacaggatgtgccagttggagacttcaagagtgagaaatccaacggagagctctccgaaagcccaggggcaggcaagggagcatctggttccaccaggataatcactcgcctgcgcaacccagacagcaagctaagccaactgaagagccagcaagtggcggctgccgcacatgaggccaacaagttgttcaaagagggcaaagaagtgctggtcgtgaactcccagggggaaatttctcggctgtccacaaaaaaagaggtgataatgaaaggtaacataaataattattttaaacttggccaagaaggcaagtatagggtgtatcataaccagtactctaccaactcttttgccctgaacaagcatcagcaccgcgaggaccacgacaagcggaggcaccttgctcacaaattctgcttgacccctgctggcgaatttaagtggaacgggtccgttcatggatctaaagtgctcaccattagcactctccgcttgacgatcacacagctagagaataacattccctcctctttcctgcatccaaattgggcctctcaccgggctaattggatcaaagcagtgcaaatgtgcagcaaaccccgagagttcgctcttgcccttgctattctggaatgcgctgtcaagccagtagtcatgttgccaatttggagagagagccttggccacaccagattacaccgtatgacgagcatcgagcgagaggaaaaggaaaaagtgaaaaagagggaagagacagggagaaggcgtaatgacgccgcatccgatatgggtaagatccatatttctagttag

SEQ ID NO: 31535 - DNA, 1752 bp, Artificial Sequence
  Description of Artificial Sequence: Synthetic coding sequence
atggcccctgaactgacacccgaggaagagcaagcaacaaagcaattcctggaggagattaataagtggacggttcagtacaacgtgagcccactcagctggaatgtcgcggttaaattcttgatggctaggaaattcgatgtgctgcgggcaattgaactgttccactcctaccgagagacgcggaggaaggagggcattgtaaaactgaaaccccacgaggagccactcaggagtgagattttgtcaggtaaatttacgatactgaatgtgagagacccaaccggagcctcgatcgccttgtttactgccagactccatcaccctcataagagtgtgcagcatgttgtcctccaggccctgttttacctgctcgaccgggcagttgactctttcgaaacacaaaggaatgggttggtgtttatttacgacatgtgtggatccaattacgctaatttcgagctggatttgggtaagaaagtgctcaacctccttaagggagccttccccgctcgactaaaaaaggtcctcatagtgggggctcctatctggtttcgggtgccctacagcattatatccctgctgttaaaagacaaggtgcgcgaacgaatccaaatcctcaaaacctcggaggtgacacagcatttaccaagagagtgcttaccagaaaatctgggcggatacgtaaaaatcgatctggccacatggaattttcaatttcttccccaagttaacggccatcccgatcccttcgacgagatcattcttttttctctgccccctgcccttgactgggattctgtccacgtcccgggacctcatgcgatgactatccaggagctcgttgactatgtcaacgcgaggcagaagcaagggatctatgaggagtatgaagatattcgcagagaaaaccctgtgggaacatttcactgctccatgtcccccggtaatcttgaaaaaaatcgctatggcgacgttccatgcttagaccaaacccgagtaaagctgactaagcgctctgggcacacacagacagattatataaacgcatcctttatggacggctacaaacagaagaatgcttacatcgggactcagggccctcttgagaacacatatagagacttctggcttatggtttgggagcaaaaggtgctggtcatcgtaatgactacacgctttgaggagggcggtcgcaggaagtgcgggcagtactggcctctcgagaaggattcccgcatccggttcggctttctgaccgttaccaatctgggtgtggaaaacatgaatcactataagaagaccactctcgagatccataatacagaggagcgtcaaaaacggcaagttacccatttccagttcctttcatggccagactacggtgtgccttcatcagcggcttccttaatagactttctcagggtcgtaaggaaccaacagtcattagcggtttcaaacatgggtgccaggagtaaggggcaatgccccgaacccccaatcgtggtccattgcagcgccggtataggcagaactgggacattttgttctcttgacatttgtttggcgcagttggaagagcttgggaccctcaatgtgtttcagaccgtgtcaagaatgcgaacacagcgtgctttctccattcaaacacccgaacaatattatttttgctacaaggcgattctggaattcgctgaaaaggaggggatggtctcttccggccagaatttactagccgtcgaatctcagtag

SEQ ID NO: 31536 - DNA, 396 bp, Artificial Sequence
  Description of Artificial Sequence: Synthetic coding sequence
atggctatgactgctggaaccactaccacctttccgatgtctaaccatacacgcgaaagagtcaccgttgctaagctgactctggaaaacttctattctaatttaatccttcaacacgaggaacgtgagacacgtcagaaaaaattagaagtggctatggaagaagaagggctggcagacgaggagaagaagttaagacggtctcagcacgccaggaaggagactgaatttttgaggttgaaacgcacaagactcggcctagacgactttgaatcgctgaaggtgattggtcgcggtgcattcggggaagtgcgactggttcagaaaaaagacaccggccacatttacgcgatgaagattctgcggaagtcggatatgcttgagaaagagcaatag

SEQ ID NO: 31537 - DNA, 435 bp, Artificial Sequence
  Description of Artificial Sequence: Synthetic coding sequence
atggcaagtgtagcggctgctagagctgtaccagtcggtagcggcctcagaggcctgcagcgcacactgcctctcgttgtcattctgggggcaaccggcaccgggaagtctacactcgccctccagttaggacaacgcctcgggggagaaatcgtgtccgccgactccatgcaggtgtatgaaggattggatattattacgaataaggtgtccgcacaggagcagaggatttgccgccatcacatgatatcattcgtggaccccctagtgaccaactacaccgtggtcgacttccggaatagggccactgctctcatcgaagatatattcgccagagacaagattccaatcgtcgtcgggggtaccaattattacatcgagtcactgttgtggaaagtgctggttaatacaaaggtgtccctggttcatagttag

SEQ ID NO: 31538 - DNA, 1386 bp, Artificial Sequence
  Description of Artificial Sequence: Synthetic coding sequence
atggccgcttcttctttagaacagaagctctccagactcgaggccaaactgaagcaggagaatagagaagcacggagacggatcgacctaaatctggacataagtccacagcgccctcggccaacactccagctgccacttgctaacgatggtggatccagaagcccaagcagcgaatcctcaccccagcatcccacgcccccagccaggcctcgacacatgctgggactgcccagcacattgttcacccccagatctatggagagcattgaaatcgaccaaaaactacaagaaattatgaaacaaaccgggtacctgaccatcgggggacaggtgccaccttcactctggcgtggagaagggggtggtccagcacgtctggatccctcatgggaacgacagtggggagccggaggcggaggaaggcccggaactctgcagccgtcgttgtcaagtcagagataccaggctgagataaatgatctggaaaatcttggcgagatgggatctggcacatgcgggcaggtctggaaaatgcggttccgtaaaaccggtcacgtcattgccgtcaagcaaatgcggaggagcggaaataaggaggaaaataagcgcatcctcatggacctcgatgtggttctcaagtctcacgattgtccttatatcgtccaatgctttgggacttttattacaaataccgatgtctttattgctatggagcttatgggtacctgcgccgaaaagctgaaaaagcggatgcaagggcctattccggagcggatacttggaaagatgacagttgccatcgtgaaggcactgtactacttaaaggagaaacatggtgtcattcaccgcgatgtgaagccttcgaacatactactggacgaacgaggccagatcaaactctgtgatttcggcatctcaggaagactagtcgactcgaaggccaaaacacgcagtgcaggatgcgctgcctacatggccccagagcgaattgacccccctgaccctacgaaacccgactatgacatccgtgccgacgtgtggtccctcggaatcagtctagtggaactggccacgggacagtttccctacaaaaattgcaaaaccgattttgaggtcctcacaaaggtgttgcaggaggaaccacctttactgcccggtcatatggggttttccggggactttcagtccttcgtaaaggattgtctcaccaaggatcatcggaagcggcctaaatataacaaactccttgagcactcgttcattaaaagatacgagactttagaagtggacgtggcgtcctggttcaaagacgtaatggccaagaccgagtcaccccgtacctcaggtgtgctgtcgcagccacatctccccttctttaggtag

SEQ ID NO: 31539 - DNA, 1611 bp, Artificial Sequence
  Description of Artificial Sequence: Synthetic coding sequence
atggagacttccgatattcaaattttctatcaggaggaccctgagtgtcagaatctgagcgagaactcttgcccaccatccgaggtctccgacaccaatctgtacagcccttttaagccccgaaattaccagctggaactggcattaccggctatgaagggcaagaataccattatttgtgcgccaacgggttgcggcaagaccttcgtgtcgctgttgatctgcgaacaccacttaaagaaatttccacaggggcagaagggcaaggtggtattctttgctaaccagatccccgtgtatgagcagcaaaagtcagtgtttagtaaatattttgagcggcatggctatcgggtgacagggatttcaggggctaccgccgagaatgtgccagtagaacaaattgtcgagaacaacgatattattattcttacgccccagatccttgtgaataatcttaagaagggtactatacctagtttgtcaattttcaccctcatgattttcgatgaatgtcataacacgagcaaacagcacccctacaatatgattatgttcaattatctggatcagaagttaggtgggagtagcggtcctttgccccaagtgatcggccttactgcatcagtcggggtaggcgacgccaagaacacagatgaagcgctggactatatttgtaagctttgcgcttctctggacgcaagcgtcatcgccacggtcaagcataatctggaagaactggagcaggttgtttacaagccgcagaagttctttcggaaggttgaatctcggatctctgacaagttcaaatacatcatcgcccaattaatgcgcgacactgaaagtttggctaagcgcatttgcaaggatctggagaacctgagtcagattcagaaccgagagtttggcacacagaagtacgaacagtggatcgtgaccgtccagaaagcttgtatggtgtttcagatgccagacaaagacgaggagagcaggatctgcaaggctctgttcctctacacgtcacatctgcggaagtacaacgacgctctgattatttcagagcacgctcgcatgaaggacgctctcgattacctgaaagacttcttctcaaatgtcagagccgctggattcgacgagatcgagcaagatcttacacagcggtttgaggagaaactgcaggaattggagagcgtcagccgggaccctagcaacgagaacccaaagctcgaagacctgtgctttatcctgcaggaggagtatcacttaaaccccgaaacaatcacaatcctgttcgtgaaaacgcgggcattggtggatgcgctcaagaactggatagagggtaatccaaaactctccttccttaaacctggcatcctaactggacgtgggaagaccaatcagaatacaggcatgacactgcctgcccagaagtgtatattagacgcctttaaagcttccggtgatcacaatatactgatcgccaccagcgtggctgatgaaggcatcgacattgctcagtgtaatctcgtgatcctttatgagtacgtggggaacgtcataaaaatgatccaaacccgcgaagaggagcaggaagtggcctctgcctccttctag

SEQ ID NO: 31540 - DNA, 2883 bp, Artificial Sequence
  Description of Artificial Sequence: Synthetic coding sequence
atgagccgcctgatagttaagaaccttcctaatggaatgaaagaagagagattcagacaactgtttgctgcctttggaactctgaccgactgttcattgaagtttacaaaagatggcaaatttaggaagtttggatttattggatttaagagcgaggaggaagcccagaaggcccagaagcactttaataaaagttttatagacactagcaggattaccgtagaattttgcaagagctttggggatcctgcaaaacccagggcttggtccaagcacgctcagaagcctagtcagccaaaacagcctcccaaggacagcaccactccagaaattaaaaaggatgaaaaaaaaaaaaaggtggccggtcagctcgaaaagttgaaagaggatacagagttccaggaatttctaagcgttcatcaacggagagcgcaggccgcaacttgggctaacgacggattggatgccgaaccatccaagggtaagtcgaaacccgctagcgactacctcaatttcgacagcgacagcggtcaagaaagcgaagaggaaggcgcaggagaggacctggaggaggaggcgagcctggaacctaaggcagcagtacagaaagagctcagtgacatggactacctgaagtctaaaatggtgaaggctggctcctcgtcatcgagcgaggaagaggagtccgaggatgaggccgtgcactgcgacgagggatctgaggccgaagaagaggactcctcagcaacccccgtccttcaggaacgcgatagcaaaggcgctggacaggaacaggggatgccagcaggcaagaagcgcccacctgaagcacgagctgaaacggagaagcccgctaaccagaaggagcctaccacttgccacacagtaaagttacgtggcgctcctttcaacgtcactgaaaaaaacgtgatggaattcttggccccactgaaacccgtggctattaggatcgtgcgaaatgcgcatggcaataaaacaggctacatcttcgtcgacttttcaaatgaggaggaagtaaagcaagctctgaaatgcaacagggagtacatgggaggtcggtatattgaagtgttccgagaaaagaacgtgccaacaaccaagggagctcctaaaaacaccaccaagtcttggcaggggaggatcctgggagaaaacgaggaggaggaagacctggcggaatccggccgtttgtttgtgagaaatctcccctatacttctacagaggaagatttggagaaacttttttcaaagtacggaccactgtccgagctgcactatccgatagattctctgactaaaaagccgaaaggatttgcgtttattacctttatgttccccgaacacgcagtgaaagcctatagtgaagtggacggacaggtttttcagggtagaatgctgcatgtgttaccaagtactatcaagaaagaagcatcagaagatgctagtgcactgggttcttcttcctataagaagaagaaggaggctcaggacaaggcaaattctgcatcttctcataattggaacacactgttcatggggcctaacgccgtggcggatgccatagctcagaaatacaatgctacaaagagccaggttttcgatcatgagacaaagggaagtgttgctgtgcgcgtcgcactcggagagacccaactggtgcaagaggtgaggcgatttctgattgacaacggagtcagcctggattcctttagccaggccgcagccgagcgatctaaaaccgttatactcgttaagaatctgcctgctggaactctcgctgcccagctgcaggaaactttcggccatttcggctctttagggcgagtccttcttcccgagggtggaatcactgccatagtggagttcttggagcccctggaggctcggaaggcgtttcgacacctggcttatagtaaattccatcacgtgcccctatatttggagtgggccccagtgggagtgttttcttccacagctccacagaaaaaaaagctgcaagatacaccgagcgaaccgatggaaaaggatccagccgaacccgagacagttcccgacggggaaacgccagaagacgagaaccccactgaagagggagcagacaatagctcagctaagatggaggaagaggaggaagaagaggaggaggaggaggaaagcctgccgggttgtacgctattcataaaaaacctcaactttgacaccacagaggaaaagctaaaagaggtgtttagtaaggtcggcacagtgaaatcttgtagcatttcaaagaagaagaataaagccggagtgttattgtctatgggcttcggctttgtcgaatacaggaagccagaacaggcgcagaaagccctcaagcagctgcaggggcatgtggtggatgggcataaattggaagtacgcatcagcgaaagagcgacaaaaccagctgtgactctggcaaggaaaaaacaagtcccccgtaaacagacaacatctaagattctagtgcgtaacattccgtttcaggcgcattcaagggagattcgggagctgttttctacctttggggaactcaagacagtgcgtttacctaagaagatgactggtaccggcactcacagaggctttggattcgtcgactttctgaccaaacaggatgccaagcgggcttttaacgccctgtgccactcgacgcacctgtacgggagacgccttgtgctagaatgggcagactccgaggtcactctgcaggctctccgtcggaagaccgctgcccatttccacgagccacccaagaagaagagatcggttgtgctggacgaaattctcgagcagctggaaggcagcgatagcgactccgaagagcaaacattgcagttatag

SEQ ID NO: 31541 - DNA, 666 bp, Artificial Sequence
  Description of Artificial Sequence: Synthetic coding sequence
atgttagccgctggactcttggaagaattgagagacttccatcgcaggtataatcagaagaatgtatctgaaaattcgcaggattaccagcatggtatcttccagtcaatcggattcaaagagtttcatgaatacctgattacagagggcaagtgcacactcgaaacctccaatcagctcctcaaaaagggaattgaggccctgaagcaagtgactaaaaggtacgctcgcaagcagaatagatgggtgaagaatagatttctctctcgccctgggcctatcgttccaccagtttacggcctggaagtctctgatgttagtaagtgggaagagagtgtacttgagccggcattggagattgtgcagtcattcatacagggtcataaacctacggcaactcctatcaagatgccatataatgaggcagagaataagagatcctatcacctgtgcgatctctgcgaccggattattatcggagatcgggagtgggccgctcatattaagtctaagtcacacctaaaccagttaaagaagcggagacgccttgactctgatgccgtgaataccatcgaaagccagtccgtcagtcccgaccacaacaaggaacctaaggagaagggatcaccagggcagaacgatcaggagctgaaatgttctgtttag

SEQ ID NO: 31542 - DNA, 2649 bp, Artificial Sequence
  Description of Artificial Sequence: Synthetic coding sequence
atgcccagagtcaagcccaaactggagaagcagttgcaaaaagataaagaaaaagtagaagagttcaagtcaattcccgctaagtctaacaacatcatcaatgaaacaaccactcgcaacaacgcactggaaaaggagaaagagaaggaagaaaaaaagctcaaagaagtcatggacagcctgaagcaggaaactcagggattgcagaaggaaaaagaatctcgggaaaaagaattgatggggtttagtaagtctgtgaatgaagccaggtctaagatggacgtcgctcaaagcgagctagacatttacttgtcccgacacaataccgcggtttcacagctcaccaaggccaaggaggccctgattgccgctagcgagaccctgaaggagcgaaaggctgctatcagagacatcgagggaaagctgccacagaccgaacaggaattaaaggagaaggagaaggaactgcagaagcttacccaggaagaaactaactttaaatctctggttcatgatctgttccagaaggtggaagaagccaagtcatctttagccatgaatcgctcaagggggaaggtgttagacgccattatacaggagaaaaagagcggccgaatccctggtatctacggaagattaggtgacctcggggctatcgatgaaaaatacgacgtagccataagttcatgttgccacgccctggactacattgtggtggacagcatcgacatagcccaggaatgtgtgaacttccttaaaagacaaaacatcggagtggcgactttcataggcctcgataaaatggccgtctgggctaagaaaatgacggaaattcagactcccgagaataccccccgactgttcgatctcgtcaaagtgaaggacgagaaaataagacaggccttttacttcgctctgagagatacacttgtggcagataatttagaccaggcgacgcgcgtggcatatcagaaggatagacggtggcgggttgtaactctccaaggacagattattgagcaatcggggaccatgacaggtgggggtagcaaggtcatgaagggtaggatggggtcatccctcgttattgagatcagcgaggaggaggtaaataagatggaaagccagcttcagaatgattcgaaaaaggcaatgcagattcaggagcagaaggtgcagttagaggaaagggtcgtcaagcttcggcactccgaacgagaaatgaggaatacactggagaaatttaccgcaagtatacagaggcttatcgagcaagaggaatacctgaatgtccaggtcaaggagttggaagctaacgttctggccactgcccctgacaagaagaagcagaagcttttggaagagaatgtgtcagcctttaagactgaatacgacgctgtcgctgagaaagccggtaaagtggaagccgaagtcaagcgactccataatactattgtagagattaacaatcacaaactgaaagcccagcaggacaagctcgataaaatcaataagcagttagacgagtgtgcaagcgccattaccaaagcacaagtcgcaattaagacagcagatcggaacctgcagaaggctcaggattctgtcctcagaaccgagaaagaaatcaaagacactgaaaaagaggttgacgacctgacagccgaactcaagtctctggaggataaagccgctgaggttgtgaagaacacgaacgccgcagaggagtctctccctgaaattcagaaggagcaccggaacctgttgcaggaattaaaagtaatacaagaaaacgagcatgctttacagaaggacgctctgagtatcaagctgaagcttgagcagatcgacggtcacatcgcggaacacaattccaaaattaagtactggcacaaggaaatctccaagatttctctccatcccatcgaagacaatccaatcgaggaaatctctgtgctctctcccgaagacctggaggcgattaagaatcccgactcaatcacaaaccagatcgcactgctagaagcccgatgtcacgaaatgaaacctaacttgggtgcaattgccgagtataagaagaaagaggagctctacctgcaacgtgttgcagagctggacaaaataacttatgaaagggacagctttcggcaggcctacgaggacttgagaaaacagaggctcaacgagtttatggcgggtttctatataatcactaataagctgaaagaaaactatcagatgctgacccttggaggtgacgctgaacttgaactggtcgactcactggaccctttcagcgaaggaattatgttttcggtgagaccccctaagaaatcttggaagaaaatttttaacctgtccggaggcgaaaaaaccctgtcaagcctggcgctggtattcgccttgcatcactacaagcccacccccctatatttcatggatgagatcgatgccgcactcgacttcaaaaatgtgtcgatcgtggccttctacatctatgagcagaccaaaaatgcccagtttataattatttccctgcgcaataacatgtttgagataagtgaccggctgattggaatctataaaacatataacataacaaaatcagtcgccgtgaaccccaaggagattgctagtaagggtctgtgttag

SEQ ID NO: 31543 - DNA, 1038 bp, Artificial Sequence
  Description of Artificial Sequence: Synthetic coding sequence
atgttcctcacccggcctaaggtctgcgtggacctcaatagaagggtgactttatatggcgttttcactatacacttcagtcctaatgttccatctagatgccttcttctggagctattagatgtgagtgtctccgagttgcttttgtactcaagtcaccagggatgctcaatgtggatgatccagcactgcgcccgtgatgtcctcgaggcgctggctttcctgcatcatgaaggctacgtgcatgctgacctgaaaccacgtaacatcttgtggtccgcagagaatgagtgcttcaaactgattgattttggacttagtttcaaggagggcaaccaggacgtgaagtatatccaaacagacgggtatcgggctccagaagctgaactccagaactgcctcgcgcaggccggattgcagtcagacactgaatgtacatccgccgtggacctctggtcactgggcataatcttactggagatgtttagcggtatgaagctgaagcatacagtgcgcagtcaagagtggaaggccaattctagtgcgatcattgaccatattttcgcttctaaggctgtcgtcaacgccgctataccagcctatcacctacgcgacctgatcaagagcatgttgcacgatgacccaagccgcagaatcccggctgagatggctctttgcagtcccttcttcagcatacctttcgcgccacatatcgaagatctcgtaatgttgccaacacctgtgctccgtctgctgaacgtccttgacgatgattacctcgaaaatgaggaagagtacgaggatgtggtggaggatgtcaaagaggaatgtcagaagtacggccctgtggtctctcttcttgtccccaaagaaaacccagggcgtggacaagtttttgttgagtacgcaaacgccggagatagtaaggctgcacagaagctgttgacgggtaggatgtttgacggcaaattcgtggttgccacattttatcctctgtcagcctataagagggggtatctgtaccagacccttctttag

SEQ ID NO: 31544 - DNA, 954 bp, Artificial Sequence
  Description of Artificial Sequence: Synthetic coding sequence
atgtggctcgcgagggaaggcatagttgccccacttcccggtgaatggaagccatgtcaagacattactggtgacatttattatttcaactttgcgaacgggcagtcaatgtgggaccatccctgcgatgaacattaccggtctctggtgatccaggagcgggcaaagttgagcacctcaggcgcaattaaaaagaagaaaaaaaagaaggagaagaaggacaagaaggatcgcgacccgccaaaaagctcgcttgaaacacagccggaggaagggctgttgccaccttcttcattcctctgcagtctcagtcctcccagtgctcccggattggccgacctcgacctggaccaggagatgcaggctatatcagaagggagctataacaagggcaagtctcccggaatgcttggagacactccatggcggttcatgggggctcttcctaggaagcttcaacctctgagcaaagggcaacctagtcaaattcaccaagtgttcgccgacatggagaaaatccttgggcgagccccagcacaatgtcgcagggaactcggagaccaacaaggactggaaaagctgcagaaggcaaccgaaaaaatctatctcggcttctctgaccccgagacagaggaactcgagatgcggagtcgccagcagaaactgggcacacctgccccacagaacaccgggctgctgcagaacatgcaagatgttgttgagagcaggaaccaggcatctgtgcactctaagctgagcgaagcaatcaaaggactgccacttaagggcgaacaacattcccactccctagcgaagctgagccctacagggccaggcggagataagggacagtcacccatcccaatgtggatatgctgtcgcctgcgggcaagcaactgtcgcaacacctcagccgcatggagactcaagctgaagcgatccagtacttgctag

SEQ ID NO: 31545 - DNA, 162 bp, Artificial Sequence
  Description of Artificial Sequence: Synthetic coding sequence
atgggaaattccgactcccagtacactctgcagggatctaaaaatcactctaataccattacaggtgccaagcagattccatgcagccttaagattaggggcattcatgctaaggaagagaaaagtcttcacggctgggggcatggatccaatggagcatag

SEQ ID NO: 31546 - DNA, 1203 bp, Artificial Sequence
  Description of Artificial Sequence: Synthetic coding sequence
gcatggctgcaaagtgccggtgaactgcctagtgacggcggatgttccaggctgagatggcaggcccacctcgaatttacccataatcatgatgtcggcgatctgacatgggataagattgctgtgagcctccccagaagcgaaaagcttagatctcttgttctggcaggtattccacatggcatgagacctcagctctggatgcggttgtccggggcactccaaaagaaaagaaattcagagctgagttatcgagaaatcgttaaaaacagttcaaacgatgagacgatcgctgccaagcagatcgagaaagaccttttaagaaccatgccatcaaacgcttgttttgctagcatggggagcatcggggtgcccaggctcaggagagtgctccgcgcattagcctggctctatccggagattggatactgtcagggaacgggtatggtagccgcttgtctgctcctgttcctcgaagaggaagacgccttttggatgatgtccgcgattattgaggacctgcttcctgcatcttatttcagcactaccctcctgggcgttcagacagaccagcgcgtgctccggcaccttattgtacagtacctgccaagactagataaattgctgcaggaacacgatatagaactgagtctgatcacgctgcactggtttctcaccgcctttgcttctgttgtggatatcaagctgctgcttagaatttgggacctgtttttttatgaaggtagccgagtgctgttccagctaacactaggcatgttgcatcttaaagaagaggaacttattcagagcgagaattctgcaagcatctttaatactctcagcgacatcccttcgcaaatggaagacgcagaactgcttttgggtgttgcgatgagactggctgggagcctgactgatgtcgccgtcgagacacagcggaggaagcatctcgcttacttgatcgccgatcagggccagctgcttggcgcaggcaccttgacgaacttgagtcaagtggcccaggatggcggacctcatcttgacccccaacacaccgggaggcggggacacctcgaggtgcagagcgcaggagctgctgagaacaagcccgcattgccagccttgccaccgagccttgcccagagtgaccactcttgtggtgtcatccaggcttctagcgggtttgtccatctgaggttctag

SEQ ID NO: 31547 - DNA, 294 bp, Artificial Sequence
  Description of Artificial Sequence: Synthetic coding sequence
atgctgagggggacaaaggagatggataatatgtctcctcgcctgcgggctttccttagcgaacctatcggagaaaaggatgtgtgctgggtggatgggatttctcatgaactcgcaatcaacctggtgaccaaaggcattaacaaggcgtatattctgctgggccagtttctcttaatgcacaagaacgaggccgaattccagcgttggctaatttgctgcttcggggcaactgagtgcgaggcccagcagacttcgcactgtctcaaggagtggtgcgcctgcttcctgtag

SEQ ID NO: 31548 - DNA, 1011 bp, Artificial Sequence
  Description of Artificial Sequence: Synthetic coding sequence
atggagtatcttggaggtggctccgctctggacctcctgaagccagggcctctggaggagacatacattgccacaattttgagagagatccttaaggggctcgattaccttcactctgagaggaagattcaccgtgatatcaaggcagccaatgtcctgctgagtgagcagggcgatgtgaaactggccgactttggagtcgctgggcaattgaccgacacgcagatcaagcgcaacaccttcgtaggcaccccgttctggatggcgccagaagtaataaagcagtccgcctacgatttcaaagccgatatttggagcttgggaatcaccgccattgagctggcaaagggagagccccctaactccgacctccaccccatgcgcgtgctgttcctgatcccaaagaacagtcctcctactctggaaggccagcattcaaaaccgtttaaagagttcgttgaagcttgtttgaataaggatccacgttttcgccctactgctaaggaactgctcaaacacaagttcatcacgagatacactaagaaaacaagttttcttaccgagctcattgatagatacaaacgatggaaaagcgagggccacggagaggaaagctcctcggaggattccgacattgacggggaggccgaagatggcgaacaggggcctatatggacttttcctccaacaatccgcccaagtccccatagcaagttacataaaggaaccgccttgcattccagtcaaaagcccgcagagccagtaaagcgccagccgagatctcaatgccttagcacgttagtgcggccagtcttcggggaggtgttctctcagttgaaggagaagcacaaacagtccggcggatccgttggagcccttgaggaactagagaatgctttcagtttagccgaggagtcttgtcccggaatttctgataaacttatggttcacctggtggaacgtgtccagcgctttagtcataaccggaatcacttgacttccacgcgttag

SEQ ID NO: 31549 - DNA, 1455 bp, Artificial Sequence
  Description of Artificial Sequence: Synthetic coding sequence
atggtgcacgaaacctcctatagtgctcaatttaagggtgaggcatccaaaccaaccaccgctgataacaaggtcattgataggcggagaatccgctccttgtacagtgaacccttcaaagaacccccaaaggttgagaaaccttcagtccagtcctcaaagcccaagaagacaagcgctagccataagcccacccgaaaagcgaaagataaacaggcagtgtccgggcaagcggctaaaaaaaaatcggcggagggcccttctaccacaaaacctgatgacaaagagcagtcgaaagagatgaacaacaagctcgcggaggctaaagagagtttagcccagccggtgagtgacagcagtaagacacagggccctgtggccaccgagcccgataaagatcaggggagtgtcgtgccgggtctgctcaagggtcagggacctatggttcaggaaccccttaaaaagcagggttctgtagtacccggacctcccaaagaccttgggccaatgatccccttgccagtcaaagatcaggatcacactgtgcccgagcctcttaaaaatgagtcccctgttatcagcgcccctgtgaaggatcaaggaccaagcgtgccagtccctcctaagaaccagtctcccatggtgcctgcaaaagttaaggaccaggggtctgttgttccagagtccttgaaagatcaagggccacgaattcccgagcctgtgaagaaccaggcaccaatggtacccgctcccgtcaaggacgagggtcccatggtgagcgcttcggtgaaggatcaagggcctatggtatcagcccctgtcaaggaccaaggacccattgtgcctgcacctgtcaaaggagagggacccattgtaccagccccagttaaggatgagggccctatggtgtccgccccaattaaggaccaggacccgatggtgccagagcaccccaaagacgaatccgctatggccaccgcccctattaagaaccagggctccatggtgagcgagccagtcaaaaaccagggtctggtagtctcgggtccagtgaaagaccaggacgttgtggtgccagagcatgctaaagtccatgactcggctgtggtggcccctgtcaagaatcaggggcctgtggtgcccgagtctgttaagaaccaggaccccattctacccgtgctggtgaaagatcagggccctaccgtgctgcagccacccaaaaatcagggcagaattgtcccggagccccttaagaatcaggtccccattgttcctgttccactcaaggatcaagatcctcttgtgcccgttcctgcaaaagaccagggcccagcggtaccggaaccacttaagactcaggggcctcgggaccctcagctgccaaccgtctcacctctacctcgggtaatgattccaaccgctcctcataccgaatatatcgagagtagcccttag

SEQ ID NO: 31550 - DNA, 2103 bp, Artificial Sequence
  Description of Artificial Sequence: Synthetic coding sequence
atggccctgggggaggaaaaggctgaagcggaggccagtgaggatacaaaggcgcagtcctacggcaggggctcctgcagagagcagccacccaggctggaggctgaagggggactgatttcacccgtatggggagccgaaggaattcccgcacccacatgctggattggaacagatcctggcggaccaagccgggcacaccagcctcaggcctctgatgcaaatagggagccggtggctgagcggagtgaaccagcactcagcggtctgccccctgccactatggggtccggcgacctcctgcttagtggggagagtcaggtagaaaagactaagctgtccagctctgaagagttcccccagacattaagccttccccgtaccacaacaatttgcagtggacacgacgccgataccgaggacgatccctcccttgccgatctgccccaggctctcgacctgtcccaacagccccattcaagtggccttagctgtctgtcacagtggaagtcagtcctctcaccgggtagcgcagcacagccttcttcttgtagcatatctgcctcaagcaccgggagctccttacagggccatcaagagcgggcagaaccaagaggagggagcctcgctaaggtgtctagcagcttggagcccgttgtgccccaggagcctagttccgtggtgggactgggccctcgccctcagtggagcccccagcctgtctttagcggaggtgacgccagcggcctgggaagacggaggttgagttttcaagccgaatattgggcttgcgtcctgcccgactccctccccccatcccctgatagacattctcccctgtggaacccaaataaggagtatgaagacctcctcgactacacctatcctctgaggcccggaccacaactgcctaaacacctggacagtagagtaccagcagatccagttcttcaggactcgggagtggacttggactccttcagcgtatctccagcaagcacgctcaagtcacctacgaacgtgtcaccaaattgcccacccgctgaggctacagccttgcctttttcaggaccaagggagccctcactcaagcaatggccgtctagggttccgcagaaacagggcggaatggggctcgccagttggtctcagctagctagtacccccagggcaccaggctcacgtgacgctcggtgggaacggagagaacccgctctgcggggtgccaaagatagattgacaatcgggaaacatctggacatgggctcaccccagctgcgtactagagacagaggatggccttcccccaggccagagagggaaaagcgcactagccagtccgcacggaggcccacttgcaccgaatccaggtggaaatcggaggaggaggttgagagcgacgatgaatacctggcactgcccgctaggctcactcaggtttcttcgctggtcagctatctggggagtataagcacgctggtcaccttacccacaggcgacatcaagggacagtctcccctcgaggtgtcagactctgacgggcctgcctctttcccttcgagcagttcccaatcacagctaccaccaggtgccgctctccaaggctctggagaccccgagggccagaatccctgcttcctgcggtcgtttgttagggcccatgattctgctggtgaaggcagtctgggatcttctcaggccctcggtgtcagctcaggactcctcaaaacccggccttccctgccagcccgacttgacagatggcctttttccgaccccgacgtagaaggacagttaccccgtaaaggcggtgagcagggtaaggagagcctcgtccaatgcgtgaaaaccttttgctgtcagctggaagaacttatttgttggctgtacaatgtggcggacgtgaccgaccacggaactgccgcacgatctaacctaacatctctgaagagctccctgcagctgtacagggtgatctgcgggcctgggtctggattgttccctcataaatctgtagccaaattactggactacaaagttaagtcccagatcacaaacgtatggtacgtgatagcacagctgaccattatcccagagatttag

SEQ ID NO: 31551 - DNA, 1626 bp, Artificial Sequence
  Description of Artificial Sequence: Synthetic coding sequence
atgaaaagttatgtttcagagacaatggctagcccaggaaaagacaattaccggatgaaatcatataagaataacgctctcaacccggaggagatgcgcagacgaagggaagaggagggaatacagcttagaaagcaaaagagagaacagcagctcttcaagcggagaaacgtggaactgattaacgaggaagccgctatgtttgacagtctacttatggattcatacgtgtctagtactaccggagagagcgtgatcacgagggaaatggtggagatgttgttctccgacgatagtgacctgcagctggctacaacccagaaattccggaagctgctctctaaagagccaagcccccctatagatgaggtcattaatacccccagggttgtagacaggtttgttgagtttctcaagaggaacgaaaactgtactctgcagtttgaggctgcttgggctttaacgaacattgcgtcagggacctcacagcagaccaagatagtgatcgaagctggagccgttccgatctttattgagctgctcaactccgatttcgaggacgtgcaggaacaggcagtgtgggcactgggtaatatcgccggagactcttcagtttgccgcgattacgtcctgaattgctctatcttgaatccccttctgaccctgctcacgaagtcaaccaggctcacaatgacacggaatgcagtgtgggcgttaagtaatctctgtcgaggtaagaaccccccacctgaatttgccaaagtgtcgccttgccttcccgtgttgagcagacttctgttctcatcagacagcgatctgctggccgatgcctgttgggccctttcgtatctaagcgatggccctaatgaaaagattcaggccgttatcgactccggcgtgtgccgacggttggtggagcttctgatgcataacgattacaaggtcgcctccccagctctgcgagctgtcggcaacatagtaaccggagatgacatccaaacacaggtgatcttgaactgttcggcgctgccttgtctgttgcatctgctttcctctccaaaggagtcgatccggaaggaggcttgttggactatctccaacatcactgctggaaatcgtgcccagattcaggcagtaattgatgcaaacatctttccagtgttgattgagattctgcagaaggccgaattcaggactagaaaagaagctgcctgggcaatcacaaatgccacctcaggaggaacccctgagcagattagatatcttgtttccttagggtgtataaagccactgtgtgatctcctcactgtgatggattctaagattgttcaagtcgctctgaacggtttggaaaatatcctgagactcggcgaacaagaggggaagcgaagcggcagcggtgtaaatccttattgcggtttaattgaggaagcatatggactggacaagattgaattcttgcagtcgcatgaaaatcaagagatctaccaaaaggcgttcgatctcatcgagcactattttggcgtggaagacgatgattccagcttagcccctcaggtcgacgagacacaacagcagtttatctttcagcagccggaggcccctatggaggggtttcagctctag

SEQ ID NO: 31552 - DNA, 1716 bp, Artificial Sequence
  Description of Artificial Sequence: Synthetic coding sequence
atgttagactgcggcatgcacatggggttcaacgatgacaggcgatttcctgatttctcttatatcacgcagaacgggcgactgactgactttctggactgcgtcattatctcacactttcacctcgatcactgtggagccctgccttacttctctgagatggtgggatatgatggacccatctacatgacacaccctactcaagccatatgcccaattttgctggaggattataggaaaatcgctgtggacaagaaaggggaggccaattttttcacatcccaaatgatcaaagattgtatgaagaaggtggtggccgtgcacctgcaccaaacagtccaggtagatgacgaactggaaatcaaggcgtactatgccggtcacgtacttggcgcagcaatgtttcagattaaggtgggctctgagagcgtggtgtataccggagactacaacatgacgcctgacaggcatctgggggctgcttggatcgataagtgccgacctaacttgctcatcaccgaaagtacatatgcaaccaccattagggactctaagcgctgtagggagcgagattttctgaaaaaggttcacgagactgtggaacgtggagggaaggtgctcattcctgtcttcgccttgggaagagcccaggaactgtgtattctgctggaaaccttttgggagcgaatgaacctcaaagtgcccatctacttttctacaggtctcacagagaaagcaaatcattattacaaactcttcatcccgtggactaatcagaaaattcggaaaacattcgtgcaacgaaatatgtttgaatttaagcacataaaagcttttgacagggccttcgccgacaatccaggccctatggtggtcttcgccactccaggaatgttgcacgcgggtcaaagtttgcaaatctttcggaagtgggcagggaacgagaagaacatggtgatcatgccaggatattgcgtgcaagggaccgtcggccataagatcctgtcaggccagcgcaagctggagatggaaggcaggcaggtgctggaagtcaaaatgcaagtggaatatatgtcattctcagcccatgcagatgccaaaggcattatgcagctcgtgggccaagccgagcccgagagcgtgctcttggtacacggcgaggccaagaagatggagttcctcaagcagaagatcgaacaggaactgcgcgtgaactgttacatgccagccaacggcgagacagtgacgctgccaacctcaccttctatccctgttggaatatcgttgggcttactcaagagggaaatggctcaggggctattgcctgaggctaaaaagcctagattacttcatggaactctgattatgaaagactctaacttccgtctggtgtctagcgagcaagcactgaaggagctgggtctggcagagcaccagcttaggttcacctgtcgtgtgcaccttcatgatacacgcaaagagcaggaaacagcgctcagagtgtacagccatcttaagtctgtactgaaagatcactgtgtgcagcacttgcccgatgggagcgtcaccgtggaaagcgtgctcctgcaggctgcggctccttcagaggatccgggaactaaggtgctgttggttagctggacataccaggatgaggaactgggctcattcttgacttctctgctgaagaaaggtttaccccaggcccctagttag

SEQ ID NO: 31553 - DNA, 2232 bp, Artificial Sequence
  Description of Artificial Sequence: Synthetic coding sequence
atggaggcagccgctgtgacagtcactaggtctgccactaggcgcagacggagacaacttcagggcctcgctgcgcctgaggccggtacccaagaggaacaggaggaccaagaacctcgacctcgcaggaggagacccggacgcagtattaaggacgaagaagaggagacagtcttcagggaggtcgtcagtttctcaccagatcccctccctgtgcgttactacgataaagacacgaccaagccaattagcttttacctctcaagcctcgaggaacttctcgcctggaagcccagactcgaggatgggttcaacgtcgccctggagccactcgcctgccgccagcctccactcagttcgcagcggcctcggaccctcttatgccatgatatgatgggtggctacctggatgaccggttcattcagggctctgtggttcagaccccttacgccttttaccattggcagtgcatcgatgtttttgtatatttctctcatcacactgtgactatccctcctgtgggttggaccaacacagcccacaggcacggagtgtgcgtgctcggcacgttcattaccgagtggaatgaaggcggaaggttgtgcgaagccttcctagcaggtgacgagcggtcctaccaagccgtggctgataggctggtgcaaatcacacagtttttcagattcgatggatggctaattaatattgagaattcattaagcctggctgctgtcggaaacatgccccctttcctcagatacttgaccactcagctgcataggcaggtgccgggaggcctggtgctgtggtacgactctgtcgtgcagagcggccagcttaaatggcaggatgagttaaatcagcacaacagggttttcttcgatagctgcgatggtttctttaccaactataactggcgggaggaacatttggagagaatgctgggtcaagctggcgaacgcagagctgatgtgtatgtcggagttgatgtgtttgccaggggcaacgtggtggggggaaggtttgacacggacaagtcattggagctcatccgcaaacacggcttcagtgttgctctcttcgcacctggatgggtgtatgaatgtctggaaaagaaggacttcttccaaaatcaagacaaattctggggcaggctagagcgctatctaccaacccattccatctgcagtttacctttcgttacatccttttgtctgggcatgggcgcaaggagagtctgctacggccaggaggaggcagtaggcccttggtatcaccttagcgcccaggaaattcagcctctgtttggagagcatcggctcggaggagatggcagggggtgggttagaacccactgttgcttggaagacgcatggcatggtggttcctcgcttttggtgcgaggtgtgataccacctgaggtcgggaatgtggccgttaggctgttttcacttcaggcacccgtcccccctaaaatatacctctctatggtttataagttggaaggacccaccgacgtgacagtggcgctggaactgaccacaggggatgctggatcatgccatattggtgggatttcagtgctgaacgcagaaacttccagtagacactccctgagacctctgagagtgcctcccacaaaattagccaggtgggtcggcagatgcggcagacagttatccggtggatgggttcaacattgctatgaggtctccctgaggggttgccttctgctggacttgctcgtctgctttagcagaccacccggttcaagggaggaggaatcctttacatgtcgactcggcgagattcaggtggtcgatgccgctagcttactggcaccactgccccaggttcaggccgtaaccattagtcacattaggtggcagccatctgcatctgagcgggaggggccaccggctcttctacagcttagttgcacgctccactggagcttcctgctcagtcaggtgcgctgcttccgtattcactgctgggggggaatgtctgacgattctcccggaagagaactgcctaggcccgaaatgccaatgttcctgggactagccttcgccacgcagtatcgcatagtcgacctactggtcgaggcggcaggcccagggcaggatcgaaggatggagtttctcgtggagcctgtccccaaagaagggtttcgagtccctcaagcagagtggggcagagcagttctgttatattccgccccagcatag

SEQ ID NO: 31554 - DNA, 396 bp, Artificial Sequence
  Description of Artificial Sequence: Synthetic coding sequence
atggagctccgcgttcatatggtctctcacactggggagatgccatataaggtcaggctggggctatctccaggccctgggcttggagggcctcgtatcctccctgccgaacctttcacatggggtgccgtaaggcatctcccccatagtagctgccagggcgcttgtcttccgtgtctcccctgcctcagcagcgcccctctgtccaggcaggggctctccgcggcttctccccctagatccttgcttgggccttgtttctttccgtggcgtacaggccttgcctccagcggacagttgagtcccgaggccctgctttgcaccatattgcatacacgcagcggggtgctgccagaatccagtcatcgcggattacccctggtcccagccctgtag

SEQ ID NO: 31555 - DNA, 909 bp, Artificial Sequence
  Description of Artificial Sequence: Synthetic coding sequence
atggagcacggcattgtgaaagattggaacgacatggagcgcatttggcagtacgtctattcaaaagaccaactgcagactttcagcgaggaacaccccgtgctgctgactgaggcacctcttaatccacgtaagaatcgagagcgcgcagcggaagtttttttcgagactttcaatgtgcccgcactgttcattagtatgcaggctgttttgtcactgtatgcaaccgggagaacaacgggcgtcgttcttgactctggcgacggagttacacacgctgtccccatctacgaaggtttcgctatgccacattctatcatgaggatagacattgcgggacgggacgtgtcccggttcttgagactgtacctcagaaaagaagggtacgattttcactcatcatcagagtttgaaattgtgaaggccattaaggagagagcatgttacctaagtatcaacccgcagaaggacgagaccctagaaactgagaaggcccagtattatctgcccgatgggtcaacaatcgagattgggccatccaggttcagggctcctgaattgttgttcagacccgatctcattggcgaggagtccgaaggtatccatgaagtgctggtgttcgccatccaaaagtccgacatggacttacgacgcaccttgtttagtaatatcgtactcagcggaggttccacgctttttaaggggttcggcgaccgcctgttgagcgaggtcaagaaactggcccctaaggacgtgaagattaggatcagcgccccacaggagaggctgtatagtacctggattgggggttctatcctcgcctctctggacaccttcaagaagatgtgggtttccaagaaagaatatgaggaggacggtgcaagatccattcatagaaaaactttttag

SEQ ID NO: 31556 - DNA, 780 bp, Artificial Sequence
  Description of Artificial Sequence: Synthetic coding sequence
atgttacggtgtgggcagatgatgcttgcccaggccctgatttgcagacacctaggacgagattggtcttgggaaaagcaaaaggaacagcccaaagaataccagagaattctccagtgcttcttggataggaaggactgctgttatagtatccaccagatggcacagatgggtgtgggcgaggggaagtctataggtgagtggtttggtcccaatactgtggcccaggtgctgaagaagctggctctgttcgatgaatggaactctctagccgtctatgtatcgatggataacactgtagtcatcgaggacataaagaaaatgtgtcgggtactcccactgagcgccgatactgcaggcgataggccaccggattccctgactgcctcaaatcaatccgacgaactgatcttcctcgacccacacacaactcagacattcgtggatactgaggagaacggtaccgttaacgatcagacttttcattgcttacaatcaccccagagaatgaatattttaaatctggacccctccgtcgcacttgggttcttttgcaaggaggagaaggattttgacaattggtgttcgctggtgcagaaggaaatattgaaggaaaacctccggatgtttgaattggttcagaagcacccttcccattggcccccttttgtgccaccagctaaacccgaggtgactaccaccggagctgagtttattgatagcacggaacaactagaggagttcgacctggaggaagacttcgagatcctgtccgtctag

SEQ ID NO: 31557 - DNA, 957 bp, Artificial Sequence
  Description of Artificial Sequence: Synthetic coding sequence
atgcgggcacagagcgacgagctggagaaaattgaaaaacatggtagaagctccaaggacaaggaaaatgccaagtcattagacaagcctgaacagtttctttacgagctctcgctcatacccaatttttcagagcgagtgttttgcatcctcttccaatccacattttccgaaagtatttgtagcatcagaaggaaactggagctgttgcagaaattgtgtgagacacttaagaacggcccaggtgtgatgcaggtgttaggcttggtcctggccttcggcaactatatgaatggcggaaacaaaacacgtgggcaggccgatggctttgggctggacatcctcccgaagttgaaggacgtgaaatctagcgacaactctagatcactcctgagttatattgtttcctattatctcaggaactttgatgaggatgcaggcaaagagcagtgcctctttccactgccagagccccaggatctgttccaggcatcacagatgaagtttgaagactttcagaaggacctccggaagctcaagaaggatcttaaagcctgtgaggtggaggctgggaaggtgtaccaggtctctagcaaagagcatatgcaacctttcaaggagaatatggagcaattcattattcaggccaaaatcgaccaagaggccgaggaaaactccctgaccgagacacacaagtgcttcctggagactacggcctacttcttcatgaaaccaaaactcggggaaaaagaggtaagtccaaacgccttcttcagcatttggcatgagttctcaagcgatttcaaagacttctggaaaaaagaaaataaactgttgctccaagagcgagtgaaagaagcagaagaagtgtgtagacagaagaaagggaagtctttgtataaaattaagcctcgacatgactctggcatcaaggctaagatcagtatgaagacctag

SEQ ID NO: 31558 - DNA, 345 bp, Artificial Sequence
  Description of Artificial Sequence: Synthetic coding sequence
atgtcctctagtatgtggtatattatgcagagcatccagagcaagtacagcctttctgagcggctgatccgtactatcgctgctattcggagcttcccccatgacaatgtggaagacttgatccgtgggggagccgacgtcaattgcacccatggaaccctgaaacccctacattgcgcttgcatggtgtctgacgccgattgcgtcgagttgctacttgagaagggagctgaggtcaatgccctggacggatacaaccggacagcactccactacgccgctgaaaaagatgaggcttgtgtcgaagtcctcctggagtatggagccaatccaaatgcactctag

SEQ ID NO: 31559 - DNA, 1365 bp, Artificial Sequence
  Description of Artificial Sequence: Synthetic coding sequence
atgtcaacttttcgccaggaagatgtcgaagatcactacgagatgggggaggagttaggaagcggccagtttgctatcgtccgaaagtgtcggcagaaaggcacggggaaagaatatgccgcaaaattcattaaaaagagacggctctcttcatctcggagaggggttagccgcgaggagatcgagagagaagtgaatattctaagagagataagacatccgaacatcatcaccctgcacgacatctttgaaaataagacagatgtcgtgctcatcctcgagctggtctctggtggcgaactgttcgactttttggcagagaaagagtccctgaccgaagacgaagcgactcagtttttaaaacaaatcctggatggcgtacattacctgcattcaaaacggattgctcactttgacctgaagcctgagaatattatgctccttgataagaacgtgcccaaccccagaatcaagcttatcgactttggcattgcccataaaatcgaagccggtaacgaattcaaaaatatttttggcactcctgaatttgtggcccctgagatcgtcaactatgaacctctgggattggaggccgatatgtggagtatcggggtaattacatatatattgctaagcggggctagcccattcctgggagagacgaaacaggagacactgacaaacatcagtgctgtcaactatgactttgatgaagagtacttcagcaacacttcagagctggccaaggactttatccgaaggctcttagtgaaggaccctaagaggaggatgaccatcgctcaaagcttggagcacagttggattaaggccattcgccgacgaaatgtaagaggggaggactcaggtagaaaacccgagcgaaggaggctgaagacaacacgcctgaaagagtacactataaagagccattcctctctcccccctaacaatagttacgctgattttgagaggtttagtaaagtactggaggaagcagccgctgctgaggagggcctgagggagctgcaaagatcaaggcgactgtgccatgaagacgtggaggcattagctgcaatctatgaggagaaggaggcatggtatagagaggagtccgactctttgggccaggatctgcggcgactgcggcaagagctcttgaaaacagaggcgttgaaaagacaagcacaagaggaggccaaaggcgctctccttgggacctctgggctgaagcgcagattctctcggttggaaaatcggtacgaggctctagctaaacaggttgccagtgagatgcggtttgttcaggacctcgtgagggccttggagcaggaaaagctacaaggtgtggaatgcggactgagatag

SEQ ID NO: 31560 - DNA, 1047 bp, Artificial Sequence
  Description of Artificial Sequence: Synthetic coding sequence
atgggtaaggattattataaaatcttgggcatacccagtggagctaatgaagacgaaataaagaaggcctataggaagatggctcttaaataccacccagacaagaataaggaaccgaacgccgaagagaagttcaaggaaattgcagaggcgtacgacgtactgtctgaccccaagaagagaggactctatgaccaatatggagaagaaggtctgaagacgggcggaggcacaagcggcggttcctctggcagctttcactatacattccacggcgatcctcatgcaacttttgcctccttctttggtgggagcaatccatttgacatctttttcgctagctctaggtccacacggcctttctcagggtttgaccccgatgatatggacgtggacgaggacgaggacccattcggggcatttggcaggttcgggttcaacgggctgagcagaggtcctcgacgagctcccgagcctctctaccctaggcggaaggtgcaagaccccccagtagttcatgaacttcgtgtttcactggaggagatctaccacgggtcgactaaaagaatgaaaattacacgcaggcgcctcaacccggatggccgtaccgtccggaccgaagacaagatcttgcacattgtgatcaagcgaggatggaaggaaggtaccaagattacgtttcctaaagagggagacgccacccctgataatatacccgctgacatagttttcgtgctcaaggacaaaccccacgcacattttcggagagacgggactaacgttctgtatagcgcattgatttccttgaaggaggccctgtgcggttgtacagttaatatccccaccatcgacgggagggtgatccccttaccttgtaacgacgtgatcaagccgggaaccgtgaagcgtctgcgtggagaggggctgccctttcctaaggtcccgactcagcgtggagacctgattgtggaattcaaggtcagatttccagaccgtttgactccgcagactcgtcaaatcctgaaacagcatcttccctgcagttag

SEQ ID NO: 31561 - DNA, 2163 bp, Artificial Sequence
  Description of Artificial Sequence: Synthetic coding sequence
atgtatggtagcgctaggtctgtcggaaaagttgaaccttctagtcaatcacccggacggtctccccgattaccccgaagcccaaggcttggccatagaagaactaacagcacaggaggatccagcgggagctcagttggcggaggctctggaaaaaccctgagcatggaaaacattcagagcctgaacgccgcatacgccacaagcgggccaatgtacttatccgatcacgaaaacgtggggagcgagacgcccaagtccactatgacccttggacggtccggaggccgactgccctacggagttcgtatgacagctatgggttcgtcccctaacattgcgagctctggagttgcctctgataccatagccttcggcgagcaccacctgccaccggtgagtatggcctcaacggtccctcattctcttcggcaagccagggataacaccatcatggaccttcagacacagctgaaagaagtgctccgtgagaacgacttgttaaggaaggacgttgaagttaaggaatccaagctgagttcgtcaatgaactccattaagacgttttggagccctgaacttaagaaagagagagccctccgtaaagacgaggcatcaaagataactatctggaaagagcagtatagggtggttcaggaggagaaccaggtggacgcactgagactcaggttggaggaaaaggaaacaatgttaaacaagaagactaagcagattcaggatatggcggaggaaaagggcacgcaggccggagagatccacgacctgaaagacatgctggatgtgaaggaacgcaaggtgaatgtgctgcagaagaagattgaaaacctccaggagcaactgcgcgataaggagaaacagatgtctagtctgaaggagcgcgtcaagagcctgcaggcagatacgacaaatacagacactgctttaacaactcttgaggaggctctggccgagaaagagcgcactatagagagattaaaagaacagagggaccgcgacgaaagggagaagcaggaagaaattgataactataaaaaggacctgaaggatctgaaggaaaaagtgtccctgctgcagggagacctgtcagaaaaagaagcaagccttttggaccttaaagagcatgcatctagcctcgcatcttcggggctgaaaaaggattcccgtttgaagacccttgagattgcactggaacagaagaaggaagaatgcctcaagatggagtcacagctgaagaaggcccatgaggccgctttagaggctcgggcatcacccgaaatgtcagaccggattcagcatctggagagggagattactagatataaggacgagtcatctaaagctcaggccgaggtagaccggcttctagagattctaaaagaggtggaaaacgaaaagaacgataaagacaagaagattgccgagcttgagtctttaaccagcagacaggtaaaggaccagaataagaaggtggccaatctgaagcataaagaacaggttgaaaagaaaaaatccgctcagatgctcgaagaggctcggagaagggaagacaacctgaatgatagttctcagcaactacaagattcactgagaaaaaaagacgacaggatagaagaacttgaagaagccctgcgcgagagtgtgcagatcaccgctgagcgggaaatggtgctcgctcaggaagaatcggcaagaaccaacgcggagaagcaggtagaggagcttctgatggcgatggagaaggtcaagcaggaactagagagcatgaaggcaaaacttagctccacccagcaatccctggccgagaaggagacccacctcactaatttgcgcgctgaacggagaaaacacctggaggaagtgctggaaatgaagcaagaagccttgctggctgcgatttcagagaaggacgccaatatcgctctcctcgagctttcatctagtaaaaagaaaacccaggaggaggtggccgctctgaaacgggaaaaggacagactggtacagcagctgaagcagcagacccagaaccgtatgaaactgatggccgataactacgaagacgaccattttaaatcttctcactccaatcagacgaaccataagcccagccccgaccaggacgaagaagaaggcatatgggcctag

SEQ ID NO: 31562 - DNA, 768 bp, Artificial Sequence
  Description of Artificial Sequence: Synthetic coding sequence
atggccgcttccactatgtcggtgtgctcctctgcgtgcagcgactcatggcaggttgacgcttgccccgaatcatgctgtgagccgcattgctgtgctctttcctgctgtgctcccgctccttgtcttacactggtgtgcaccccggtctcccgggtcagcagcccttgttgccaggctgcctgcgaaccaagcccatgccagtcaggctgcacttcctcttgcaccccgtcctgctgtcagcagagtagctgtcagcccgcttgctgcactagctccccctgtcagcaagcctgctgtgttccagtgtgttgtaagcccgtgtgttgtctgcctacctgcagtaaggacagttcaagctgctgccagcagagctcttgtcagcccacctgttgcgcaagctcctcttcgcagcagtcttgctgtgttcctgtctgctgcaaaccagtatgttatgttcccacatgctctgaggattcgagctcttgctgtcagcaatcctcttgtcatccagcttgttgtaccagcagcccttgtcagcaagcctgttgtgtgccagtacgatgtaagcctgtttgttgcaagccaatctgttgcgtcccggtatgtagcggcgcaagtacatcatgctgccagcagagctcttgtcagccagcctgctgtaccacgagttgctgtcgcccaagttcaagcgtgtcattactttgccgccctgtttgccgacctgcctgctgctccctctgctctggtcaggaaagctcctgttag

SEQ ID NO: 31563 - DNA, 2562 bp, Artificial Sequence
  Description of Artificial Sequence: Synthetic coding sequence
atgtcagagaaggtggattggctgcagtcacagaatggagtctgtaaggtcgacgtgtactctccaggggacaaccaggcccaagattggaagatggacacttccacagaccccgtaagagtcctcagttggctccggagagacctagaaaagtcaacagcagaattccaggacgtgcgattcaagcccggagagtctttcggtggcgagacaagcaattccggtgaccctcataagggcttttcagtggattactataacacaacaaccaagggcacacccgaaaggctacatttcgaaatgacccacaaagaaataccctgtcaaggcccacgggctcaactgggaaacggcagcagtgtggatgaggtgtccttctatgccaaccgtcttaccaatcttgtaatagcaatggctaggaaggaaatcaatgagaagatcgatggatccgaaaacaagtgcgtctatcaaagcctctatatgggcaacgagcctactcctactaagtcgctcagcaaaattgcctccgaactagtaaacgagacggtgagtgcatgcagccgaaacgccgcacctgataaggctcctggatccggcgaccgcgtgagcggctcctctcaatctccacctaatctcaaatacaagtccacactgaagattaaggaaagcacgaaggagcggcagggacctgatgataagccacctagcaagaagagcttcttttacaaggaggtgtttgagtccagaaatggggactatgcgagagagggcggacggttcttccccagagagcgcaagagattccggggacaagaacgtcctgatgacttcaccgcatctgttagcgagggaattatgacttatgcaaacagcgtggtcagtgacatgatggtctctatcatgaaaactctaaaaattcaggtaaaagatacaacaatcgctaccatactcctgaagaaagtgttactcaaacacgcaaaggaagtggtgagcgatttgatcgactccttcctgagaaatctgcatagcgtcaccggcacacttatgaccgatacccagttcgttagtgcagtcaaacgcacagtgtttagtcatggctcccagaaagcaacagacatcatggacgctatgctgagaaaactctataacgttatgttcgctaagaaagtacccgaacatgttcgtaaggcccaggacaaggccgaaagttactctttgatcagcatgaaaggaatgggcgaccctaagaacaggaacgtgaatttcgctatgaaatccgagactaagcttagggagaagatgtactctgagcctaaatcagaggaggaaacttgcgccaagactctgggggagcatatcattaaggaaggccttacgctctggcacaagacccagcaaaaggaatgcaagtccctggggttccagcacgcggcattcgaggcccctaacacacaaaggaagcccgcttctgacatatccttcgagtaccccgaggatattggaaatctgagtctacctccttacccccctgaaaaacccgaaaatttcatgtatgactccgattcatgggctgaagatcttatcgtttcagctttgctgcttattcaataccatcttgctcaggggggacgcagggacgcccgttctttcgtggaagcggctggtaccacgaattttccagcaaacgagcctcctgtcgcccctgacgagagctgcctgaaaagtgcgccaatcgtgggggaccaggaacaagccgaaaagaaggacctgcgttccgtattctttaatttcatccgcaacctactgtcagaaaccatttttaaaagagaccaatctcccgaacctaaagttccggagcagcccgtaaaggaggaccgtaaactttgcgaacgacctctcgcctcctcacctccaaggctatatgaggatgatgagactccgggagccttgtctgggctgacgaagatggccgtttcacagatcgatggccacatgagtggacagatggtcgaacatctcatgaactccgtgatgaaactgtgtgtcattatcgcaaaatcttgtgacgcgagtttggctgagttgggcgatgataaaagcggggatgcgtcgcggttaactagcgccttccctgatagcttgtatgagtgccttcccgctaaaggcacaggttcggcggaggccgtgctgcagaatgcttaccaggcgatacacaatgagatgcgcggaacgtcgggccagccaccagagggatgcgccgctccaacggtcatagttagcaaccacaatctgacagacacagttcagaataaacagctgcaggccgtgttgcaatgggttgccgcatctgaattgaacgttccaatattatactttgctggcgacgatgagggaatccaggaaaagctcctccagttgagcgccgctgcggtggacaaagggtgcagcgtaggagaagttctacagtcagtgctgaggtatgagaaagagcgccagttgaatgaagcagtgggcaacgtcactcccctgcagcttctggactggctgatggtaaacctgtag

SEQ ID NO: 31564 - DNA, 1263 bp, Artificial Sequence
  Description of Artificial Sequence: Synthetic coding sequence
atggttcatggtagaaaggcgaatgcccaagtgatggagagcgaggaattcatgctgcttcctgcgaaccaactgatcgatattatctccagtgacgagttgaacgtccgtagcgaggaacaggtgtttaacgcagtaatggcctgggtcaaatattcgatccaagagcgacggcctcagctgcctcaagttctacagcacgtgagactgcccttactctctccaaagttcctcgttgggacggtcgggagtgatccactcattaagagcgatgaggaatgcagggatctcgtagatgaggcaaaaaactaccttctgcttccacaggagagacctcttatgcagggtcccagaactcggccacgcaaaccgatccggtgcggtgaagtcctctttgcagtgggtgggtggtgctcaggtgacgctatcagttccgtggagagatacgatccccagaccaacgaatggaggatggtagccagcatgagtaagaggcggtgtggggttggggtgtccgttcttgacgatctgttgtatgctgtgggcggacatgacggctcttcctatcttaacagtgttgaacgatacgatccaaaaactaaccagtggagctcggatgttgccccaaccagtacctgtcgcacctctgtcggcgtggccgtccttgggggttttctctatgccgtgggagggcaggatggtgtgtcatgcctgaatatcgttgagcgatatgaccccaaagagaataagtggacgcgggtggcgagcatgagcaccaggaggctcggagtcgcagtcgccgtcctagggggattcctctacgctgtgggaggtagtgatggtacctctcccctgaacacggttgaaagatataacccacaggaaaatcgctggcatactatcgcacccatgggaacccggcgtaagcacctgggatgcgcggtttatcaagatatgatatatgcagtgggaggacgggacgacaccaccgaactgagttctgccgagcgatacaatcccaggactaatcaatggtcacccgtggttgccatgacatctcggcgatctggagtggggctggcagtagtgaatggacagctgatggcagttggaggattcgacggaacaacgtacctgaagactatagaggtgtttgatcccgatgccaacacatggagactatatgggggtatgaactataggagacttggaggaggcgtgggggttatcaaaatgacacattgcgagtcgcacatttggtag

SEQ ID NO: 31565 - DNA, 519 bp, Artificial Sequence
  Description of Artificial Sequence: Synthetic coding sequence
atgtcctgcaccattgagaaggctttagccgacgcgaaagccctcgtcgaacgtctcagggaccacgatgacgctgcagaatctctgatagagcagacaactgccttaaacaagcgggtggaagctatgaagcagtatcaggaagagatccaagagctgaatgaagttgcccgtcaccgtcccaggtctacactggtaatgggaatccagcaggagaataggcagattcgagagctgcagcaggaaaataaggaactccggaccagccttgaggagcatcagtcggccctagaactcatcatgtccaagtacagagagcaaatgtttcggttgctgatggcaagcaagaaagacgaccctgggataattatgaaattgaaagaacagcacagtaaaatcgacatggttcacaggaataagtctgagggattttttctagacgctagtaggcatatcctggaagccccacaacatggcctagagagacgccaccttgaggcaaatcagaatgtgcactag

SEQ ID NO: 31566 - DNA, 813 bp, Artificial Sequence
  Description of Artificial Sequence: Synthetic coding sequence
atgctgtttatatttcccctatcccttccctggcgaccatcttgctggaaggagagctgttcgaccgggcaacgtcaggccggacgatcccgcgaagacagcgttaccccgccacccagcagcccctggcccactcctccagccggtgccatgtctacgaagcaggaagcccgtcgcgatgagggcgaggcaaggacccgtggacaggaggctcagctgcgcgatagagctcacctgtcactacataaggactcagcggatctgctgccactggatagtctcaaacgcttgggaaccagtaaggacttacagccccgaagtgttattcagagacgcctggtcgaggggaacccaaactggctccaaggcgagccccctcgcatgcaggatctgatacatggccaggagagcagaaggaagacatctcggaccgagatccccgctctgttagtaaattgcaagtgtcaggaccaacttttaagggtggccgtagacactggcacgcagtataatcgtatctccgccggatgtctaagccgcttgggcttggagaaaagagttctgaaggctagcgccggtgacttagccccaggccctcctacacaggtggagcagttggagcttcagctaggccaagaaaccgtagtctgctccgcccaggtggtggatgcagagtcccccgagttttgtctgggcctacaaacactcctctccttaaaatgttgcatcgacctggaacatggggttctcaggctcaaggcacccttctcagagttgccctttctgcctctgtaccaggagcctggccaatag

SEQ ID NO: 31567 - DNA, 243 bp, Artificial Sequence
  Description of Artificial Sequence: Synthetic coding sequence
acctcttgttgtcgccctagcagctccgtgagcctgctctgccacccagtctgtagctgttcccctgcttgtcagcccacttgctgcatccattccccatgccaagcgtcctgttatgtgcctgtgagctgccaacccattatctatgtcactccttcatgtcagagctccgggtgctgccagcccccttgcactacggccttgtgcaggccaatctcctgcagcaccccatcttgctgctag

SEQ ID NO: 31568 - DNA, 2013 bp, Artificial Sequence
  Description of Artificial Sequence: Synthetic coding sequence
atggcccttggggaagaaaaagcggaggccgaggccagtgaggatacaaaggcacagagctacggaagaggatcttgcagagagagggaactggatatacccggacctatgtcaggcgagcagccacccagattggaagccgaaggaggcctgatatcccccgtctggggcgctgagggtatccctgcgcctacctgttggatcggaacagacccgggaggcccttccagggcacatcaaccccaagcctctgatgccaatcgggagcccgtggccgaaaggagtgaaccagccctttctgggctgcctcccgctacaatgggcagcggagatcttctgttgtctggtgagagccaggtcgaaaagacaaaattatccagctctgaggaattccctcagactctaagtctaccaagaaccacgacgatatgcagtggacacgacgcggatacagaggacgatccctccctggccgacctgccgcaggcccttgacctgagtcaacaaccgcacagttcaggtctgagctgtctctcccaatggaaaagtgttctgagccccggatcagccgctcagcccagcagttgcagcatttctgctagctcaaccggcagtagcctccagggtcatcaagaacgagctgagccccgaggagggagcctggccaaagtcagctcgagcctggagccagtggtaccacaggagccttcgtcggtcgtgggtctggggccacgacctcagtggagtccacagccagtcttttccggtggagacgcttctggactggggcgacgaaggctgtcctttcaggccgagtattgggcctgcgtattacccgactcactgcccccttctcctgatcgccatagccccttgtggaacccaaacaaagaatatgaagacttgctcgattacacatatccactgaggcctggtccgcaactacccaaacacctggattcccgagtccctgccgaccccgtgctgcaggacagtggggtggatctggattcatttagtgtatcccctgcatcaaccctgaaatcacctaccaatgtctctccaaattgccctccagctgaagccaccgctttgccctttagtggcccacgggagccctcgctgaagcaatggccctctagagtgccgcagaaacaggggggtatgggcctggcctcctggtcacagcttgctagcactcctcgggcaccaggatccagggatgccaggtgggagaggcgcgagcccgcactaaggggcgctaaggacaggctaacaatcggtaaacatttggatatgggttctcctcagctgcggactcgcgataggggctggccatccccaagacccgaaagagagaagaggactagtcagagtgctcgcaggcccacttgcacggagtcgaggtggaagtcagaggaggaggtggagagtgatgacgaatatctggctctcccagcacgcctcactcaggtgtcctcacttgtctcctatctcggttctatcagcaccctggtcacactgcctaccggggacataaagggccagagtcccctggaggtatcagactcggacggaccagccagctttccatctagcagctcacaatctcagcttcctcccggtgcagcactgcagggcagtggagaccccgaaggacagaacccttgtttccttcgctcatttgtgcgtgctcatgatagcgcaggagaaggctcactgggttcctcgcaggccctcggagtgagcagcgggctcctcaaaacacgcccaagtctgccagcacgcttagatcgatggcctttctccgaccccgatgttgagggtcagctcccgaggaaaggcggagagcagggcaaagaaagccttgtgcagtgcgtcaagactttctgctgccaactggaagaacttatctgttggctctataatgtggctgacgtgactgaccacgggacggctgcacgttccaatctgacatcactgaaatctagtcttcagctgtatcgattttag

SEQ ID NO: 31569 - DNA, 702 bp, Artificial Sequence
  Description of Artificial Sequence: Synthetic coding sequence
atgaaacagttgatcgaagacactgagaagaacaaagtctacgtggctatggttactgactacggggcttttataaagatccccggatgccgaaagcaaggccttgtgcatcgtacccacatgagttcctgccgagtcgataagccctctgaaattgtagatgtgggagataaagtgtgggtgaaattgattggtagggagatgaaaaacgacaggataaaggtttctttatctatgaaggtcgtcaaccagggcactggaaaggacctggacccgaacaacgtaattattgagcaagaggagcggcgaaggagatccttccaggactatacgggccaaaaaatcacactggaggctgtactgaataccacttgtaaaaagtgcggctgcaagggacactttgcaaaagattgtttcatgcaacctggaggcactaaatattccctaattcctgatgaggaggaagaaaaagaggaggcaaaaagcgccgagttcgagaagcctgatccaacacggaatccctcaagaaaaaggaagaaagaaaaaaagaaaaagaaacatagagaccgtaagtcgtccgactctgacagttctgacagcgaatctgatacagggaaacgggcaagacacaccagcaaggatagcaaggccgcaaaaaaaaagaagaagaaaaagaagcacaaaaaaaagcacaaagagtag

SEQ ID NO: 31570 - DNA, 492 bp, Artificial Sequence
  Description of Artificial Sequence: Synthetic coding sequence
atgggatggcgtctgcttacacaagatgaaggtcccgcactcgtccccggagggaggctcggggacctgtgggactatcatcagcaccggtacttgcagggtgtgcctgaaggggttcgcgatttgccacccggagtggccctcccgctcgaatcaaacctggcctttatgaacggagttagctttacgaagggctgttacattggacaagaactcactgcacggactcaccatatgggggttattcggaagcggctgttccctgtgcggttcctcgatccactgcctacgagtgggatcacccctggcgcaactgtgctgactgcaagtggccaaaccgtggggaaatttcgggcaggacaggggaacgtaggcctggccctactctggtctgagaagataaagggacccctgcatatacgcgctagcgaaggagcacaggtggccctcgccgcatccgtgcctgattggtggcccacagtctctaaatag

SEQ ID NO: 31571 - DNA, 804 bp, Artificial Sequence
  Description of Artificial Sequence: Synthetic coding sequence
atggccatggagatgcgcctgcccgtcgcacggaagcccctgtccgagcgcctgggccgtgacaccaagaagcacctcgtagttcccggtgataccatcactactgatactgggttcatgagaggtcatggtacctacatgggcgaggaaaagttaattgcatccgtggcaggcagtgtcgagcgggtgaacaagctcatctgtgttaaagcacttaaaactagatatatcggggaagtgggggatattgtggtcgggagaatcactgaggtgcaacagaaaaggtggaaagtggagactaatagcaggctcgactctgtactgctcctgtcgagtatgaacctgcccggaggcgaactgaggcgccgttcagccgaagacgagctggcgatgagaggattcctccaagaaggcgacctaatcagcggcgttcttgtgcaggtgagcccatcgctggtaaagcgtcaaaaaacacacttccatgatctaccatgtggcgctagcgtcatacttggaaacaatgggttcatatggatctaccctacccccgagcataaagaggaagaggcgggaggctttattgctaatctggaacccgtatccttggcggatcgcgaggtcatcagtcgtcttcggaactgcataatctctcttgttactcagcgaatgatgctgtacgacacatcaattctgtattgttatgaggcctccctgccgcaccagatcaaagacatcctcaagcccgagatcatggaggagattgtgatggaaacacgacagcgtctgctggagcaggaagggtag

SEQ ID NO: 31572 - DNA, 3111 bp, Artificial Sequence
  Description of Artificial Sequence: Synthetic coding sequence
atgcccgtcttcaaagaggtgaaggtgcacctcttggaagatgccggaattgaaaaggacgcggtgactcaggaaacacggatcagcccctccggcatagactccgcgacgaccgttgcagccgctacagcggcagcaatcgccacggctgctcctctgataaaggtgcagtcggatctggaggccaaggtcaattcagttaccgagctgctttctaaacttcaggagacagataagcacctgcagcgagttactgagcagcagacgtccattcaaaggaagcaggaaaaactccattgtcacgaccacgaaaagcagatgaatgtgttcatggagcagcacattaggcacttagagaagttacagcagcagcaaatagacattcagacacacttcataagtgcggctctgaagacatcctcttttcagccagtatcaatgcctagctcccgggcagttgagaagtacagtgtgaagccagagcatccgaatctggggtcctgcaatccctcactgtataatacattcgcgagcaagcaggccccactgaaggaagtggaggacacctcattcgacaagcagaagagtccacttgaaacccccgctcctagaagatttgctcctgttcctgtgtctagggacgacgagctgagtaaaagggagaatcttctggaagagaaggagaatatggaggtgtcgtgtcacaggggtaacgttcggctgctggagcagatcctgaataataatgatagtttaactagaaagtccgaatcaagtaataccacgtctttgacacgctcaaaaatcgggtggacccctgagaagacgaataggtttcccagctgcgaggagctcgagactaccaaagtgacaatgcagaagtccgatgacgttctgcacgatcttggtcagaaagaaaaagaaactaattcaatggttcagccaaaagagtctctgtctatgctcaaacttcccgatctgcctcaaaactcagtgaagcttcaaaccactaacacaacccgctcggttctaaaagacgctgaaaagatccttcgcggagttcagaacaataagaaggttctagaggaaaaccttgaagccatcatccgggcaaaggatggggctgccatgtattccctgatcaatgccctttctacgaacagggagatgagcgagaaaataaggatcaggaaaaccgttgacgagtggattaagacgataagcgctgagatacaggatgagctctctcggaccgactatgaacaaaagagattcgaccagaaaaatcagaggaccaaaaagggacaaaatatgactaaagatattcggacgaatacacaggacaaaactgtaaataagagtgtgattccacgcaagcacagccaaaagcagatcgaagagcacttccgaaacctgcccatgaggggcatgcccgcaagctctctgcagaaagaacgcaaagaaggcctgctcaaagccacaacggtcatccaggacgaagactacatgctgcaggtttatggaaaaccagtttatcagggccatcgcagtactctaaaaaaagggccatacctgaggttcaactctccctcccctaaaagcagaccccagcggcctaaggtgatcgaacgagtgaagggcaccaaggtcaagtcgattcgaacccagactgacttctatgccaccaagccgaagaagatggattccaagatgaaacacagcgtgccagttctaccacatggtgatcagcaatatctcttctccccatcccgagagatgccaactttttctggcacacttgaaggacacctgattcccatggcaatcttgttggggcagacacaaagtaattctgatacgatgccgccagcaggggtgatcgtgagtaagcctcatcctgtgaccgttacaacttctatccccccatcttccagaaaggtcgagactggcgtgaagaaacctaatatcgccatcgttgaaatgaaatcagagaagaaagatcctccccaattaacagtgcaggtactgccgtctgtagacattgactcaatctctaactcgtccgccgatgtcctgagcccactgtcgtctcctaaggaggccagtctgccacccgtgcagacgtggatcaaaacgcctgagataatgaaggtggacgaagaagaggtgaagtttcctggcaccaacttcgatgaaatcattgacgtgatacaggaagaggagaaatgtgacgaaattcccgactccgagcccattctagagtttaatcgatctgtgaaggccgactcaacgaagtacaatgggcctccttttccgcctgtggcctcaacttttcagcctaccgcagatatcctggacaaggttatcgaaagaaaggagacacttgaaaacagcctgatacagtgggtggagcaggaaattatgtccaggattatctcaggtctgttccccgtgcagcaacagatcgcgcctagtatcagcgtgtccgtgagcgagacatccgaaccacttacctcagatattgtagagggaacgtcttcaggtgccttgcaactcttcgtggatgcaggtgtgccagtgaatagcaacgtcatcaagcacttcgtgaacgaggcattagccgaaacaatcgccgtgatgcttggcgacagggaggcaaaaaagcaagggcctgttgccaccggagtaagcggcgacgcctctacaaacgaaacgtacctccctgcacgagtgtgcacaccactccccacgccccagcctactcccccttgcagccccagttctcccgcaaaggaatgcgttcttgtgaaaaccccagatagttcaccgtgcgactccgaccatgacatggcatttcccgttaaagaaatttgtgcagagaagggagatgatatgcctgcaattatgctggtgaacactcctacagtgactccgaccaccacaccccctcccgcagctgccgtgtttactccaacattaagtgatatctccattgacaagctaaaggtttcatcacctgaactgcccaagccatggggtgatggtgacttaccccttgaggaagaaaatccaaactcccctcaagaagagttacaccccagagctatgtag

SEQ ID NO: 31573 - DNA, 3351 bp, Artificial Sequence
  Description of Artificial Sequence: Synthetic coding sequence
atgtatggttcagccagaagtgtcggaaaggtggagccttcatcgcaaagccccggacgctccccaaggctgcctcggtctcctcgcttaggacaccgcagaaccaattccacagggggatcctcaggcagctcagttggcggaggcagtgggaagactctgtctatggagaacatccagagccttaacgcagcttatgccacatcgggcccaatgtacctctctgatcacgaaaatgtcggaagtgagactcccaagagcaccatgaccctggggcgatccggcggtcggctcccatacggagtccggatgactgccatgggaagttcgcccaacattgccagctcaggggtggctagtgacacgattgcatttggcgagcaccatttgcccccagtttccatggcgagcacagtcccccatagcctgcggcaggcaagggacaatacaatcatggatctacaaacccagctcaaggaagtgctaagggagaacgaccttctaagaaaagacgtggaggtgaaggaatcaaaactctctagctcaatgaactcgattaaaaccttctggtctcctgaattgaagaaggagcgggctctgagaaaagacgaagcaagcaaaatcacaatttggaaggaacagtaccgggtggtgcaagaggaaaaccaacacatgcagatgaccatccaagcactccaagacgagctgcggatccagagggatctcaaccagctctttcagcaggactcgagctcccggacgggtgagccttgcgtcgccgagctgactgaagagaacttccagaggctacacgctgaacatgaaaggcaggccaaggagctgtttcttttaaggaaaactctggaggagatggaactgagaattgagacacaaaaacagacactgaacgctcgggatgaatccattaagaaactgctggagatgctgcagagtaagggactcagcgctaaagcgaccgaggaggatcacgagcgcactagaaggctggctgaagccgagatgcacgtgcaccacttggaatccctgttagaacagaaggaaaaggagaatagcatgctaagggaagaaatgcatcgtagatttgagaacgctccggacagcgccaaaactaaggccctacagacagtaatcgagatgaaggacagcaaaataagcagtatggagcgaggcttgagagatctagaagaggaaatccagatgcttaagtccaacggtgcactgtctactgaggagcgggaggaagagatgaagcagatggaggtgtatcgtagccattcaaaattcatgaagaataaggtcgagcagctgaaggaggaactgagcagcaaggaagcccagtgggaggagctaaagaagaaggccgctggcctgcaggcggaaatcgggcaagttaaacaggaactgtccaggaaagataccgaattactggcgctgcaaaccaagctggaaaccctcactaaccagttttcagattccaaacagcacatcgaggtcctaaaggagagtttaaccgctaaggaacagagagctgccatactgcagacggaggtggatgctctgagacttagactcgaggagaaagagaccatgctgaataaaaagaccaaacagatccaggacatggcagaggagaaaggtacccaggccggagagatccatgatctgaaggatatgctggatgtgaaagagcggaaagtgaacgtgcttcagaagaagatcgagaatctgcaagaacagcttcgcgacaaggaaaaacaaatgtcatcactgaaagagcgtgtaaaaagtctccaagcggatactacaaacacagatacagctttaactacactggaagaagcactggccgaaaaggagcggactatcgaacgattgaaagaacagcgcgatcgggatgagcgagaaaaacaggaagagatcgataattataagaaagatcttaaggacctgaaggagaaggtgtcgctcctccaaggcgatctgagcgaaaaggaagccagcttgctggacctgaaggagcatgcttcctcgctggctagctctggacttaaaaaagatagcaggttaaagactttggaaatagcgttagagcagaaaaaagaggagtgtctaaagatggaaagtcaactgaagaaggctcacgaagccgctctcgaggcaagggctagcccggaaatgtcagaccggatccagcacttagagcgggagatcactaggtacaaggacgagagttccaaggctcaggcagaagtcgaccgacttctcgaaatactaaaggaagtggagaatgaaaagaacgacaaagataagaaaattgcagagctcgagaggcaggtcaaggatcaaaacaagaaagtggcgaatctcaaacacaaagaacaagttgagaaaaagaaaagcgctcagatgctggaagaggcacgccgaagggaggacaatctcaatgacagctcacaacagctccaggacagcctgagaaagaaagacgacaggatagaggagctcgaggaggctctgagagaatccgtgcaaatcaccgccgagcgtgagatggttctcgcacaggaggaaagtgccaggacaaatgccgaaaagcaggttgaggaactattgatggccatggagaaagttaagcaggagctggaatctatgaaggctaaattgagctcaacccaacagagcctcgccgagaaggagacccatctgaccaatcttcgagcggaaaggcgcaagcatctggaagaagtcttggagatgaagcaagaggccctactggccgcaatttctgagaaggacgccaacattgcgttgctggagctctctagttctaaaaagaaaacacaggaagaggtcgccgctcttaaacgcgagaaagatagactggtgcaacagctgaagcagcagacgcagaatagaatgaagctgatggcggacaactatgaagacgatcactttaagagctcccacagcaatcaaaccaaccacaaaccgtcccccgaccagattatccagccactcttagagctggatcagaataggagcaaattgaagctgtacatcggacatctgacgaccttgtgccacgacagagaccctctcattttgaggggactcactccacctgcttcttacaatcttgacgacgatcaggccgcatgggaaaatgagctgcagaagatgaccagaggacagttgcaggacgaacttgaaaaaggcgagcgggataacgcggagttacaggagttcgctaacgccatcctacagcagatcgcagatcattgtccagacatcctggagcaggtggtgaatgccctggaggagtctagctag

SEQ ID NO: 31574 - DNA, 816 bp, Artificial Sequence
  Description of Artificial Sequence: Synthetic coding sequence
atgagacaactgcatcctgaagccattgcagcaattcagtcaaaggctctattcagcaaagcggaggaacaactgctatctaaggtgggctcaacgtcgcagcccacccttgagacgttccaagatctactacaccgccacccagacgctttctacctcgcacgaaccgccaaagccctgcaggcgcactggcaactgatgaaacagtactatctactggaggaccaaactgtgcaacccctgccgaagggtgaccaggtcctcaactttagtgacgcagaggatttaatcgatgattccaaattaaaagatatgagagacgaagttctggaacatgagctgatggtcgcggaccggaggcagaaacgtgaaattaggcagctggagcaggaattgcacaagtggcaggtgctggtggattccataacaggtatgtcgtccccggacttcgacaaccagactttagcagtgctgcgtggacggatggtgcgatatctaatgcggtcccgagagattaccttaggccgagcgactaaagataatcagatagacgtcgatttatcattggaagggccagcgtggaaaatcagtcggaagcagggagtgattaaattgaaaaacaatggggatttcttcattgctaacgaggggcgtaggcccatttatatagatgggaggccagttctgtgcggatcgaagtggaggttatctaacaattctgtggtggaaattgcctctctccgttttgtgttccttattaatcaggatctaatcgctctgatccgggcagaagctgctaaaataactccccaatag

SEQ ID NO: 31575 - DNA, 2751 bp, Artificial Sequence
  Description of Artificial Sequence: Synthetic coding sequence
atggagatgcctctacctcctgatgatcaggagcttcgcaatgtgatcgacaagttagctcagttcgtcgcccgaaacggaccagagttcgagaaaatgacaatggagaagcagaaggataatccaaagttcagtttccttttcggaggtgaattctactcgtactacaaatgcaagttagctttggaacagcagcagctaatctgcaagcaacaaacccccgagctggaacccgcagctactatgccgccactgccgcaaccacccctggcacccgctgcccctattcctccggctcaaggcgcaccctcaatggacgaattgatccagcagtcccagtggaacctccagcagcaagaacagcacctgctcgctctgagacaagagcaagttaccgctgcagtcgcccacgctgtggaacagcagatgcaaaaactgctggaagaaacgcagctggatatgaacgagttcgacaacttgctgcagcccataatcgatacatgcacaaaggacgccatatcagcagggaaaaattggatgtttagcaatgccaaaagtccccctcattgcgagctgatggccggtcatttacgaaaccgcatcactgctgatggagcacattttgaattgaggttacacctgatatatctgatcaacgacgtcctgcaccactgtcagcggaagcaagccagggaattactggccgctctccagaaggttgtggtgccaatctactgtacatcattcctcgcagttgaagaggacaaacagcagaagattgcgcgtctcctccagctgtgggagaagaatggctactttgatgactcgattattcaacagttacagtcacccgctcttggactgggccagtaccaggctacgcttattaacgaatattcatccgtggtccaacctgtgcagctggcattccagcaacagattcagaccttaaagactcagcatgaagagtttgttaccagtttggctcaacaacagcagcagcagcaacagcagcaacagcaactccagatgccccaaatggaagccgaggtgaaggccaccccgcctcctccagccccacccccagctccagcgcctgcccctgcgattccacccacaacccagccggatgactcgaaaccaccaattcagatgcctggctcgtcagaatacgaagcgccaggcggagtccaggatccagccgctgcaggccctaggggtccaggaccacatgatcagattcctcctaataaacctccctggtttgatcaacctcaccctgtggctccttgggggcaacaacagcctccagagcagcctccctacccgcaccaccaaggagggcctccccactgtcccccatggaataacagccacgaaggcatgtggggcgagcagagaggagaccctggctggaacgggcaaagagatgcaccctggaataatcagcccgatgcagcttggaactcccagttcgaaggaccttggaacagtcagcatgaacagccgccatggggtggtggacaacgcgagcctcctttccgcatgcaacgtccccctcacttccggggacctttccctcctcaccagcagcatccccaattcaatcagccaccccatcctcacaacttcaacagattccctccacgctttatgcaggatgatttcccccctagacacccctttgagcgacctccttacccccatagattcgactacccacagggggacttccccgcagaaatggggccaccacaccatcaccccggacacaggatgccccaccccggtattaacgagcatccaccatgggcaggaccccagcatccagattttggtccaccgcctcacggatttaacgggcagccccctcatatgcggcgtcagggacccccacacatcaatcatgatgacccaagcctcgtgcccaatgtcccctactttgaccttccagctggcctgatggcacccctcgtgaaattagaggaccatgagtacaaaccactggatcctaaagatatcagacttccacccccaatgcccccttccgagagactcctcgctgcagtcgaagccttttactcacccccatcgcacgaccgtcccaggaacagtgagggctgggaacaaaatggtttgtacgaattcttccgggctaagatgcgcgctcggaggcggaagggccaggaaaagcgtaacagcggaccctcacgatcacgttcccgcagcaagtcacgaggtaggtcttctagtaggtctaatagtaggtcatctaaatcctcggggagttattccaggtcacgctctcgcagctgttccaggtcctattcccggagcaggagcaggagtcgcagcagaagccggagctcccgaagccggagtcgctctcagtctcggtcccggagcaaaagctacagtcccggacggcgtaggcgatctcggtctagatcacccacacccccaagttcggccggacttggaagcaattcagcaccacccattccagacagccgccttggagaggagaacaaggggcaccagatgctcgtgaagatggggtggagcgggtccggtggactcggagcgaaggagcagggtattcaggaccccataaagggtggggatgtcagggataaatgggaccaatataagggcgtgggggtcgctctggacgacccatacgaaaactataggaggaacaagagttactcatttatagcccgaatgaaagctagggacgaatgtaaatag

SEQ ID NO: 31576 - DNA, 963 bp, Artificial Sequence
  Description of Artificial Sequence: Synthetic coding sequence
atgagcaagagcgagtcaccaaaggagccagaacagctccgaaagctctttattggtgggctatctttcgaaaccaccgatgaaagtctgagatctcacttcgagcagtggggcacgcttacagattgcgtagtcatgagagaccctaacaccaagaggagcagaggttttgggttcgtgacgtatgccacagtggaggaggtcgacgctgccatgaacgctcgaccgcacaaggtggacggacgggtggtggagcctaagcgggcagtttccagggaggactcgcaaagacctggcgctcatctcaccgtaaagaagatctttgtggggggaattaaggaggacaccgaggagcatcacctgagagattatttcgagcagtatgggaaaatcgaagtgattgagatcatgacagaccgagggagtggcaagaaacgcggattcgcatttgttactttcgacgaccatgattccgtggacaagattgtgatacagaaataccataccgttaatggtcacaattgtgaagtgcggaaggccctttctaagcaggaaatggcatcggccagctcctcccagagaggacgcagcggctcaggaaattttgggggaggtcgaggaggcggattcggcggtaacgataacttcgggcgtggcggtaatttctccggacggggaggtttcggcggatcccgcggagggggaggctacggaggcagcggcgatggttataatggatttggcaacgacggctccaatttcggcggtggaggaagctataacgactttggcaactacaataaccagtccagtaactttggtcctatgaaggggggaaattttggcggacgcagttcagggccatacggagggggagggcaatattttgctaaacctaggaaccagggtgggtatggtgggagtagcagcagtagctcctatggctcagggcgacggttctag

SEQ ID NO: 31577 - DNA, 735 bp, Artificial Sequence
  Description of Artificial Sequence: Synthetic coding sequence
atggaactgaccatattcatactgagacttgctatctacattctgaccttccccttgtatctgctgaatttccttggattgtggtcatggatatgcaagaagtggtttccgtatttcctcgtccggtttactgtcatttacaatgaacagatggcaagcaaaaaacgcgaattattttctaatctgcaggaattcgcaggtccatcgggcaaattatctctgttggaggtgggctgtggaaccggagccaatttcaagttttacccccctggatgtagagtcacctgtatcgacccaaaccccaatttcgagaagttcctgataaaaagcattgccgaaaatagacatctccagtttgaaaggttcgttgtcgcagctggagagaacatgcatcaggtagctgatgggtctgtggacgtcgtcgtgtgcaccctggttctgtgcagcgtgaaaaaccaggagcgaatcctgagagaagtctgtcgtgttctacgcccagggggtgccttctattttatggagcacgttgcggcagagtgcagcacgtggaattacttctggcagcaagtgctggaccctgcctggcatcttttatttgatggctgcaatctgaccagagagagttggaaggccctggagcgggctagcttttctaagctgaagttacagcacatccaagcacccctgagctgggaactggtgaggccacacatctacgggtacgctgtgaagtag

SEQ ID NO: 31578 - DNA, 4125 bp, Artificial Sequence
  Description of Artificial Sequence: Synthetic coding sequence
atgacatctgccgctgaaataaagaaacccccagtggctccaaaacctaagtttgttgttgctaacaacaaacccgcacccccacccattgcccctaagcccgatatcgtcatctcttccgtgccccaatccacaaagaaaatgaagcccgcaatcgcccctaaaccaaaagtcctaaagacctctcctgtgagggagattggtcagtcaccttctaggaagataatgttaaacttggagggtcataagcaggaactagccgaaagcactgacaactttaactgcaaatacgaagggaaccagtcgaacgactatattagtccaatgtgcagctgtagctctgagtgtatacacaagctcggccatcgggaaaatctctgtgttaaacaactcgtcctggaacccctcgagatgaatgagaacctcgagaatagcaaaatcgacgagacgctgacgattaagactaggtccaaatgcgacctatatggcgagaaagctaaaaatcaagggggagtggtcttgaaagctagtgtgctggaggaagagttgaaggacgccctgatccaccagatgcccccattcatttcagctcaaaagcaccgcccaaccgactcgcctgaaatgaacgggggatgtaattcaaatggacagtttaggatcgagttcgcggatctatctcctagcccttcctcctttgaaaaagtccctgaccaccatagttgtcacctgcaactgcctagcgacgaatgtgaacatttcgagacttgccaggatgattccgagaagtctaacaattgtttccagtcatcagaattagaagccttagagaatggtaagaggagtacactcatctctagtgatggtgtgtccaaaaagtcagaggtgaaggatcttgggccactggaaatccacttggtgccatatacgcccaagtttccaacacccaagcctcgaaaaacccgtacggcccgtctccttcgtcaaaagtgcgtggatacaccctctgaaagcacggaggaacctgggaacagtgacagttcctcgtcttgcttaacagagaactcccttaaaattaacaaaatctccgttctccaccagaatgttctttgcaagcaggaacaagtggacaagatgaaattaggcaataagtctgaactcaacatggagagcaactccgatgcccaagacctcgttaactcccagaaggcaatgtgtaatgaaacaacgtcttttgaaaagatggctccatctttcgataaggactcgaacctctcttcggattctaccacagttgacgggagctctatgtccttggctgttgacgagggcacgggatttattaggtgtacagtgtcaatgtctctgccgaagcaactaaaattgacctgtaatgagcacctgcagtcaggtagaaatttaggcgtgtccgccccacagatgcagaaggagtcggtgataaaagaggagaactcactgcggattgtgccaaaaaagccacagaggcactccctgccagctactggggtgctgaagaaagccgcttcagaggaacttttggaaaagtcatcttatccaagttctgaagaaaagagctcagagaagtcactggaacggaatcacctacagcatctttgcgcccagaatcgaggagtgagcagttcattcgacatgccgaaaagagctagcgagaaacctgtgtggaagcttccgcacccaatactgccattctctggtaatccagagtttctgaagtcagtcacagtatcctcaaattccgaaccgagtaccgctctgactaagcctcgcgctaaatcactgtctgctatggacgtggagaagtgtactaagccttgcaaagacagcactaaaaaaaactcattcaaaaagctgctgtcaatgaaattgtcaatctgtttcatgaagagcgactttcagaaattttggagcaagtctagccaacttggggatacaaccacggggcacctgtccagtggagaacaaaagggaatcgaaagcgattggcagggcctgctcgttggagaagagaagcgttcaaaaccgattaaggcttactccactgagaattattctcttgaaagtcagaagaaacggaagaagagtagaggacagacctccgcggcaaacgggcttagagctgaatctttggacgatcaaatgctctcccgtgagtcctcttcccaggctccatacaagagcgtgacgtcattgtgtgcacccgaatatgaaaatatcagacattacgaggagattcctgaatacgaaaatttgccttttattatggctattaggaagacccaggaactggaatggcaaaattcgagcagcatggaggacgccgacgccaatgtttatgaagtggaagagccttacgaagctccagacggacagctgcaacttgggcctagacaccagcatagtagtagtggagccagccaggaagaacagaacgatctgggcctgggcgaccttccttctgacgaggaagagatcattaacagcagtgacgaagatgacgtctcatccgagtcctccaaaggggaacctgatccactcgaggataagcaggatgaggacaatgggatgaaatccaaggtccaccatatcgcaaaagagattatgagttccgagaaagtgtttgtggacgtgctgaaactgctgcacatagacttcagagacgccgttgcacacgcgtcccggcagcttggtaagccagtgatagaagatcgtattctgaaccaaatcctgtattatttgcctcagttatacgaactgaatagggatcttcttaaagagttagaagagaggatgctgcattggaccgaacagcagagaatcgctgatattttcgtaaagaaagggccatatctgaaaatgtactccacttacatcaaagaatttgataagaacattgctttgctggacgagcagtgtaagaagaaccccggatttgccgctgtggttcgggaattcgagatgtctccaagatgcgccaatctcgcactgaaacactacttattgaaacccgtacagaggatcccgcagtaccgcctccttctgacggactatttaaagaaccttatagaggacgctggagactaccgtgatactcaggacgcacttgccgtggttatcgaggtagcaaaccacgcgaacgacaccatgaagcaaggtgacaatttccaaaagctcatgcaaattcagtatagccttaacggacaccacgagatagttcagccagggagggtgtttttgaaggaggggatcctaatgaagttatcaagaaaggtgatgcagcctcgcatgtttttcctgtttaacgacgctcttctgtacaccacaccagtgcagagcggaatgtataagctcaacaacatgcttagcctcgcagggatgaaagtgagaaagccaactcaagaggcctatcaaaacgagcttaaaatagaatcggtagaacggtcgttcatattgagtgcctcgtctgcaactgagagagatgagtggctagaagctattagtcgggctatcgaggagtacgctaagaaacgtataacgttctgtccttctcgctccctggatgaggctgattcagagaacaaggaagaggtgtcccctctcggcagcaaagccccaatctggattcctgacaccagagccactatgtgtatgatttgtacaagtgaatttaccctcacatggcgacgccatcactgccgagcgtgtggtaagatcgtgtgtcaggcctgctccagcaacaagtacgggctcgattatttaaaaaatcagcccgctcgggtttgcgagcactgctttcaagagcttcagaagctcgatcatcagcatagtcccagaattggctccccaggaaatcacaaatccccttcatctgccctctccagcgtgcttcatagtatcccatctggcagaaaacagaaaaagatccctgctgcacttaaagaggtgagtgctaacactgaggattcctccatgtctggctatctctacagatccaaaggcaataaaaaaccctggaagcatttttggtttgtgattaagaataaagtgttgtatacatacgccgcatcagaggtcaggtcagagatttag

SEQ ID NO: 31579 - DNA, 1446 bp, Artificial Sequence
  Description of Artificial Sequence: Synthetic coding sequence
atggcaagtgcagcctcagttacatctttggcagacgaggtcaattgtcccatctgtcagggcactctcagggaacccgttacaatcgactgtggccacaacttctgccgcgcatgtctcacaaggtactgtgagataccgggtccagacctggaggagagcccaacttgccctctgtgtaaagaaccctttcggccagggtcctttagaccaaactggcagctggccaacgtagtggaaaacatcgagaggctccagctggtgagcaccctgggcttgggcgaggaagacgtctgtcaggagcacggcgagaagatttattttttctgtgaggatgatgaaatgcagctgtgcgttgtatgccgtgaggccggagagcatgctacccacaccatgcgattcctggaggatgccgcagcgccataccgggagcagatccacaagtgcctcaagtgtttgaggaaagagagagaggaaatccaggagattcagagtagagagaataaaagaatgcaggtccttttaacccaggtgagtaccaagcgacagcaggtgatttcagagttcgcccatctccggaagtttttggaggaacagcagagtatcctgttggcacagctggaaagccaggatggtgacattctgcggcagcgcgacgaatttgatctcctcgtagccggtgaaatttgtagatttagtgcacttattgaagagctggaggaaaagaatgaacgcccagccagagaacttcttactgatattcgatctacgctgatcaggtgtgaaactcggaaatgcaggaagcctgtcgctgtgtcacccgaattagggcagagaatccgggatttcccgcagcaggccctacccttgcagagggagatgaaaatgttcttagaaaacctgcctaaccatttggtgatccctaccgcccatatcagtctggacccacagacaagtcatccgaagcttttgctctcagaagaccatcagagggcacagttctcatataagtggcagaattccccagacaacccccagaggttcgacagggcgacctgtgttctcgcccacaccgggatcacaggcggacggcacacctgggtggtgagcattgacctagctcatgggggaagctgcaccgtaggagtagttagcgaagacgtgcagaggaaaggcgagcttcgtctgcgaccggaagagggggtctgggcggtgcggttggcttgggggtttgttagcgctctgggatcctttcctacacggctgacactgaaggagcaaccaagacaggtccgcgtgagcttagactatgaggtaggctgggtgacttttacgaatgccgttacaagagagccaatttataccttcaccgctagttttactcgcaaagttattccattcttcggcctctgggggaggggaagctctttctcactgtcgtcttag

SEQ ID NO: 31580 - DNA, 468 bp, Artificial Sequence
  Description of Artificial Sequence: Synthetic coding sequence
atggacactatgatgctcaatgtgaggaatctatttgagcaattggtccgacgagtggagattctgtcagaaggaaacgaggttcagtttattcagcttgcaaaagacttcgaagacttccgtaagaagtggcagcggaccgatcacgagctcggcaaatataaggacctgctgatgaaagcagagacggaaaggagcgctctggacgtcaaactgaagcatgccaggaatcaggtggacgtggaaatcaagcgccgtcaaagagccgaagcagactgcgaaaagctggaaaggcagattcagttaattcgggagatgctgatgtgtgacacatctggatcaatccagctgagcgaggagcagaagagcgccctggcctttctgaaccggggacagccctcaagttccaacgcgggtaataaaaggctgtccactattgatgaaagcgggagcatcctcagcgattag

SEQ ID NO: 31581 - DNA, 420 bp, Artificial Sequence
  Description of Artificial Sequence: Synthetic coding sequence
atggatacaatgatgctgaacgtacgtaacctgttcgagcagctcgtgcggcgagtggagattctgtcggagggcaacgaggtgcaattcatccagcttgctaaggacttcgaggacttcaggaaaaagtggcagcggaccgaccacgagttgggcaaatacaaggatctcttaatgaaagccgaaacagagaggtccgctctggatgtgaaactgaagcacgcccgaaatcaggtggatgtggaaatcaaacgtcgtcagagagcggaggccgattgcgagaagttggaacggcagattcagcttattcgggagatgcttatgtgtgataccagtggttccatccagctctccgaggagcagaaatccgcactggcgtttttgaatcggggtcagccatcttcttctaacgcgggatag

SEQ ID NO: 31582 - DNA, 3282 bp, Artificial Sequence
  Description of Artificial Sequence: Synthetic coding sequence
atgggagggaaagcctggcccagacgcgcagtaggaaccgccggtgggccttgcgccgagcaaatcagcgctcctttccagaccctactcatgccccatttgccactcgcatcatttagacctcccttctggggcttgagacactccagaggccttccaaggttccacagcgtgtctacccagtctgagccacacggaagtccaatcagtcgacgcaatcgtgaggcgaaacagaaacgcttgagggagaagcaagccacgctggaagccgaaatcgcaggtgagtcaaagtcgcctgcggaatcaatcaaggcttggcgtcccaaagaattagttctgtatgagattccgaccaaacccggtgaaaagaaggatgtatctgggccactccccccagcctacagtcctagatatgtcgaagcagcatggtatccgtggtgggtcagggagggtttttttaaaccagagtatcaggccagactgccacaggcaacgggcgagacattcagtatgtgcatccctcccccaaacgttactgggagtctgcacatcggacacgcactcacagtggctatccaggatgctctcgtgagatggcatcgtatgcgcggagatcaggttctctgggtccctgggtccgaccacgctggcatagctacacaagcagtagtggaaaaacagctgtggaaagagcggggagtaagacggcatgagttatctagagaggcttttctccgcgaggtttggcaatggaaagaggcgaagggaggtgaaatctgcgaacaattgcgcgctctgggggcttctttagactgggaccgagagtgctttaccatggatgtgggatcttccgtggcagttacagaagcattcgttagactctacaaagccggtctgttgtatcgcaatcaccagctggtgaattggtcttgtgccctcagaagtgccatctcggacatcgaagtcgagaacaggccactgccaggacatacacagctccggctcccgggatgcccaacgcctgtttccttcggactgctattttcagttgcatttcccgtggacggggagccagatgcggaggtagtcgtcggaacaacacggccagaaaccctgccaggggacgtggcggtggccgtgcatccggacgacagccgctacactcacttacatggacggcaattgcgccacccactcatgggacagcccttgcccctgatcactgactatgctgtgcagccgcacgtggggacaggtgctgtgaaggtcactccggctcacagccctgctgatgcagagatgggagcgagacacggcttgtcccctctcaatgtgattgcggaggacggcacaatgacgtcattgtgtggcgactggttacaaggacttcataggttcgtggctcgtgaaaaaattatgagcgtgctctctgagtggggtctgttcaggggcctacagaaccatcctatggttctgcccatttgttcaagatccggcgatgtgatcgagtatttgctaaaaaatcagtggttcgtacgatgtcaggagatgggcgctcgcgctgcaaaagcagtggaaagcggagccttggaattgtccccctcattccatcagaagaactggcaacattggtttagccacatcggggattggtgcgtatcacgccagctgtggtgggggcaccaaatccccgcttacttggtggtggaggaccacgcccagggagaggaagattgctgggtggtggggcgatccgaggctgaggccagagaggtggctgctgagcttacagggagacccggagccgagctgaccttggaaagggatccagatgtcctcgacacgtggttcagctccgccttattcccattctctgcattgggctggccccaggagaccccagacctagcaagattctaccctttatcactgctggagacaggctctgacctcctcctgttttgggtcgggaggatggtgatgctcggaacccagttaacaggccagctccccttctctaaagtgttgttgcaccctatggtgagggaccggcaagggaggaaaatgtccaaatcgttaggaaacgtgctagatccaagagatatcatctctggggtcgaaatgcaagtgttgcaggaaaagttgaggagtggaaacctggacccagccgagctggcgattgtggccgcagcccaaaaaaaagacttcccacacggaatccccgagtgtggaaccgacgcacttcgcttcacgttgtgctcgcacggcgtccaggccggagatctccacttgtctgtatccgaggttcagtcctgtcgacacttctgcaacaaaatctggaacgcccttagatttatcttaaatgctcttggggaaaaatttgtgccccaacccgctgaggagctgagcccaagttcgccaatggatgcatggatcttgtctagactggccctagccgcacaggaatgcgagcgaggcttcttgactcgagaactctctctggtgacgcacgcactccaccacttctggctccataacttatgtgatgtctacctggaagcggttaagcccgtgctctggcactcaccccgaccccttgggcctcctcaagtcctctttagttgtgctgaccttggcctgcggctgctggcgcctttaatgccattcctggcagaggaactgtggcaacggctgccccctaggccgggatgcccccctgctccaagcatcagcgtcgccccatacccgagcgcatgcagccttgagcactggaggcagcctgaactggaaagaaggttctccagagtgcaagaggtcgtgcaggtgctccgagctctccgcgcaacgtaccagcttacaaaggctaggccacgtgtccttctgcaatcatcagagccaggggaccagggcttgtttgaagcgttcctcgagcccctcgggacattggggtactgtggcgctgtggggctactccctcctggtgcggctgctccttctggatgggcccaggcccctctcagcgatacagcccaggtgtatatggagctgcagggactagttgatccacagatccaattacctttactggccgctcggcgatacaagttacagaaacagctggatagtttgaccgccaggacaccatcggaaggggaggcgggtacgcagcgtcaacagaaattatcatcacttcaacttgagctctccaaacttgacaaggcagccagccacctcaggcaactgatggatgaaccccctgcccctggaagtcccgaattgtag

SEQ ID NO: 31583 - DNA, 231 bp, Artificial Sequence
  Description of Artificial Sequence: Synthetic coding sequence
atgaactctgtgggggaggcctgtaccgacatgaagagggaatacgaccagtgctttaaccgctggtttgctgagaagttcctaaagggggattcatcaggggacccatgcacggatcttttcaagaggtaccagcagtgtgtccagaaggctataaaagaaaaagaaatcccaattgagggactcgagttcatgggccacgggaaggaaaagccagagaattcttcttag

SEQ ID NO: 31584 - DNA, 735 bp, Artificial Sequence
  Description of Artificial Sequence: Synthetic coding sequence
atggagttgactatcttcatcctgagactcgccatctatatcctcacattccccctttatcttctcaacttcctgggactctggtcctggatttgtaagaaatggttcccgtactttctcgttcgcttcacggtgatttacaacgagcagatggcttcaaaaaaacgtgaactcttctctaatttacaagaattcgctggaccttccggcaaactcagcttgttggaggtcggatgtggaaccggggctaattttaagttttatccccctgggtgtagggttacctgtattgatccaaatcccaattttgagaagttcctgatcaagtctatcgctgagaaccggcatctgcagtttgagagattcgttgtggccgctggcgagaatatgcaccaagttgctgatggcagtgtggatgtagttgtgtgtacactggttctgtgtagcgtcaaaaatcaagagcgtatcctgcgcgaggtgtgcagagtattacgccctggaggggctttctacttcatggaacacgttgccgctgaatgctccacttggaactacttctggcagcaagtgctagacccggcttggcatttgttgttcgacggttgtaatctgaccagggagtcatggaaggctctggaaagggcatcgtttagcaaacttaaactccagcacatacaagcacctctctcatgggagttagtacgaccccacatctatggctacgccgtcaagtag

SEQ ID NO: 31585 - DNA, 774 bp, Artificial Sequence
  Description of Artificial Sequence: Synthetic coding sequence
atgccccatcttcctctcgctagcttccgcccacccttttgggggcttcgccactcccgcggattgccccgttttcattctgtgtctactcaatccgagccccacgggtccccaatctcaagaaggaaccgtgaggcaaaacagaagcgactccgggagaaacaggcaacacttgaagcagaaattgcgggtgagtcgaaatccccagctgaaagcattaaagcctggaggccgaaggaactggtgttgtacgaaatcccaactaagcccggagaaaagaaggatgtgtctgggccactcccacccgcatacagtccaaggtacgttgaagccgcttggtacccctggtgggttagggaaggcttttttaaacctgagtatcaggcacgcctcccacaggccaccggcgagactttttcaatgtgtattccacctccaaacgtgaccgggagtttgcacatcggccatgccttaactgtggctattcaagatgccctcgtgcggtggcataggatgcggggagaccaggtcctatgggtcccagggtctgaccacgctggcattgccacccaggcggtggtggagaagcaactgtggaaggaaaggggggtacgccgacacgagctatcccgcgaagcgttcttgagagaagtgtggcagtggaaagaggctaaggggggagagatctgcgaacagctgagggctctgggagcatcactcgactgggatagggtgttctaccatggctgctggttactctcaggatgcgactag

SEQ ID NO: 31586 - DNA, 804 bp, Artificial Sequence
  Description of Artificial Sequence: Synthetic coding sequence
atgtccaagagtgagtcacccaaggaaccagaacagctgaggaaactttttatcgggggactatcctttgagaccacggatgaatctttaaggtcacattttgagcagtggggaaccctgactgattgcgtggtgatgcgagaccccaataccaagcgcagtagaggtttcggcttcgtaacctatgctacggtggaggaagtggacgcagccatgaatgccagaccgcataaggtggacggacgggtagtcgagccaaaacgtgcggtgtccagggaagattcacagagaccaggcgctcacctgacagtgaagaaaatcttcgtcggcggaattaaagaggatacggaggagcaccatcttcgcgattattttgaacaatatggcaaaatcgaggtcatcgagattatgactgatcggggaagcggtaagaagaggggtttcgccttcgtcacttttgatgaccacgacagcgtggacaaaatcgtgattcagaagtatcacaccgtgaacggccacaattgtgaagtcagaaaggctctgtcaaagcaagagatggcctccgcatctagcagccaaaggggacgaagcggatctggaaactttggcggtggtagctacaacgattttggaaactataataaccaatctagcaactttggccctatgaagggaggaaattttgggggtcgctccagtggaccttacggagggggagggcagtacttcgctaagccaaggaaccaaggcggatacggaggttcaagcagttcgtctagctacggctccggaaggaggttctag

SEQ ID NO: 31587 - DNA, 531 bp, Artificial Sequence
  Description of Artificial Sequence: Synthetic coding sequence
atgaacgagagcaaacctggagactcacaaaacctcgcatgcgtcttttgtcgcaaacacgatgattgtccaaataaatacggagagaagaaaactaaagaaaagtggaacctgaccgttcactactattgcttactcatgtcttccggcatttggcagaggggcaaggaggaagagggcgtgtacggttttcttatcgaggatatcagaaaggaagtgaaccgcgctagcaaactgaagtgctgcgtctgcaaaaaaaacggggcatccatcggttgtgtagcaccgagatgcaaaagatcttaccatttcccttgcggactgcagagggaatgcattttccaatttacaggcaattttgcctcattttgttgggaccaccggccagtccagataattacctccaataattatcgtgagtccctgccttgcacaatctgcctggaattcatcgaaccaattccttcctacaacattctgcgaagtccttgttgcaagaacgcttggttccatagagactgtctgcaatag

SEQ ID NO: 31588 - DNA, 3171 bp, Artificial Sequence
  Description of Artificial Sequence: Synthetic coding sequence
atgctgagtgtagtggagaacggcctggatccacaggctgctatccctgtgatcaagaagaagctcgtgggttccgtcaaagcactccagaagcagtatgtgagcctcgacactgttgtgacatcagaagacggggacgcaaatacaatgtgttctgcgctcgaagcggtcttcatacacggactacatgcaaaacacattcgggctgaggctgggggtaagaggaaaaaaagcgcacatcagaagcccctgcctcagcccgttttctggccgcttttaaaagccgtgacccacaagcatatcatctctgaactggaacacctgaccttcgtgaataccgatgttggcagatgtcgggcttggctgaggttagccctgaacgacggtcttatggaatgttatctgaaattgctgctgcaggagcaagctcgcctgcatgagtattaccagccaaccgcgttgctgcgagacgccgaggaaggcgaattccttctgagcttcctccaaggactgaccagtctgtctttcgagctcagctataagtccgctattctaaatgagtggacactgacaccccttgcactgagcgggctgtgtccacttagcgagttggacccactgagtacttccggcgcagaactgcagaggaaggagagtcttgattcaatttcccacagtagcggctccgaggatatagaggtgcaccattccgggcacaaaatacgacgtaaccagaaactgaccgcctcctcattgtcactagatacggcctcatccagccaactctcctgttctcttaatagtgacagctgcttacttcaggaaaacggaagtaagtcgcccgatcattgcgaggaaccaatgtcttgcgactcagacctgggcacagctaatgcagaagactcagatcgcagcctgcaggaggtcctcctggagttttctaaagctcaggtcaattccgtgcctactaatgggttgtctcaggagactgagatccccactccacaggcctccctaagcctccatggcctcaatacatccacatacctgcattgcgaggctccagcagagccgctgccagcacaagcagccagcgggacacaggatggcgtgcatgtgcaagagccacgaccacaggcgccaagtcccctggacctgcaacagccagttgagtcaacatccgggcagcagcctagtagcaccgtgtcagaaactgcgagggaggttggtcagggtaatggcctgcaaaaggctcaggctcacgacggggctggtcttaaactggtcgtgtcctctcccacctctcccaagaacaagagttggatctcggaagacgatttttatcggccttcacgggagcagccactcgagagtgcaagtgatcacccaatcgcatcttaccggggaactccaggcagccggccagggttgcatcggcattttagccaagagcctcgaaaaaactgctctctgggcgcactcgaccaggcctgcgttccctccccgggtcgacgccaagcccaggccgctccctcccagggccataagagttttcgcgttgtgcatcggagacagatgggtctgagcaatccattccggggattaatgaaactgggcacagtcgagaggaggggcgcaatgggcatttggaaagagctcttctgcgagcttagcccactcgagtttcgcctctatctctctaacgaggagcatacttgtgtcgagaattgctccttattgcgatgcgaaagtgtaggcccagcccactctgacgggcgatttgaactcgtcttcagtgggaagaagctcgccctgagagcctcatctcaagacgaggcagaggattggctcgaccgtgttagagaggcccttcagaaggtgagaccacaacaggaagacgagtgggttaacgttcagtatccagatcagcctgaggagccccctgaggcccctcagggctgcctctctccttcggatctcctcagtgagcctgcggctctgcaaggaacgcaattcgactggtcaagcgcgcaggtacccgagcctgatgcaatcaaagagtccctgttgtatctgtacatggacaggacttggatgccctacatattctcactgtcactcgaggcgttaaagtgcttccgaataagaaataatgagaagatgctatctgactctcatggggtagaaaccataagggacatcttgcctgacacatctctcgggggtccttcctttttcaagatcatcactgccaaggcagttttaaaactgcaggccggaaatgccgaggaggctgcactgtggcgagaccttgtgcggaaggtgttagcttcttatctcgaaactgccgaggaggccgtcactctcgggggttcacttgatgagaattgtcaagaggtgttgaaattcgcaacccgcgagaatgggtttcttctccagtacctggttgctatccctatggagaagggcctggattctcaaggatgcttttgtgccggatgcagccggcaaatagggttttcctttgtgcgccctaaactttgtgccttcagtggcctgtactattgcgatatctgccatcaggacgatgccagtgtgattcctgccagaattatacacaactgggatctgacgaagcggccaatctgccgacaggcgttaaaattcctgactcaaatcagagcacagcctctcattaatcttcagatggttaacgcttcactgtacgagcacgttgaaaggatgcatcttatcggacggagaagggagcagctcaagttgttgggggactatcttggtttgtgccggagcggcgctctcaaagaactgtctaagaggctgaatcatcggaattacctgctcgaatcaccccacaggttcagcgttgccgatctgcagcagattgccgacggcgtctacgagggtttcctcaaggcgttgatcgagttcgctagccagcatgtatatcattgcgatctctgtacccagcggggatttatatgccagatctgccagcatcatgacatcatctttcccttcgagttcgataccaccgtaaggtgcgcagaatgcaagacagtgtttcaccagtcgtgccaggcagtggttaagaaaggctgcccacgctgcgcacgtagacgcaaatatcaggaacagaacattttcgcttag

SEQ ID NO: 31589 - DNA, 390 bp, Artificial Sequence
  Description of Artificial Sequence: Synthetic coding sequence
atggctgaactgatacagaagaaattgcagggggaggtggaaaaataccagcagttacaaaaggacctgagtaagagcatgtccggaaggcagaagctagaagcacagcttaccgagaacaacatagttaaagaagagctcgcactcctggacggatccaacgtggtctttaagctgttgggacctgtactggttaaacaagagctgggtgaggctcgcgcaacagttggcaagagattagactacattaccgccgaaattaagagatacgaatcacagttacgcgaccttgaacgacagtccgaacagcagcgggagacactcgctcagttgcagcaggagttccagagggcccaggcagcaaaagccggtgccccagggaaagcgtag

SEQ ID NO: 31590 - DNA, 348 bp, Artificial Sequence
  Description of Artificial Sequence: Synthetic coding sequence
atgacaaagaaaaggcgcaataacggtcgtgccaaaaagggtaggggccacgtacaacccatccgatgtacaaattgtgctcgctgtgtgccgaaggataaagctatcaagaagttcgtaataaggaatattgtggaagcggcagcagtccgcgacatttcagaggtgtcagttttcgacgcatatgtgctgcctaaactgtacgtgaagcttcactactgcgtgtcctgcgcaatccattcaaaggtggtgcgcaataggtctagggaggctaggaaagaccgaaccccgccacctcgcttccgtccagcaggtgcagccccaggacccccacccaagccaatgtag

SEQ ID NO: 31591 - DNA, 1899 bp, Artificial Sequence
  Description of Artificial Sequence: Synthetic coding sequence
atggacactatgatgctcaacgttaggaacctgtttgaacaactggtgcgtcgggtggaaatcctttccgagggcaacgaagtacagttcatccagctggccaaggactttgaggacttcaggaagaagtggcagcgtacagaccacgaattaggcaaatataaagacctgttgatgaaagctgaaacagaaaggtctgctctggatgtgaaactgaagcatgccagaaaccaggtggatgtggagatcaagagaaggcagagagctgaggcagactgtgagaaactggaacgtcagattcaactaattagggaaatgttaatgtgcgacacgagcggctccattcagctgtccgaagaacaaaagagtgccctggcttttctcaatcgaggccaacccagttcttcgaatgctggaaataagagacttagcactatcgacgaaagtgggtcaatcctgagcgacatttctttcgacaagacagacgagtctctggattgggacagctcgttggtgaaaacatttaaattaaagaagagagagaagcgacggtcaacaagccgccaatttgtggacggtccacctggcccagtgaagaaaacacgctctattgggtctgcagtcgaccaggggaacgagagtatcgtggccaagacaaccgtcaccgttccaaacgacggcggacctatcgaagccgtgtcaaccatcgaaacggtcccctattggacacgaagcaggcgaaaaactggcacccttcagccatggaattccgatagtacactcaactcccgccaactcgagcctagaactgagacagattctgttgggacgccacagagtaatggagggatgcgcctgcacgattttgtgtccaaaactgtgattaagcctgaatcatgtgtgccatgtgggaaaagaataaaatttggcaaactgagtctaaagtgcagggactgtagggtagtgtctcaccccgaatgccgagatcggtgtccacttccatgtatccctacactgataggcacacctgtgaagatcggggagggaatgctagcagactttgtctcccaaaccagccctatgatacccagcatcgtggtgcattgcgttaacgagatagagcaaagaggccttacagagaccggtctgtaccgaatttcgggatgtgacaggactgtgaaagaactcaaggagaagttcttgagagttaaaacagttccccttctgtccaaagtagatgacattcatgctatctgcagtctgctgaaagattttctccgaaatttaaaagaacctctgctcactttccgattaaatagggcttttatggaggctgccgagatcactgacgaggataattctattgcggcaatgtaccaggcagtgggtgaactcccgcaggccaaccgtgatactctagcattcctgatgatacacctgcagcgagtggcacagtcaccacacacaaaaatggatgtggcgaacctcgcaaaagtttttggacctaccattgttgcccacgccgtgcctaatcctgatccagtgacgatgcttcaggacattaagcgtcagcccaaagtcgtcgaacggttgctcagtctacccctggaatattggtctcaatttatgatggttgagcaggagaatattgaccctctgcacgtgatcgagaatagcaacgcgttctcaacgccgcagacccctgacattaaggtctccctgctgggccctgtcactacccctgaacatcagctgctgaaaactcctagctcttcctctctgtctcaacgggtccgatcgacattgacaaagaacacaccgagattcggttccaagtccaagtctgccactaatctgggacggcaaggcaatttctttgcttcccccatgttaaagtag

SEQ ID NO: 31592 - DNA, 390 bp, Artificial Sequence
  Description of Artificial Sequence: Synthetic coding sequence
atggcagaattaatccaaaagaagttgcagggtgaagtggaaaaatatcagcaactgcaaaaggatctatcaaagtctatgagtggacggcaaaaactcgaggcacagctgaccgagaacaatatagtcaaggaagaattggccttgcttgacggttccaatgtggtctttaagcttcttggaccagtcctcgtaaaacaggagttaggagaggcacgggcaacagtggggaagcggctggactacataacagcagagatcaagcgctacgaatctcagcttagggatctagagcgccagagcgaacagcagagggagacgctggcccagcttcagcaggaatttcagcgcgctcaggccgcaaaagctggcgcacctggcaaggcctag

SEQ ID NO: 31593 - DNA, 5219 bp, Artificial Sequence
  Description of Artificial Sequence: Synthetic coding sequence
atgatggagggtaacgggactgagaatagctgtagccggaccagaggttggcttcagcaggataacgacgcaaaaccctggttatggaaattcagcaattgcttctctaggcccgagcagacattgcctcatagccctcagactaaggagtacatggaaaacaaaaaagtggctgtcgagttaaaagacgtcccaagccccctgcacgccggttctaagctgtttccggctgtgcccctccccgatattcgttctctgcagcagccaaagatccagcttagcagcgtgccaaaagtgtcctgctgcgctcactgccccaatgagccaagtacctctccaatgcggttcggcggtggtgggggagggtctggcggaacctcttccttaatacacccaggcgcattgctagatagccagtcaactcggaccataacttgtcaggttggctcaggattcgctttccagagcgcatcctcactccagaatgcatctgccagaaacaacctggccggtatcgccagtgatttccccagcatgtgcctcgagtcaaatctaagcagctgcaagcacctgccttgctgcggcaaactccattttcaaagctgccatggcaatgtgcataagctgcatcaattccccagcctgcagggttgtacatctgccggttatttcccatgcagcgacttcaccagcggcgcacctggacacctcgaggaacatatcagccagagcgaacttactcctcacctatgtacaaattcactgcacttgaacgttgttcctcccgtctgtttgaagggctctctctactgcgaagattgcctaaataaaccggctaggaactccatcatcgatgctgcaaaggtctggccaaatatacctcccccaaacactcagcctgcccctctggctgtcccgctgtgtaacggctgcggaaccaagggcacagggaaggagaccacacttctgctggccacttccctcggaaaggctgcctctaagttcgaagttgctgtcgctggacaagtacttgagaacttgccaccgattggggtgttttgggatattgaaaactgctctgtcccctcaggcaggtctgcaactgctgtagttcagaggattcgggagaaattttttaagggacaccgcgaagcagagttcatctgcgtgtgtgacatctccaaggagaacaaagaggttatccaggagctcaacaattgccaagttacagtagcacacataaatgccactgcaaagaacgcggctgatgataagctccggcaatccctgcgtcgtttcgctaatacccacaccgctcccgctaccgttgtgctggtgagtacagacgttaattttgcgcttgaactgagtgacctgcgccatagacatggcttccacattatccttgttcacaagaaccaagcatctgaggcgctgctgcaccatgcaaatgagctgatcaggtttgaggaatttatatctgaccttcccccaaggctgcctctcaaaatgcctcagtgtcacacattgctgtacgtttacaatttaccagccaacaaagacggaaagtctgtaagcaataggctaagaaggctctctgataattgtggaggcaaggtcctttctatcaccggctgctcagcaatactaagattcatcaaccaggatagtgccgagcgtgcgcagaagcgcatggaaaatgaagacgtattcggtaaccggatcattgtcagttttactccgaaaaaccgagagctttgtgaaacaaaaagctccaacgctattgcagataaggtgaaatccccaaagaagctgaaaaatcccaagctctgtctgatcaaggacgcaagtgagcagtcttcctctgctaaggctacacccggaaagggctcacaggccaactccggctctgcaaccaagaacacaaacgtgaagagtctgcaggaactttgccgaatggaatctaaaaccggacaccggaacagcgagcatcagcagggccacttgaggctggtggtgcccacccatgggaacagtagcgccgctgtgtcaacaccgaagaatagcggagtggccgaacccgtctataagacctcacagaaaaaagagaacctatccgccaggtccgtgacttcttcgccagtggaaaaaaaggataaagaggaaacagtgtttcaggtgtcttatccttcggcgttttccaaactcgtcgctagcaggcaggtaagccccctgctggcgtcccagtcttggagttcaagatccatgtctcccaaccttctcaatagggcaagccctttagcattcaacatagcaaacagcagtagcgaagcggattgcccagatccgttcgccaacggtgcagatgttcaagtgtcaaacatcgattacaggctttcccgcaaagaactgcaacagttgctccaggaagcatttgctaggcacgggaaggtcaaatccgttgaactgtcgccccacactgactaccaattaaaagctgtcgtacagatggagaatttacaggatgctattggcgcagtcaactctctgcatcgctataagatcgggtccaaaaagatcctcgtgtccctggccaccggagccgcatctaaaagtttgagcctcctcagcgctgaaaccatgtctgtgcttcaggatgcacctgcttgctgtctgccgctgttcaagttcactgatatctacgagaagaaatttggccacaagcttaatgtgagcgatctgtacaagctgacagacacagtggccatacgagaacagggaaatgggagactggtttgtctcctacccagtagccaggctaggcagtcccccttgggtagtagccagagccatgacggcagctcaaccaattgtagccccattatatttgaggagctagagtatcatgaacctgtttgccgtcagcactgctccaacaaggatttttcagagcatgagtttgaccctgacagttacaagattcccttcgtgattctttcactgaagacgtttgcacctcaagttcactccttattgcagacacatgagggcacggtccccctgctttcattccccgactgctatatcgcagaattcggcgatctggaggtggtacaggagaatcaaggcggagtaccgctcgagcactttataacctgcgtgcctggggtcaacatcgccactgcccagaacggcatcaaggttgtgaagtggatacataacaaaccgccaccccctaatacggacccatggttgctgaggtcaaaatcaccagtcgggaacccccagctcatacagttctctagagaagttattgatttgctcaaatctcagccaagctgcgtcattcccattagtcatttcatcccatcctaccaccaccacttcgccaagcagtgccgagtatccgactacgggtatagtaaactcattgaacttctggaagccgttccacatgtgctccagatactgggaatgggctctaagcgcttactaacattgacccatcgagctcaggtcaaacggttcacgcaagacctgttgaaactgctcaaaagtcaggcttccaagcaagttatcgttagggagttttctcaggcatatcattggtgcttctctaaagattgggatgtgaccgaatacggagtgtgtgaacttattgacatagtctccgagattccagacacaaccatttgcctgagtcagcaggataatgagatggtgatttgcattcctaaacgggagcgtacccaggacgagatcgaacggactaagcagttctctaaagacgttgtggacctgctgaggcatcagccacacttcagaatgccgttcaataaattcatcccatcttatcaccatcattttggaaggcaatgtaagctggcgtactacggctttacaaagctgctcgaactctttgaagccattcccgacacactccaggtgcttgaatgcggcgaggaaaagatattgactttgaccgaggtggaacgctttaaggctcttgcagcgcaattcgtcaaattgctacggtctcagaaagacaactgcctcatgatgactgatctactgacagaatacgctaagacctttggatatacatttaggctgcaggactacgatgtgtcctcaatatcagcactaacacagaaactctgccatgtggttaaggtggccgacatcgagagtgggaggcagattcagctgatcaatcgcaagtcgctgagaagcctcaccgcccaactattggtcctcctcatgagttgggaagggactacacacctgagtgttgaggagctgaagcggcattatgagtccacacataacacacccttaaatccctgcgagtatggattcatgacactgaccgaactcttaaaatcactcccttatctcgtggaagtcttcacaaatgacaagatggaggagtgcgtgaagcttacatctctgtacctctttgccaaaaatgttagaagcttgctgcatacctaccactaccagcaaatcttcctgcacgagttttcaatggcatacaccaagtacgtgggggagactctgcagcccaaaacctatggccacagctctgtagaagagctgctgggagctatcccccaagttgtgtggattaagggtcacgggcataaacggatcgtggtgcttaaaaatgacatgaaatcacggctgtcctcactgtctttgagcccagcaaaccatgagaatcagccttctgagggagagcggatcctggaggtaccagaaagccacaccgcaagcgagctgaagctaggggctgatggatctggtccgtcccacacagagcaagaactgcttagactcactgacgacagccctgtcgacctgctctgtgcccctgtgccttcttgtttgcccagcccccagctgcggcctgacccagtgatcttgcagagtgctgatctcattcagttcgaagaacggccacaggaaccgagcgagataatgatcttgaatcaggaagaaaagatggagatcccaattcccggaaaatctaaaacactcacttctgattcctcttcaagttgcatttcagccgcagtccctgtccccccttgcccatcgtcggaaaccagcgaatctctgctgagcaaggatccagttgaatctccagccaaaaaacagccaaagaaccgcgtgaagttggcggctaacttcagcctcgccccaatcacgaaacttta

SEQ ID NO: 31594 - DNA, 390 bp, Artificial Sequence
  Description of Artificial Sequence: Synthetic coding sequence
atggctgagctaatccagaaaaagctgcagggggaggtcgagaagtatcagcaactgcagaaagacctgagcaaaagcatgagcggcagacaaaagctagaggcacagcttaccgagaacaatatcgtgaaggaggaactggccctgctcgacggctctaatgtggtttttaagttgctggggccagttctcgttaaacaggaactcggagaagcacgtgcaaccgtggggaagcgactggactacatcactgcggaaataaagaggtatgaatcgcagctccgcgacttagagagacagtctgaacagcaacgggaaaccctggcacagctgcaacaggagtttcagcgggctcaggccgcaaaagccggtgccccaggtaaagcatag

SEQ ID NO: 31595 - DNA, 432 bp, Artificial Sequence
  Description of Artificial Sequence: Synthetic coding sequence
atgacgctccggtgtttggagccatcaggcaatggcggagagggtacccgctctcagtggggaactgcaggctcggctgaggagccatctccccaggcagcacgactcgcgaaagctcttcgggagcttggccagaccggatggtattggggatccatgaccgttaatgaagccaaagagaagctcaaggaggcacccgagggtacattcttgatccgggattctagccatagcgactaccttcttacaatttctgtgaagacgtctgcaggccctactaacttacgaatcgaataccaggatggcaagttcagactggatagcattatctgtgtgaagtcaaaacttaaacagttcgatagcgtcgtccaccttatcgattactatgtccagatgtgcaaagataagaggacagggccagaagccccttag

SEQ ID NO: 31596 - DNA, 156 bp, Artificial Sequence
  Description of Artificial Sequence: Synthetic coding sequence
atgagtagctctatgtggtatattatgcagagcattcaatccaagtacagcctctccgagcggcttatcaggacaatcgccgctatcagatcgttccctcatgataacgttgaagatcttataagaggcggagccgacgtgaattgcactcattag

SEQ ID NO: 31597 - DNA, 1902 bp, Artificial Sequence
  Description of Artificial Sequence: Synthetic coding sequence
atggaggagtctccattgtctcgagcaccctcccgcggaggggtgaatttcctgaacgtcgcaagaacgtatatccccaacaccaaggttgagtgtcactatacactgccgcctggcaccatgcctagtgcatctgattggattggtattttcaaggtggaggccgcttgcgttcgggattaccacactttcgtttggtcaagcgttcccgaatcaactactgacggatcaccaatccataccagcgtgcagttccaggcttcttatctgcccaaacccggtgcacagctgtaccaatttagatatgtgaacagacaaggacaagtatgcggccagtcacctccctttcagttccgggagccccgtcccatggacgaactggtgacactggaggaagccgacggcggatccgacatcctgctggtggtccccaaggcgacggtgttgcagaaccagttggacgaatcacaacaagaacgcaacgacctcatgcagctgaagctgcaactcgaaggacaggtaacagagctccggtcccgggtgcaagagctggagcgagcactcgcaacagcacggcaggaacacaccgagctgatggaacagtataaaggaataagcaggtcccacggtgagatcaccgaggagagagacattctgagcagacaacagggggatcacgttgctcgcatcctggaattagaagacgacatccagactatcagtgagaaggttcttactaaagaggtagagcttgacaggttgagggatactgtcaaggcccttaccagagaacaagagaaattgttgggacagttgaaggaagttcaggccgataaagaacagagcgaggctgagctccaagtagcgcagcaagagaaccatcacttaaacctggatctgaaggaggctaaaagctggcaagaagaacagagtgctcaggcacagcgtctaaaggataaggttgctcaaatgaaagatactcttggacaggcacaacagagagtcgccgagttggagcctttgaaggaacaacttagaggagcacaggaactggctgcatcgtcccagcaaaaggcaactttgcttggcgaggaactcgcctctgccgctgccgcacgcgatagaacaattgcagaactccatagaagcagactggaagtagctgaggtcaatgggagattagccgagttgggcctgcatttgaaagaagaaaagtgtcaatggagtaaggagcgtgccggtctcttgcagtcagtggaggcagaaaaggacaagatcttgaaacttagcgcggagatcctgagactggaaaaggccgtgcaggaggagaggacccaaaatcaggtgttcaagaccgagctggcaagggaaaaggatagttctctggtacaactgtcggaatcaaagcgggagctgaccgagctaagatctgccctgcgggtgttgcaaaaggaaaaggagcagctccaggaggaaaagcaagagctgctagaatacatgcgaaaactggaggctcgccttgagaaagttgcagacgaaaagtggaatgaagacgcaaccactgaggatgaggaggcggctgtgggcctgagctgtcccgcagctttaactgactcggaggacgagtctcccgaggatatgagattacctccctacgggctgtgtgaacggggtgatccgggttccagtcctgccggtccgagagaagcttcccccttggtggtcattagccagccggcacctatctccccccatttgagtgggcctgcagaagattcctctagtgacagcgaggctgaagatgaaaagtcggtccttatggcggcagtgcaaagtggaggcgaggaggccaatctgttattgcccgaactgggatctgccttctatgacatggcccgttag

SEQ ID NO: 31598 - DNA, 810 bp, Artificial Sequence
  Description of Artificial Sequence: Synthetic coding sequence
atgaagacgccggtggagctggccgtgtctgggatgcaaaccctggggctccagcatcggtgccgcggtggttaccgcgtgaaggcacgaactagctacgtggacgaaactttgttcgggtctccagccggaactcggcctacaccccctgatttcgaccctccctgggtggagaaggctaatcggacaaggggtgtagggaaggaggcctccaaagccctgggtgccaaaggctcatgcgagactacgccttctcggggttctaccccaacattgaccccaagaaaaaagaacaaataccggcctatttctcatacaccttcctactgcgatgagtctctgtttggaagcaggtcagaaggagcctcatttggagcgccacggatggccaagggagacgcagccaagctccgcgctctgctctggacacccccacctacccctaggggatcccactcccctcgaccccgtgaagcccctctgcgggcaattcacccagctggtccctcaaagacagaacccggacctgctgcagacagccagaaattatctatgggtggactgcatagcagtcggcctctcaagagaggtttgtcccactctttgacacacttaaatgttcccagcaccggccatcccgcaacttctgcccctcatacaaacgggcctcaagatctaaggcccagcacaagtggtgtgactttcaggtctcctttggtgacatctcgagctaggagtgtgtctatcagtgtaccaagtactccgaggcgtggaggagcgacccagaaaccgaagcccccttggaagtag

SEQ ID NO: 31599 - DNA, 618 bp, Artificial Sequence
  Description of Artificial Sequence: Synthetic coding sequence
atggacaaggactcccaaggattactcgacagctccctcatggcctctggcacagctagccgttctgaggatgaagagagtcttgccggtcagaagagggcatcctcccaggcccttggtacgatcccaaagaggagatccagctctcgctttatcaagaggaaaaagtttgacgatgaacttgtggaatcttcgctggccaagagctcgactcgcgctaagggtgccagcggtgtggaaccaggtagatgttctggtagtgagccctctagttctgaaaaaaaaaaggtgtcgaaagccccaagtaccccggtacctccgagccccgcaccagctcctgggctgactaaaagggttaagaaaagtaagcagccactgcaggttaccaaagatctcgggaggtggaaacctgccgatgatctcctactaatcaacgccgtcctgcagactaatgatttgacctctgtgcatctgggcgtgaagttcagttgccggtttacactgagggaagtgcaggaaaggtggtatgcactcttatacgacccagtaatctccaagctagcttgtcaggctatgcgccagctgcatcccgaagcaatcgctgctatccaatcctag

SEQ ID NO: 31600 - DNA, 540 bp, Artificial Sequence
  Description of Artificial Sequence: Synthetic coding sequence
atggactggacccctcgccttccctcacgtcacattatctctgagctggaacacctaactttcgtcaatacggacgtgggtagatgcagagcatggctccggttagcactgaatgacggtctcatggaatgctatctcaagcttcttctccaggaacaggctagactccaattgcagcgtaaggagagtctggacagtatatcccattcttctgggtctgaagacatcgaggtgcaccatagtggacataaaatcagaagaaatcagaaactcaccgcctcttcccttagcctggacaccgcatcttcctcacaacttagttgttcactcaactcagactcttgcctcttacaggaaaacggttccaaatcgccagaccactgtgaggagcccatgtcttgtgacagtgacttgggaactgccaacgccgaggactccgatcgttctctgcaggagaaaacgagagccggatcgcaacgaatgacatccacaggacttcccggatcaaacccttggcgtgtcctacagaccacacagtag

SEQ ID NO: 31601 - DNA, 735 bp, Artificial Sequence
  Description of Artificial Sequence: Synthetic coding sequence
atggaactcacaattttcatcttgcgactggcgatctacatcttgacattccccctctatctgctcaatttcttaggactgtggtcctggatttgtaaaaaatggttcccatacttcttagtccgctttacagttatatataacgagcagatggcttccaagaaacgagagcttttcagtaaccttcaggagttcgccggacccagcggtaaattgtctttacttgaagtagggtgcggaacaggagctaactttaaattttatccgccagggtgcagagtcacttgcattgaccctaaccccaatttcgagaaatttctgatcaagtctatcgctgagaaccggcatctgcaattcgagcggtttgtagtcgcagctggagaaaacatgcaccaggtggcggatggttctgtggatgtcgtcgtgtgcaccttggtgctatgctccgtcaagaatcaggaaagaatactgcgggaagtgtgccgggtcctaagacccggaggagcattttatttcatggagcatgtggccgcagagtgtagcacatggaattacttttggcaacaggtgctggacccagcttggcatctactgtttgatggctgcaacttgacacgagaatcctggaaagccctcgagagagcttctttctcgaagctcaagctccaacacatacaagctcccctgagctgggagctggtacggccacacatctacggatatgcagtcaagtag

SEQ ID NO: 31602 - DNA, 558 bp, Artificial Sequence
  Description of Artificial Sequence: Synthetic coding sequence
atggataaggacagtcaaggtttactggattcctccttgatggcctctggtacagcaagtcggtccgaagatgaggaatcgctggccggacaaaagcgggcttcttcgcaggcactcggaaccattccgaagcggagatccagtagcagattcataaagagaaaaaaattcgacgacgagctggtagaatcaagtctagccaagagttctaccagagcgaagggtgccagcggcgtcgagcccggaaggtgctcaggttctgagcctagtagttctgaaaaaaagaaggtgagcaaggcgcctagcactccggtgccaccctctccagctccggctccaggtttgactaaaagagtgaaaaagtccaagcagcccttacaagtcacgaaagatctgggcagatggaagcctgccgatgatctgctgctgattaacgctgtcctacagactaacgatttaacatctgttcacttgggagtgaaattttcatgccggttcaccttaagagaggtgcaggaacggtggtatgccctgctctacgatcctgtgatttcttag

SEQ ID NO: 31603 - DNA, 3003 bp, Artificial Sequence
  Description of Artificial Sequence: Synthetic coding sequence
atggtggaatgcttcgaatctggaggtactcggctcagcctttctagcttcaacgtgtcgtgcgattctctaagagaacagctccgtgagtggaggtgcttccagtggtggcgcatggactggacccccagactgccaagccgccatataatctccgagttagagcatctcacatttgtgaatacagatgtaggacgatgccgcgcttggctccggttggcccttaatgacggactgatggaatgttaccttaaacttctgctgcaggagcaggctcgactgcatgagtattatcagccaaccgccctccttcgggacgccgaggagggagagttcctgctgtcatttctccagggtcttacgagcctttcctttgagctgagctataaatcagcaatattgaatgaatggacgttgaccccgctggctctttctggactgtgccccttaagtgagttggatcctctcagtacatccggggctgaactgcagcgcaaagaatccctcgattccatctcccactcttcgggcagcgaggacatagaggttcaccacagcggacataagatcaggcggaaccagaagctaacagccagctcactgtccctcgacaccgcctcaagtagtcagcttagctgctcactgaatagtgacagttgccttctgcaggagaatgggagcaaaagtcccgatcactgcgaggaaccgatgtcatgcgattcagacctgggtacagcaaatgccgaggatagcgaccgcagcctgcaggaggtcttgcttgaattcagtaaggcccaggtgaacagtgtgccaactaatggcctctcgcaggagaccgagatcccaaccccgcaggcaagcctgagtttgcatgggctcaatacttccacatacttgcactgcgaggcacctgctgagcccttacctgcccaggcggctagcggaacccaagacggagtccacgttcaagaacctcgaccacaagccccaagccccctggacttgcagcagcctgtcgagtcgaccagcggacagcagccctccagcacagtaagtgagaccgcacgtgaggttggccagggcaatggccttcagaaggcccaggctcatgatggggcagggttgaagctggttgttagttctccgacttcaccaaaaaacaaatcttggatctctgaagacgacttctaccggccaagtcgagagcagccactcgaaagcgccagcgatcaccccatcgcgagttatcgtggcaccccaggctcccgtccaggccttcaccgtcatttcagtcaggagccgcgtaagaactgtagcctcggcgctctggatcaggcctgtgtgccttcccccggtcgaaggcaagctcaagccgcaccatcacaggggcacaagtcattccgggttgtgcaccgcagacagatgggcctgtcaaatccattccgagggcttatgaagttgggcacagtggagaggcgaggagccatgggcatatggaaagagctgttttgtgaactctctccattggagtttcgtctatacctgtccaacgaggaacatacgtgtgtggagaactgctccttactgcgatgcgagtccgtcggtccggctcattctgatggaagatttgagctggtgttctctggaaagaagttggcgctgagggccagctcccaggatgaggccgaagactggctcgatcgggtccgcgaagccctgcagaaagtgcgccctcagcaggaggatgagtgggttaacgtgcaatatcccgatcagccagaagaaccccctgaggcacctcagggctgcctgtcgccttcagacctcctaagcgagccagctgcgcttcaaggaacccagtttgactggtcctctgcccaagtgcctgagccagacgccattaaggagagtctcttgtacctgtatatggaccgcacctggatgccctatatcttcagtttatctcttgaggcgcttaaatgctttcgcattaggaacaatgagaaaatgcttagcgattctcatggagtggagacgatccgggatatcctgccagatacctctctcggcggacccagctttttcaagatcattacagctaaagcggtgcttaaactgcaggcgggaaatgcagaggaggccgctttgtggcgtgaccttgtgcgcaaagtgcttgcgtcttacctggagactgcagaagaggccgtgacactgggcggttcactcgatgagaattgccaggaagtactgaaatttgccactagggagaatgggtttcttctccagtacttggtcgccatcccgatggagaaggggctcgattcacagggatgcttctgcgcagggtgctcacgtcagataggtttcagctttgtgcggcctaaactgtgcgcttttagtggtctctattattgcgatatatgccaccaggacgacgcatccgtgatcccggcacgcattatccataactgggatttgactaaacgaccaatctgcaggcaggccctgaagttcttgacacagatcagagcacagccactgatcaatctacagatggtgaacgcaagcttgtacgaacatgtggagcgcatgcaccttattggcagacgcagggaacagctgaagcttctgggggattatttaggactgtgtcgctcaggcgctctcaaagagctttctaaaaggctcaaccatcggaattacctgctggagtccccacaccggttctcagtcgccgacctgcagcagattgctgatggagtgtacgaaggtttttctccgaaggtgccaagcgaggccgctgggctaagaccttggggggctcgttccccggaagcagccagcgcatttagatgtatcgactcatcccacctgccctcactgagaaaggtggtccccacactctttctaaagtgttactttatgcagtacaccgtccccagcgaacagggctctgggccagaggagagtctgcagtgcatagaaggcatcgccgcagtatag

SEQ ID NO: 31604 - DNA, 525 bp, Artificial Sequence
  Description of Artificial Sequence: Synthetic coding sequence
atggataccatgatgctgaatgtacgcaacctcttcgaacagctcgttcggcgtgtggagatcctgagcgaggggaatgaggtccagtttatccagctggcaaaggacttcgaggattttaggaaaaaatggcaaaggacggaccacgagctggggaagtacaaagatctgctgatgaaggcagaaaccgaaaggtcagctcttgatgttaaactgaaacatgctagaaaccaagtagatgtggaaatcaagaggcggcagcgagccgaggcggactgtgaaaaattggaaaggcagattcagctcatcagggagatgctgatgtgtgacacctctgggtcgattcagttatcagaagaacaaaagtctgcgctcgccttccttaatcgtggccaaccttcatcttccaatgctggtaataaacgcttgagcaccatagatgagtcaggctccattttaagtgacatcagttttgacaaaaccgacgagtccctggactgggattctagtctcgttaaaacatag

SEQ ID NO: 31605 - DNA, 2904 bp, Artificial Sequence
  Description of Artificial Sequence: Synthetic coding sequence
atggattggacccccagactgccctccaggcatatcattagcgagctggaacacttgacattcgtgaatacagatgttggcaggtgccgtgcttggcttcgcttggccctcaatgatggcctgatggagtgctatttgaaactcctcctccaggagcaggctcgtttgcacgaatactatcaaccaactgcccttctgcgggatgcagaggagggagagttcctgctgtcctttctgcaaggtctaacctccttgtcattcgagctgtcatacaagtccgcaatcctgaatgagtggacgctaactcctctcgccctgtctggactgtgccccctctctgaactggaccccctgtccaccagcggagccgagctgcagcgcaaggagtctctagacagcatttcccattccagtggaagtgaggatatcgaagtgcaccatagtggacataaaatccgccgtaaccagaagttaacagcatctagcctgtccctcgatactgcctctagctcccagctgagctgctccttaaatagtgatagttgtctgctacaggagaacggcagtaagtcacccgatcactgcgaagagcctatgtcctgtgattcagatttaggcactgcaaatgccgaagacagcgaccggagtttgcaggaagtcctgcttgaattttcgaaggcacaggttaactccgtgccgacaaacggtctcagccaggaaactgagatccccacgccccaggctagtctatcgctccatgggctgaatactagcacgtacttacattgcgaagcccctgctgagcctctccctgcccaggccgcatcaggtacacaggatggagtgcatgtgcaagaacctaggccccaggccccatcgcccctcgatcttcagcagccagtggagtctacgtccggccagcagccaagctctacagtgagtgagactgcgagggaagtgggccaaggaaacggacttcagaaagctcaggctcacgacggcgcaggccttaaattggtagtctcctctccaacctctccaaaaaacaaatcctggattagcgaggacgacttttacaggccctcccgtgaacagccccttgaaagcgcgtctgaccatcctatcgcctcttaccgaggcactcctggctcccgccctggcctgcatagacacttctcccaggagcctcggaaaaattgctccctgggagccctggaccaggcctgcgtgccctctccagggagaagacaggctcaggctgctccttcacaggggcacaagagctttcgggtcgtgcatcggcgacaaatgggcttatcaaacccgtttcgcggactgatgaagctgggaaccgtggaaaggaggggcgcaatgggcatatggaaggagttattctgcgagctgagccccctcgagttcaggttatatctaagtaacgaagagcacacttgtgttgagaactgctccctgttaaggtgcgagtctgtggggccagctcactccgatggaagattcgaattggtgttcagtgggaaaaaactcgccctgagagccagcagccaggatgaagctgaggattggctcgaccgtgtgcgagaggcactacagaaggtgagaccacagcaggaagatgaatgggttaatgtccaataccccgatcagccagaagagccacccgaggcgcctcagggctgccttagcccttccgacctgctgagtgagcctgctgctttgcagggtacacagtttgactggtcttcggcacaggtgcccgaaccggatgcgatcaaagagtcactgctgtatttgtacatggatagaacctggatgccctatatctttagtctaagtctggaggctctgaagtgcttccgcatccggaacaacgagaagatgctgagtgactctcatggagtcgagaccatcagggatatactgcctgatacctccttaggaggaccgtccttttttaagattataacagcaaaagcggtcctcaaacttcaagccggaaacgcggaggaagcggcactttggagagatctcgttaggaaagtgttagcttcatacctcgaaacggctgaagaggctgtcacgctagggggtagcctcgacgaaaactgccaggaggtgctgaagtttgccacgagggagaatggtttcctccttcagtacctggttgccattcccatggagaaagggctggattcccagggctgcttttgcgccggatgcagtcggcagatcggcttctctttcgtgcggccaaaactgtgtgcgttctcaggtctctattattgcgatatttgtcaccaggacgacgcgagcgtcatccccgctaggatcatccacaactgggacctgacaaaaaggccgatctgcagacaggccctgaaatttctgacacagatcagagcacaacctcttatcaacttacaaatggtgaatgcttctctttatgagcatgttgaaagaatgcatttgatagggagacgccgagagcagttgaaactgttaggtgactatcttggcttgtgtcgctccggcgcactgaaggaactgagcaagagactgaatcaccggaactacctgctggaaagccctcatagattctcagtcgccgacctgcaacagattgctgacggtgtgtacgaagggttccttaaggccctcattgaatttgcctctcagcacgtttaccactgcgatctctgcacacagagggggttcatctgccaaatatgtcagcaccacgacattatttttccttttgagtttgacaccacagtcaggtgcgcggagtgcaaaacggtgtttcatcaatcttgtcaggcggttgttaagaaaggctgcccccgatgtgcgaggcgcagaaagtatcaggagcagaacatatttgcatag

SEQ ID NO: 31606 - DNA, 1446 bp, Artificial Sequence
  Description of Artificial Sequence: Synthetic coding sequence
atggcctcagccgcatcagtcactagtttggctgatgaagttaattgcccaatatgtcaggggaccctgcgggaaccagtgacgatagattgcggtcacaatttctgcagagcctgccttacccgatactgtgagattccagggccagacctggaggagtcgcctacctgtcccctgtgtaaagaaccttttcgcccaggaagcttccggcctaactggcagcttgctaatgtggtcgagaatatcgagcgcctgcagcttgtgagtaccctcggcttaggtgaggaagatgtgtgccaggaacatggggaaaaaatctactttttttgcgaggacgatgagatgcagctttgtgttgtatgtcgggaagctggcgagcatgccactcacaccatgcggttccttgaggatgctgccgcaccttacagagaacagatacataagtgtctgaagtgccttcgcaaggaacgagaggagatccaggagatccagtccagggagaacaaaaggatgcaggtgctactcacgcaggtgagtactaagaggcagcaagtcatcagtgagttcgctcatttgcgcaaatttctggaggagcagcagagcatcctgctggcccagttggagagtcaggatggggacatcctgcgccagcgggacgagttcgacttacttgttgccggagaaatttgcaggttcagcgccctgatcgaagaactagaggaaaagaatgaaaggcccgctcgagaattactgacagatatccggtctacccttatccgttgtgagacacggaaatgtagaaagccggtggccgtgtctcccgagcttggccagagaatcagggacttccctcagcaggctttgccactccaaagagaaatgaaaatgttcctggaaaatctgcccaaccacttagtgatcccaacagctcacatttcacttgacccacagacctcccacccaaagcttctgctgtcagaagaccaccagcgcgcacagttcagctacaaatggcagaattcccctgacaatccacagcgctttgatcgtgcgacatgtgtgctcgcacacacgggaatcaccggcggacggcacacttgggttgtgtcgatcgacttggcccacggaggcagctgtacagttggggttgtttctgaggacgtacagcggaaaggagaactgaggcttaggcccgaagaaggcgtgtgggccgtgcggctcgcgtgggggtttgtgtctgcactggggagcttccccactcggctgaccctgaaagaacagcctcggcaggtgagggtcagtttggactacgaggtaggatgggttacctttaccaatgcggtcacacgtgagcccatctacacctttacggcatccttcacacgtaaggtgatccccttcttcgggctgtggggcagggggtcttcattctcactgtcaagctag

SEQ ID NO: 31607 - DNA, 462 bp, Artificial Sequence
  Description of Artificial Sequence: Synthetic coding sequence
atggctcctggaagcaggggtgaacggtcttccttcaggtccagacgcggacctggggtgcccagtccccagcccgacgtcaccatgctttctcggctgctcaaagaacaccaggcaaaacagaatgagagaaaagaattgcaggagaagagacgaagagaggccatcacagcggctacctgtctgactgaggctctagttgaccaccttaatgtgggcgtagctcaagcctatatgaaccaaaggaagcttgatcacgaagtaaagactcttcaggttcaggccgcacagtttgcaaagcagactggtcagtggattggcatggtggaaaacttcaatcaggccctaaaagaaattggcgacgtggagaattgggctcgttccatcgaattagacatgcggactatagccacagctctggagtacgtgtacaagggacagctgcagagtgcgcctagttag

SEQ ID NO: 31608 - DNA, 1311 bp, Artificial Sequence
  Description of Artificial Sequence: Synthetic coding sequence
atgttgtggaacttcaaacctcatgctagagcctataggtacgtcggccacaaggacgtggtgacctctgtacagttctcccctcacggtaaccttctggcatcggctagccgggatcgcactgtcagactttggataccagataaacgtggcaagttcagtgagttcaaggcgcacactgcccctgtcagaagcgtggacttttcagccgatggccagtttttggctacggctagtgaggacaaaagtattaaggtgtggagcatgtaccgacagagattcctctacagcttgtataggcatacccattgggtccggtgcgcgaaattcagcccagatggccgattaatcgtgagctgctctgaagacaagaccataaagatatgggacaccacaaataagcaatgtgttaataacttttccgacagcgttggttttgccaacttcgtggattttaatccatccgggacctgtattgcttccgctgggtcagatcagaccgtgaaagtgtgggacgtaagagtcaacaagcttcttcaacattatcaagtacactcaggcggtgtcaactgcatctcctttcacccatcaggcaattacctgataactgcctcttctgacggtactttaaaaatactggacttgctagagggaaggttgatttatacccttcagggccacacggggcctgtgttcacagtcagcttctctaaggggggtgagctattcgcctcaggcggtgctgatacccaagtgttactgtggaggactaactttgatgaactgcactgtaaaggactgacgaagcggaatctgaagcgactgcattttgactctcctccacacttgctggacatctatcctcgaacgccacatccccacgaagagaaagtggaaacagtggagatcaacccaaagctggaagtgatcgatctccagatcagtacccctcctgtcatggacattctgtcctttgattccacaaccactaccgaaacatccggacgaacactgcccgacaaaggcgaggaggcgtgtggctacttcctgaatccttcactaatgtccccagagtgtctccccaccaccacaaaaaagaaaaccgaggatatgagcgaccttccatgtgaatcccagagaagtatcccattggccgtgacagacgctctggagcacatcatggagcagctgaacgttttgacccagaccgtgtctatcctggagcagaggcttactttaactgaggacaagctcaaagattgtcttgagaaccaacaaaagctcttttcggcagtgcagcagaaaagttag

SEQ ID NO: 31609 - DNA, 597 bp, Artificial Sequence
  Description of Artificial Sequence: Synthetic coding sequence
atgacattgcgatgcctggaaccaagcggtaatggaggggaagggacccgaagccaatggggcacagctgggtctgccgaggagccatccccacaggctgcacgtcttgccaaggcactcagagagttgggccaaacggggtggtactggggttccatgaccgtaaatgaggctaaggaaaagctgaaagaagccccagaaggtacattccttatcagagacagcagtcatagtgactacttgctgacaatctccgtaaaaacttccgctgggcctaccaacctgcggatagaatatcaggacggcaagtttcgtcttgactcaatcatctgcgtcaagagcaaactaaagcagtttgattctgtcgttcacctcattgactactatgtccagatgtgcaaggacaagagaactgggcctgaagctcctcgaaacgggaccgtccacctctatcttaccaagccactttacacatcagcccctagcctgcagcatctttgcagactcacaatcaataagtgtacaggtgctatctgggggctcccgctcccgacccggctcaaggactatcttgaggaatacaagtttcaggtttag

SEQ ID NO: 31610 - DNA, 597 bp, Artificial Sequence
  Description of Artificial Sequence: Synthetic coding sequence
atgacattgaggtgtctagagccatccgggaacgggggagaggggacgcggagtcagtgggggactgccggtagtgccgaagagcccagcccccaggcggcacggctggcaaaggcactcagggaactggggcagaccggttggtactggggcagcatgacagttaacgaggccaaggagaaactgaaagaggccccagaaggtacctttttaatcagggactcatcccactctgattatctgctgacaatcagcgtgaaaactagcgccggaccaaccaatctgagaattgaatatcaggacggaaagttccgtctagacagtataatttgcgtgaaatccaagctgaagcagtttgattcagtggtccatctgattgattactatgtccagatgtgtaaggataagcggaccgggccagaagcacctcgcaatggtactgtgcatctgtatttaacaaaaccactgtataccagcgcgccatccctgcaacacctgtgtaggttgaccatcaataaatgcactggagcaatatggggcctccctttacccacacggctgaaggattatctcgaggagtacaaatttcaggtctag

SEQ ID NO: 31611 - DNA, 495 bp, Artificial Sequence
  Description of Artificial Sequence: Synthetic coding sequence
atgatggagggcaatgggacagagaactcttgttctcgcaccagaggctggctgcagcaagacaatgatgccaagccatggctctggaaattttctaactgcttctcccggccagaacagaccctcccacactccccacagacaaaagagtatatggaaaataagaaagttgccgtcgagctgaaggatgtgccctctcccctccatgccggaagcaagttgttcccagccgtgcccctgcccgatattcgctccctgcagcagcccaagatccaactgtcatcagtgccaaaagtctcatgttgtgctcactgtcctaacgagccttccacatctcccatgcgttttggcggaggaggtggaggatcagggggaacatcaagcctgatccaccccggtgccctgcttgactcccaaagtactcggaccattacctgccaggtgggttcaggcttcgcattccaaagcgcatcctccctacagaacgcaagttag

SEQ ID NO: 31612 - DNA, 855 bp, Artificial Sequence
  Description of Artificial Sequence: Synthetic coding sequence
atgctgtcggtggtcgagaatgggctagatccgcaggctgcgattccagtgatcaaaaaaaagcttgtgggttctgtgaaggccctgcagaaacagtacgtgagcctggatacagtggtaacttccgaggatggcgatgccaacaccatgtgctcagcgctagaggctgtgtttattcatggactacatgctaagcacattagagcagaggcgggtggcaagcggaagaaaagtgcacatcaaaagcctctgccgcagcccgtcttttggcccttgctcaaggcagtgacgcataagcatatcatctccgaactggaacaccttacgtttgtgaacactgatgtgggcaggtgtcgggcttggctgagattagccctaaacgatggcctcatggaatgttatctaaaattgttactgcaggaacaggccagacttcagctgcagcgtaaggaaagccttgactcaatttcacacagctctggttcagaggacatcgaggttcaccattctgggcataagatccggagaaaccagaagttgacggcctcaagcctctccctcgatacagcatcaagcagccagttgtcctgttcattgaactctgactcctgcttacttcaggaaaatggctccaaatcgcctgaccattgcgaggaaccgatgagctgtgattccgatctaggaactgccaacgccgaggattcagataggagcttacaggacatcaagattttttcttgggcacagtggttgacaccggtgatacccgcactatgggaggccgaggccggtgggagtcaacgacagcagattgaaacgttcctggctaacacagtgaagccccacctgtactag

SEQ ID NO: 31613 - DNA, 3282 bp, Artificial Sequence
  Description of Artificial Sequence: Synthetic coding sequence
atgggaggcaaggcttggcccaggcgtgcagtgggcaccgctggcggtccatgcgctgagcagataagcgcaccctttcaaacgttgctcatgccccacctgcctctcgcttcttttagaccacccttctgggggttgagacacagccggggtctgcctcgttttcactctgtgtccactcagagtgagccacacggaagccccatttcgagaagaaaccgagaagccaagcaaaaacgtctgcgtgagaaacaggctaccttggaagccgagatcgcaggagagtcaaaaagccccgctgagagtattaaggcttggaggcctaaagaattggtactttatgagattcctacgaagcctggggagaaaaaggacgtgtctggccctctgccacctgcctacagccctcgatacgttgaggccgcatggtacccatggtgggtgcgtgaaggattttttaagccggagtaccaggccaggctgccccaagctacgggcgaaacattttccatgtgcattcccccacccaatgtgacaggaagtctgcacataggccacgctcttaccgtggccattcaagacgctctcgtaaggtggcataggatgagaggggaccaagtgttgtgggttccagggtccgatcacgctggtatcgccacacaagcggtggtagaaaagcagttgtggaaggaacgcggagtgcggagacacgaactgagccgggaggcttttcttcgcgaagtctggcagtggaaggaagctaaagggggagaaatctgcgagcaactcagagctcttggagcctctctggactgggatcgcgagtgcttcaccatggatgttggatcttcagtggcagttacagaggctttcgtgcgcctctataaggccggacttctgtaccggaaccaccagctggtgaactggtcatgcgctctgcggtccgccatctccgacatcgaggtggaaaatcgaccgctccctggccacacacagcttcgtctccctggttgtcccacgcccgtctcatttggtcttctctttagcgtggcttttccggtcgacggcgaacctgatgctgaggtagtcgtcgggaccacccgacccgagaccttgcctggagatgtggcagtcgccgtgcatccagatgactcacgctatactcatctccacggccgtcagctgcggcatcctctgatgggtcagcctcttccactgattactgactacgctgtgcagccacacgtgggcacgggcgctgtgaaagtgactcctgctcacagtcctgcagatgccgaaatgggcgcaaggcacggactaagtcccctcaacgtgattgcagaagacggcacaatgacctctctgtgcggcgattggctgcagggccttcaccgattcgtcgccagggaaaaaattatgtccgttcttagcgagcggggtcttttccgcggtctgcagaaccatccaatggtgctgcctatctgtagtcggtcaggggacgtgatagaatatcttctaaaaaaccaatggttcgtgagatgccaagaaatgggcgctagagcagccaaggctgttgagagcggcgctctggagttatcccccagctttcaccaaaaaaactggcagcattggttctcccacattggcgactggtgcgtttctcgccagctgtggtggggacaccagattccggcatacctagtggttgaggatcacgctcaaggtgaggaggattgttgggtggtgggcagatccgaggctgaggcccgagaagtggcagctgagcttaccggacggcctggagccgagctcaccctggaacgtgacccagacgtgcttgatacatggttctcttcagccctcttccctttctccgccctgggctggccacaggaaactccagacctcgcacgtttctacccattatccctactggaaactggctccgacctgttgcttttttgggtaggcaggatggtcatgcttgggacacagctgactggacagcttccttttagcaaggtgttattacaccctatggttagggaccgccagggacggaaaatgagcaaatcacttggaaacgtcctcgatccgcgagacataatcagcggggtcgaaatgcagctactccaggaaaagctcagatcgggtaatctggatccagcagaacttgccatagttgccgcagctcaaaaaaaggacttccctcatgggattcctgaatgcggaactgacgcattgaggttcaccttgtgctcccacggagtgcaggcaggcgacctgcacctgtccgtgtccgaagtgcagagctgcaggcatttttgtaacaaaatatggaatgcgctccgcttcatcttaaatgcactgggggagaagttcgtgccgcagcctgccgaagagctgtcgcccagttctcctatggacgcgtggattctgtcccgcctggccctcgcagcccaagaatgcgagagggggttcctcaccagggagctgtctctggtgacgcacgcattacatcatttctggctgcacaacctgtgtgacgtgtacttggaggctgttaaacctgtcctgtggcattccccaagaccactgggcccaccccaggtgctctttagctgcgcggacctgggcctgcgactccttgcccctctcatgccgtttctcgccgaagagttatggcaaagactccctcctcgacccggttgtcccccagctcctagtatctccgttgctccatatccttctgcctgttccctagagcattggcggcagcccgaacttgagaggaggtttagtcgggtgcaggaggttgttcaggtgttgagggcactccgggctacctaccagcttaccaaggctcgaccccgtgtcctgttacagagctcagagccgggagaccaggggctgttcgaagcctttctggagccactagggacccttggttattgcggcgctgtgggattactgccacccggaaccgccgctccaagcgggtgggctcaggctcccctgagtgatactgcccaagtgtacatggagctgcagggactggtggatccccagatccaacttcccctcctcgctgcccgtcgatacaagttgcagaaacaactcgacagcctaacagctagaactccctccgaaggcgaggctgggacccaaagacaacagaagctgagttctcttcagcttgagctttcgaaactcgacaaggccgcaagtcatctccgacagctgatggacgaaccccctgctcccggttcaccggaattatag

SEQ ID NO: 31614 - DNA, 3621 bp, Artificial Sequence
  Description of Artificial Sequence: Synthetic coding sequence
atgacatctgccgcagagatcaagaaaccgcctgtggccccaaaacctaaattcgtagtggccaacaacaagcccgctccaccacccattgcccctaagcccgacatagtcatctcgtccgtgcctcaaagcacaaagaaaatgaagccagccatcgccccaaagcctaaggtgctcaaaacttcccctgttagagagattgggcaatccccctcccgcaagatcatgctcaatctggaaggccacaagcaggagcttgctgaatctaccgacaatttcaactgcaaatatgaaggcaaccagagcaatgattacatctctcccatgtgttcttgttcttcagagtgtatccataaactgggccaccgggaaaacctctgcgtcaaacagcttgtcctcgaaccgttagagatgaacgagaatctggaaaactctaagattgacgagacactaacaatcaaaactagatcaaagtgcgatctctatggcgaaaaggcaaaaaaccagggaggggttgtgctgaaggcctcagtgcttgaagaagaattgaaggacgcacttatccaccagatgcccccatttatctcagcacagaaacaccgcccaactgattctccagaaatgaacgggggatgtaactcaaatggtcaattccgcatcgaatttgccgatctctctccgtctccatcttcattcgagaaagtgcctgaccaccactcttgccacctgcaactgccttctgatgagtgcgagcattttgagacatgtcaagacgattcagagaagtctaataattgcttccagagctcagagctggaagcactggagaacgggaagaggtccacgctgattagcagcgacggagttagcaagaaaagtgaggtgaaagacttggggcctctggagatccacctggtcccttatacacctaaattccccacccccaagccacgaaagacacgtaccgccagactgttaaggcaaaaatgcgtggatacgccaagcgaatcgaccgaagaaccgggtaacagcgactcatcatcgtcctgcctaaccgaaaattcactgaaaattaataagataagcgtgttacaccagaatgttttgtgtaagcaggaacaggtggacaagatgaagctggggaacaagtcagagctaaacatggaaagcaattctgatgctcaggacctggtgaacagccagaaggccatgtgcaacgaaacaactagttttgaaaagatggccccttcatttgataaagactctaacctcagcagtgatagcacgactgtagatggaagctcaatgagtctagctgttgacgaaggaactgggttcattcgctgcacagttagtatgagcctgcctaagcagcttaagcttacatgtaatgagcacctgcagagcggtcgaaacctgggagtatcagccccacaaatgcagaaggaatctgtcataaaagaggagaactctcttcgaattgtgcctaaaaaaccccaacgacacagtctccctgcaactggggtgttgaagaaagccgcatccgaggaactgctcgagaagtctagctatccctcttccgaggagaaatctagcgaaaaatctctcgaacgtaaccacttgcagcacctgtgtgctcaaaaccgaggcgtgtctagctcattcgacatgcccaaaagggcctctgagaaacctgtgtggaagttgccgcacccaattctacccttcagtggcaaccccgaatttctcaagtccgtgaccgtgagcagtaacagtgaacccagtacagccctcacgaagcccagagctaagtcactgagcgccatggacgtagagaaatgcacaaaaccctgcaaggatagtactaagaagaattccttcaaaaaattattgtcgatgaagctcagtatttgcttcatgaagtccgacttccagaagttttggagtaagagcagtcagctgggtgatactacaaccggccacctgagcagtggggaacagaagggaattgaatccgattggcagggcctgttagtgggtgaagaaaagaggtctaaaccgatcaaggcttactcgaccgaaaattacagtctggaaagtcagaagaagaggaaaaagagcagaggccagacatctgcagcaaatggactgagggcagagtcgctcgacgatcagatgttgtccagagagtcatcttctcaggcgccttacaagagcgtgacctcgctgtgtgcgcctgagtatgagaatatccggcactacgaggagatcccagaatatgaaaacttgccttttatcatggcgatccgaaaaacacaggagctagagtggcagaactcttcaagtatggaggatgcggatgccaacgtgtacgaagtcgaggagccatacgaggcgcctgacggacaactgcagttgggcccacgccaccaacactcctcatcgggggcaagccaggaagagcaaaatgacctgggcctgggcgatcttccctcagacgaggaagagatcatcaactcatcagacgaagacgatgtcagttcagaatcttccaagggtgaaccagacccactggaggacaagcaggatgaggataatggcatgaaatcaaaggttcaccacatcgccaaagaaatcatgtcttcagaaaaagtatttgttgatgtgctcaagctactgcatattgactttagagatgctgtggctcacgcgtctaggcagcttggcaagccagttattgaagacagaattctgaaccaaatcctatactatctccctcagctctatgaacttaatcgcgatttactcaaggaactggaggagcgcatgctccattggaccgagcagcaacgtatagcggatatctttgttaagaaaggtccctatctgaaaatgtacagcacctacataaaggagttcgacaagaacatcgccctgctggacgagcaatgcaagaagaaccctgggttcgcagctgtggtgcgggaattcgagatgtcaccaaggtgtgcaaacctggccctgaaacattatttgttgaagcccgtgcagaggataccgcagtatcgcttgcttctcacagactacctaaaaaatttgatcgaggatgccggtgactacagagatacccaagacgccctggctgtggtcatcgaggttgccaatcatgcaaacgataccatgaagcaaggagacaactttcaaaagctcatgcagatccagtacagtctgaatggtcatcatgaaattgtccagcctggtagagtcttcctgaaggagggaatcctaatgaaactatccagaaaggtcatgcagccacggatgttctttctctttaacgatgccctgttgtacaccactcccgtccagagcggaatgtataaactaaataatatgctgtctctcgccggtatgaaggtccggaagcccactcaggaagcctatcagaatgagttaaaaatcgaatctgtggaaagaagcttcatcttgagcgcctcttccgcaaccgagcgcgacgaatggctggaggcaatctctagagcaattgaggaatatgcaaagaagagaatcaccttttgtccttcacgaagcttggatgaggcagattctgagaacaagtag

SEQ ID NO: 31615 - DNA, 435 bp, Artificial Sequence
  Description of Artificial Sequence: Synthetic coding sequence
atggacaaggacagtcaaggcctcctagactcctctctcatggcttctggcaccgcctcccggtctgaagatgaggaatccctcgccggacaaaagcgcgcatctagtcaggccttagggaccataccaaaaaggcgcagctcatcacggacgctctatcgttttatcaaacgcaagaagtttgacgacgaactcgtcgagtcgagtctagcaaaatcatctactcgggctaagggagccagtggagtcgagcccggacggtgctctggcagtgaaccaagctcctctgaaaaaaagaaagtatcaaaggccccttcaacacccgtgccaccatcgcctgcccctgctccgggtctcacgaagcgcgttaaaaaatctaaacagcctcttcaagtgacaaaggacctcggcagatggaagcctgctgatgattag

SEQ ID NO: 31616 - DNA, 810 bp, Artificial Sequence
  Description of Artificial Sequence: Synthetic coding sequence
atgaaaacgccagtggagctggccgtttctggaatgcagaccctgggtctgcagcacaggtgtagggggggatatagagtgaaggcgcgaacgagctacgtagatgagaccttatttgggagcccagcaggcaccagaccaactcctcccgatttcgacccaccctgggtggagaaggcgaacaggacaagaggagtaggcaaagaagccagcaaggcactgggcgctaagggttcgtgcgaaacaactcctagccggggatcaaccccaaccctaacccccagaaaaaagaacaaatatagacctatatcccacaccccatcttactgcgacgaatctttgttcgggagcaggtctgagggcgctagctttggcgctccgcgtatggccaagggtgatgcagctaaactacgagctctcctctggacaccccctcccaccccacgtggaagtcattcacctcgtcccagagaggctcccttgcgcgctattcatccggcaggcccttccaaaaccgagccgggacctgcggcagatagtcagaagctcagcatgggcggattacactcgtcacggccactgaaaagaggcctctctcattctctcactcacctgaatgtgcccagtaccggacaccctgctacctcagccccacatacaaatggcccacaggatttgcgtccctccacctctggggtgacttttcgctcgccgctggttacttcacgtgccaggtccgtctctattagtgtgccctcaaccccccgtcgagggggtgcaactcagaaacctaagccaccctggaaatag

SEQ ID NO: 31617 - DNA, 501 bp, Artificial Sequence
  Description of Artificial Sequence: Synthetic coding sequence
atggctaatgatccgttggagggcttccacgaggtcaatctcgctagccccacgtcccccgaccttctgggtgtctatgaatctggcactcaagagcagacaacatccccttcggtgatatatagaccccacccatctgctctgtccagtgttcccatacaggcgaatgcgctggatgtgagcgaacttccaacccagccggtttactcatccccgcgtagactgaactgtgccgaaatctcaagcatttcctttcacgtgacagatcctgccccttgcagcactagcggagttacggccggacttaccaaactgacaaccagaaaagacaactacaatgcggagcgcgaatttctacagggcgcaactattacagaggcctgtgatggatctgacgatatctttgggttgtccaccgatagcctgtctcgactgaggagcccgagcgtgcttgaggtccgggaaaaggggtacgaaaggctcaaagaagaactagcttag

SEQ ID NO: 31618 - DNA, 390 bp, Artificial Sequence
  Description of Artificial Sequence: Synthetic coding sequence
atggacacaatgatgctcaacgttagaaatctatttgagcagctcgttaggcgagtggagatcctgagtgagggaaacgaagttcagttcatccagctggccaaggacttcgaggacttccgcaagaagtggcaacgcacagaccacgagctggggaagtacaaggatctcctcatgaaggctgaaactgaacgcagcgctctggatgtcaagctgaaacatgcgaggaatcaagtggacgtggaaattaagagacgccagagagccgaggctgactgcgagaagttggaaagacagattcagttaattagggaaatgctcatgtgtgacaccagtggcagcatccagctctctgaagaacaaaagagcgccctcgcattcctcaactag

SEQ ID NO: 31619 - DNA, 486 bp, Artificial Sequence
  Description of Artificial Sequence: Synthetic coding sequence
atgacactccggtgcttggaacctagcggcaacggcggtgaaggcacacgtagccagtggggcactgcgggaagtgccgaggagccttccccccaagcagcacgcttggcaaaggccttaagagaactgggtcagactggctggtactggggttccatgacggtgaatgaggcaaaggagaagctaaaggaagcacccgaagggacctttctgattagggacagtagtcactccgactacctgctgaccatcagcgtcaagactagcgccggacccacgaatcttcgcatcgagtaccaggacggaaagttccgcctggactcaattatctgtgtgaagtccaaacttaagcagttcgactcagtcgtccacttgatcgattattacgtgcaaatgtgtaaggacaaacgcaccggccctgaggccccacggaacggcacggtccacctgtacctgaccaaacccctttatacctccgctccctag

SEQ ID NO: 31620 - DNA, 1389 bp, Artificial Sequence
  Description of Artificial Sequence: Synthetic coding sequence
atggataaggactcccaggggctcctcgattctagcttgatggctagtgggaccgcgtctcgatccgaggacgaggagagcctcgccggacaaaaaagggcctcatcacaggcactgggtacgattcctaaaaggaggtctagctctagatttattaagcgcaagaaattcgatgatgaattagtggagtccagcttagccaagagctctacgagagctaaaggcgcatctggagtggaacctggccgatgctccgggtcagaacctagcagcagtgaaaaaaaaaaagtgagcaaagccccaagcactccggtcccaccgtccccagctccagcaccaggcctcactaagagggtcaagaaatcaaagcagcctctccaggttaccaaggacctcggcaggtggaaacctgctgacgatctcctcctgatcaatgctgttctgcagaccaatgacctcacatctgttcacctgggagtcaagttctcctgccggtttacgttaagggaggttcaggaaaggtggtacgccctgttgtatgaccctgtcattagcaaattagcttgccaagccatgagacagttgcatccggaggctatcgcggcaatacagtctaaggctctgttctctaaggcagaggaacagctcctgtctaaagtagggtcgacctcccaaccgacccttgaaacgttccaggatctgctgcataggcaccctgacgctttctacctcgctcggacagctaaagcactgcaggcgcactggcagctgatgaaacagtattacctgctggaggatcagactgttcagcccctgcctaagggcgaccaagtactgaatttctctgacgccgaagacctcatcgatgactccaaactcaaagacatgcgagatgaggttcttgaacatgaactgatggttgcagatcgacgccagaagcgcgaaataagacaacttgagcaggagctgcacaagtggcaggtgctggtcgatagcatcacggggatgtcttccccagatttcgataatcagactctggctgtgctgcgcggtcggatggtgcgatacctcatgcgctcccgcgaaataactctgggcagggccacaaaggacaatcaaatcgatgtcgacctgtcgctcgagggtcccgcatggaaaatttcgcgaaagcagggggtaatcaagcttaaaaataatggagacttctttatcgctaacgaggggaggcgtcccatctacatagacggaaggcccgtgctgtgcgggagcaaatggaggctcagtaataacagtgttgtggaaatcgccagcctcagatttgtctttctcattaaccaggacctgatcgctctgatcagagctgaggctgccaagatcacccctcagtag

SEQ ID NO: 31621 - DNA, 576 bp, Artificial Sequence
  Description of Artificial Sequence: Synthetic coding sequence
atggggaagaaaaccaagaggacagccgattccagcagtagcgaggatgaggaagaatatgtggtcgagaaggtgctggaccgcagggtggtgaaggggcaggtcgaatacctgctcaaatggaagggcttttcagaggagcataacacctgggaacctgagaagaacctggactgtccggaactcatctcagagtttatgaaaaagtacaagaaaatgaaagagggagagaacaataaaccccgtgaaaagtccgaaagcaataaaaggaaaagtaatttctctaacagcgccgatgacatcaaatctaaaaaaaaaagagaacagagcaatgatattgctcgtggctttgagcgtggattggagcccgagaaaattatcggtgccactgattcctgtggtgacctgatgtttctaatgaagtggaaagatacagatgaggcagatctggtcctagccaaagaagcgaacgtgaagtgccctcagatagtgattgccttctacgaggaacggctcacgtggcatgcgtaccctgaagacgccgagaacaaagagaaggagacagcgaagtcttag

SEQ ID NO: 31622 - DNA, 1212 bp, Artificial Sequence
  Description of Artificial Sequence: Synthetic coding sequence
atggcctcttcatcagtaccgcctgccaccgtctctgcggctacggcagggcctgggcctggcttcggcttcgcatctaaaacaaagaagaagcactttgtacaacagaaagtgaaagtgttcagagccgctgaccctctggtgggcgtgtttctctggggggtggcacactctataaatgagctgagccaagtgcccccacctgtgatgttactcccggatgactttaaggcgagctcgaagattaaagaatactgtcctcaggtgttcagaaaccttcgtgataggttcggcattgacgaccaggactacctggtgtcgcttacgagaaatcccccttccgaaagcgagggctctgatggcagatttctgatcagctatgatagaacactagtgataaaggaagtgagtagcgaggacatagctgatatgcactctaacctgagtaactaccaccaatacattgtcaaatgccacggtaacactctcctgccccagttcctggggatgtaccgcgtttctgtggacaatgaggatagttacatgctcgtaatgcgtaacatgttctctcatcgccttcctgtgcaccggaaatatgatctaaaaggctcgctcgtctctagagaggctagcgataaagagaaggttaaggagctacccacgctcaaagatatggatttccttaataaaaatcagaaggtttatatcggcgaagaggagaagaagatttttttagagaagctcaagagagacgtcgaatttctagttcagttgaagatcatggactatagtttactgcttgggatccacgatatcattagaggttccgagcctgaagaagaagctcccgtcagggaagacgagtcagaagtggacggtgactgctcccttacaggacccccagcactcgtggggtcctatggcaccagtcccgaaggcattggcggttacatccactcccacaggcccctaggccctggggaatttgaatcatttattgacgtgtatgccattaggtccgccgagggggcaccgcagaaggaggtgtattttatgggactgatcgacatcctaactcaatacgacgccaagaagaaggccgctcatgccgctaaaactgtgaaacatggcgctggcgcagaaattagtacagtgcatcctgaacaatatgccaagcggtttttggatttcataacaaacatatttgcgtag

SEQ ID NO: 31623 - DNA, 576 bp, Artificial Sequence
  Description of Artificial Sequence: Synthetic coding sequence
aaaatcgaagtcatcgaaattatgacagaccggggtagtggaaagaagaggggctttgcctttgtgaccttcgatgatcacgactccgtcgataagatagtgatacagaaataccacacagttaatggccacaactgcgaagtgaggaaggctttgagcaagcaagagatggcttccgcctcctcatctcagaggggcagaagcgggtccggaaatttcggcggaggcaggggcggtgggttcggcggaaatgataacttcggacggggaggaaacttcagcggcaggggaggcttcggtggctcaagaggaggcggagggtacgggggtagtggtgacggatacaatggatttggaaacgacgggtctaatttcggcggagggggatcatacaacgactttgggaattacaataaccagtcttccaactttggtccaatgaaaggtggtaatttcggcggtcgttcttccggcccatacgggggtggtgggcagtacttcgctaaacccagaaatcagggaggatacggagggtcaagcagttccagctcctacggaagcggtagacgtttctag

SEQ ID NO: 31624 - DNA, 543 bp, Artificial Sequence
  Description of Artificial Sequence: Synthetic coding sequence
atggaactaacaatcttcatccttaggctggcgatatacattttaacttttccgctgtatctcctgaacttcctcgggctctggtcctggatatgcaagaaatggttcccgtattttctcgtgaggttcacagtaatctacaatgaacagatggccagcaagaagagagagctctttagcaacttgcaggagtttgccggtccctcaggaaagctttctcttttggaggtgggctgcggcacaggcgctaattttaaattttatcctcctggttgccgtgtcacctgtatagacccaaatcctaattttgagaagtttcttatcaaatctatcgctgagaaccggcatctccaatttgaaagatttgtcgtggcggctggtgagaacatgcaccaggtggccgacgggtcagtcgacgttgttgtgtgcactttggttctttgctccgttaagaatcaggagagaattctgagagaggtttgccgggtgctcaggcctgggggagccttctattttatggaacatgtggctgctgagtgctag

SEQ ID NO: 31625 - DNA, 1431 bp, Artificial Sequence
  Description of Artificial Sequence: Synthetic coding sequence
atgggactaaagaagatgaagggcctgagctacgatgaggccttcgctatggcaaacgaccccttggaaggttttcacgaggtgaacctcgcctctcccacctcgcccgatctgttgggagtttacgagtcaggtacacaagagcagaccacaagcccctcagtgatatatagaccgcatccctcagctttatcaagtgtcccaattcaggccaatgctctggatgtgagcgagttacctacccagccggtttactcatctccgagaagactcaattgtgccgagatcagcagtatttcattccacgttaccgaccccgctccctgtagcacttcgggcgtgacggctggactgaccaagctgacaactcgcaaggacaactacaatgccgaaagggagttcctgcaaggggcaaccatcactgaggcttgtgacgggtcagacgatatttttgggctgagcaccgacagtttaagccggctgcgcagccctagcgtcctggaggtccgagagaaaggctacgaaaggctgaaggaggaactcgcaaaggctcagcgcgaactgaagttaaaagatgaggagtgtgaacgcctctctaaggttcgggaccagcttggacaggagttggaggaactaactgcatcactgtttgaggaggctcacaaaatggtgcgcgaagcgaatatcaaacaggcgacggccgagaagcagttgaaagaggcacaggggaagatagacgttctgcaggccgaggtcgcagcattgaagactcttgttcttagctcctcaccaacaagcccaacacaggagcccctccccggaggtaaaacaccattcaagaagggacacactcgaaataaaagtacttcttctgccatgtctggctcacaccaggacttaagtgtgattcagcctatcgtgaaagactgtaaggaagctgacctaagtctctacaacgagtttcgactatggaaggatgaaccaacaatggaccgtacatgtccattcttggacaaaatctaccaggaagacattttcccgtgtctgaccttctccaaatccgagctcgccagcgctgtgcttgaggcagtcgaaaacaacacgctgtccattgaacccgtaggcttgcagcccatccgctttgtgaaagcatccgccgtcgaatgtggcggaccaaagaagtgtgccctgacaggtcaatcaaagtcttgtaaacacaggatcaagctgggggatagctctaactactactacatcagtcctttctgcaggtataggataacctccgtttgtaatttctttacttacattcgttacatccagcagggccttgtgaaacagcaagacgtggatcaaatgttttgggaagtgatgcaactccggaaggagatgagtctggctaaactcggatactttaaagaggaactgtag

SEQ ID NO: 31626 - DNA, 336 bp, Artificial Sequence
  Description of Artificial Sequence: Synthetic coding sequence
atggatacaatgatgctcaatgtgcgcaatttatttgaacagctcgtgcgtcgggtggaaatcctctccgaaggtaatgaagtgcagtttatccagttggctaaggacttcgaggattttcggaaaaaatggcagcgtacggaccacgaattgggtaaatacaaggacctcttaatgaaagccgagactgaaaggtccgcacttgatgtgaaattaaaacatgcaagaaatcaggtggatgtggagataaagcgtcgacaacgcgctgaagccgactgtgagaaacttgagcgtcaaattcaattgatcagggagatgctgatgtgtgacacgtag

SEQ ID NO: 31627 - DNA, 324 bp, Artificial Sequence
  Description of Artificial Sequence: Synthetic coding sequence
atgataaagaacttagaagtgcagcttcgaagggccaccgacgagatgaaggcctatatctcctccgaccagcaggagaagagaaaagccatcagggagcagtacaccaaaaacaccgccgagcaggaaaacctgggtaagaagctgagagaaaagcagaaggttattcgtgagtcccatggaccgaatatgaagcaggccaaaatgtggagggacctagagcagctgatggagtgcaagaagcagtgcttcctgaaacaacaatcacaaacaagtatcggtcaggttattcaagagggcggtgaggaccgcctgatactgtag

SEQ ID NO: 31628 - DNA, 2772 bp, Artificial Sequence
  Description of Artificial Sequence: Synthetic coding sequence
atgtgcatcccccctccaaacgtgactggctctcttcatattggtcatgccttgaccgtggctattcaagatgccctggtgcgctggcataggatgcgaggcgaccaagtattatgggtcccaggaagcgaccacgccggtatcgccactcaggcagtcgtggaaaaacaactgtggaaagagagaggagtgcgccgacatgagctaagccgggaggcttttctgagagaagtgtggcaatggaaggaagccaagggtggggagatctgcgagcaactgcgagccctgggggcatctctggattgggatcgcgagtgcttcaccatggatgtgggctcgagcgttgctgtgaccgaggccttcgtgcgtctgtataaagcaggcctgttgtatcggaaccatcaacttgttaattggtcctgcgcacttcggtcagcaatctccgacatagaagtcgaaaatcgcccacttcctggccacacccaattgcgactcccagggtgccccacacctgtgtcctttggtctgttattctcggtcgcattccccgtggatggtgaaccagatgctgaggtcgtggtagggactactcgtcccgagactctacctggcgatgtggccgttgccgtccaccctgatgacagtcgctacacgcacctgcacgggcgtcaactccgccacccattgatggggcaaccgctcccattgattacagactacgcggtccagccccacgtgggaactggggctgtgaaagtgacgccagcgcactcccccgcagatgcagaaatgggagctcgccacggattaagccctctgaatgtcatcgcagaagacggaacaatgacatcactttgcggggactggctgcagggacttcacagatttgtggcccgagagaaaatcatgtctgtattatctgagcgaggtctgttccgcggactgcagaatcatccgatggtgctgcctatctgttctcgcagcggcgacgtgatcgaatatttgcttaaaaatcagtggttcgtgaggtgccaggaaatgggggcaagggcggcaaaagccgtagagagcggtgccttggagctgagcccttcctttcaccagaaaaattggcagcactggttctctcacattggagattggtgtgtgtctcgtcagctgtggtggggtcaccagattcccgcttatctagttgttgaagaccacgcccagggggaggaggactgttgggtggtgggcaggtctgaggccgaggcccgagaggtggccgctgaactgaccggcaggccgggagcagaacttaccctggagagggatccggatgtcctggatacgtggttcagcagtgcgctgttcccgttcagtgccctaggctggccacaggaaacacctgaccttgcgagattttatccacttagcctcctggagacagggagcgatctgctactgttttgggtggggaggatggtgatgctggggacacagctgacaggccaattaccatttagcaaagtgcttctacatccaatggtgcgagacagacagggtagaaagatgtcaaagtcgctgggcaacgttttggatcctagggacatcattagtggcgtcgagatgcagctgttacaggaaaaacttaggagtgggaacctagatcccgctgagttggccatcgtcgcagccgcacagaagaaggacttcccacacggaatcccagagtgcgggacagatgcgttaagatttacactgtgttcccacggcgtgcaggctggtgacctgcacctttcagtgtccgaggtccaatcttgccgccacttctgtaataagatctggaacgccctgagattcattctgaacgccctgggcgaaaaattcgtgccacaacctgccgaagaactttccccatcaagtcccatggacgcttggatacttagtaggcttgccctcgcagctcaggaatgcgagaggggcttcctgaccagagaattatcactggtcacacatgcactccatcacttctggctccataatctgtgcgacgtctacctcgaagctgtgaagcctgtgctttggcattcgcctaggcctctcgggcctcctcaggtgctgttcagctgcgccgatctaggtctccgactcctagctccactgatgccattcctggccgaagaattgtggcagcgcttgccacctcgacctggctgcccccctgccccttcaatctccgtggcaccatatccgagtgcctgttcactagagcattggagacagcccgagctcgagagacgctttagcagggtgcaggaggtggtgcaggtgctaagagccttacgtgcgacctaccagttaacaaaagcacgcccacgggtactgctgcaaagctccgaaccaggagaccagggcctgtttgaggctttcttggaacccctgggaacccttggatattgcggcgcagtaggactcctgcctcccggtacagcagccccaagcggctgggcacaggcaccacttagcgatacagcacaagtgtacatggaactgcaagggctcgttgatccgcagatacaactgccactcttggccgcacgaagatacaagctgcagaaacagctggatagcttgactgcccgtacaccaagcgagggggaagcgggaacacagagacagcagaagctgtccagcctccagctggagctgagcaaactcgacaaagcggcatctcatctgaggcagctcatggacgagcccccagctcctggatcacccgaattatag

SEQ ID NO: 31629 - DNA, 2076 bp, Artificial Sequence
  Description of Artificial Sequence: Synthetic coding sequence
atggaggagagccccctcagcagggcacccagccgcggtggcgtcaacttcctgaacgtggcccgaacatatattcctaacacaaaagtggagtgtcactatactctacccccaggcactatgccttctgcctccgattggataggaattttcaaggtcgaggctgcttgtgttcgcgattaccacactttcgtgtggtctagcgtgcccgagtctaccacagatggaagtcccatccacacaagcgtccaattccaggcaagttaccttcctaagcccggagcgcagttgtatcagtttcgttatgtgaaccggcaaggacaagtgtgtgggcagagtcctccctttcagtttcgggaacctagacccatggatgagctggtcactctggaggaggcagatgggggaagtgacattcttctcgtggttcccaaggctactgtcctgcaaaatcaactggatgagtctcagcaggagcgcaatgacctaatgcagctcaaacttcagctggaaggccaagtcaccgaattgcgaagccgcgtccaggaattggagagggcgttagcaaccgccagacaggagcatacggaacttatggagcaatacaaaggaatctctaggagtcatggagaaatcaccgaggagcgggacatcctgtcccggcagcagggggaccacgtcgcaaggattttggagcttgaggacgatatccagactatctcagaaaaggtcttaaccaaagaggtcgaattggataggctcagagacaccgtcaaggctctgacccgggaacaagagaagttgctcggacagttaaaggaggtacaggccgacaaggagcagtccgaagccgagctgcaggtcgcccaacaggagaaccaccacctgaacttggatctgaaggaggccaagtcgtggcaagaagaacagagtgcacaggcgcagaggttaaaagacaaggtagcacagatgaaggataccctgggtcaggcacagcagcgagtggcagagctcgagcccctgaaagagcagcttcggggagcgcaggaactagcagcgtcttctcagcaaaaagccaccctcctgggagaggagttagcctctgctgcagcagcacgtgatagaacaatcgcagagctccatcgcagtagactggaagtcgctgaggtgaacgggaggctagcagagctaggccttcacttgaaagaggaaaaatgtcagtggagcaaggagcgggctgggctgcttcagagtgtggaagctgagaaggacaaaattctaaaactcagcgccgaaatactcaggctggagaaggcggtgcaggaagagcggacacagaaccaagtatttaaaactgagttagcacgggaaaaggattcctctctggtgcagttgagcgagtcaaaacgggagttgacggagcttcgaagcgcactgagggtactgcagaaagaaaaggaacagctgcaggaagagaaacaggagttgctcgagtacatgagaaaactcgaggcccgtctcgagaaggttgctgacgagaagtggaatgaagatgccaccaccgaggacgaagaggcagcagtggggctctcatgcccggctgccctgactgactcagaggacgaaagccccgaggatatgcgcttgccaccctacggtttgtgtgaaaggggcgaccccggatcatctcctgccggtccacgagaagcatctcctctggtggttatttctcaacccgcacctatttcgccacatctttccggaccagcagaggattcatcctccgattcagaggctgaagacgagaaaagcgtgctgatggcagctgtccagagcgggggtgaagaagctaatctcctgttgcctgaactgggctcagcgttttatgatatggccagcggcttcactgttgggacactctccgaaacctcaacaggcggacctgctacccccacctggaaggaatgccctatctgcaaggagagatttccagccgaatccgacaaagacgccctggaggaccacatggatggccactttttcttttctacccaggatccttttacctttgagtag

SEQ ID NO: 31630 - DNA, 366 bp, Artificial Sequence
  Description of Artificial Sequence: Synthetic coding sequence
atgaacgaatcaaagccaggcgactcacagaatctcgcatgtgtgttctgtagaaagcacgacgactgccctaataagtacggcgagaaaaaaactaaggagaagtggaacctgacagtccactactattgcctcctaatgagttcaggtatctggcagcggggtaaggaagaagagggcgtttacggattcctaatcgaagacatccgtaaggaagtgaatcgggcatccaagcttaaatgctgcgtgtgcaaaaagaacggcgcttccatcggctgcgtagcacccagatgtaaaaggtcctaccatttcccctgtggcttgcaacgcgaatgcattttccagtttaccggaaattttgcatag

SEQ ID NO: 31631 - DNA, 657 bp, Artificial Sequence
  Description of Artificial Sequence: Synthetic coding sequence
atgaattgtcggtccgaggtcctggaggtttctgttgagggcagacaagtggaagaggcaatgcttgcagtcttgcataccgtcctgctccacagatctaccgggaaatttcactacaaaaaagagggaacttacagcatcggaacagtgggtacccaggacgtcgattgcgacttcatcgacttcacttacgtgagggtatctagcgaggagctcgatcgcgctctgcgtaaggtggtgggcgaattcaaggacgcactcaggaactcggggggagacggtctcggccaaatgagtctagaattttaccagaaaaagaagtcgaggtggccttttagcgatgagtgtatcccttgggaagtctggaccgtgaaagtgcacgtagtcgcgttggccactgagcaggaaaggcaaatatgccgggagaaggtgggcgagaaactctgcgaaaaaatcattaatatcgtggaagtcatgaatagacatgagtatttaccaaagatgcccactcaatccgaagtggataatgtttttgataccggcctgcgggatgtccagccttacctctacaagatcagcttccagataacagatgccctgggtacatcagtcactacgacaatgcgccgtctgatcaaggacacactcgccctgtag

SEQ ID NO: 31632 - DNA, 1899 bp, Artificial Sequence
  Description of Artificial Sequence: Synthetic coding sequence
atggacacgatgatgctgaacgtgcgcaacctgttcgaacagctggttcggagggtggagatcctatctgaaggcaatgaggtacaattcatacagcttgccaaagactttgaagattttcggaaaaagtggcagcgaacggaccacgagctgggtaaatacaaggatctactgatgaaggcagaaacagagagaagcgcattggatgtgaaactgaaacatgcaagaaaccaagttgacgtggagatcaaacgaagacagagggccgaggccgattgcgagaagctggagcgtcagattcagctaattcgcgagatgctgatgtgcgacacatctgggtccatccagctgagcgaggaacagaaaagtgcactggctttccttaacagaggacaaccctcctcctcaaacgctggcaataaacggctctcgaccatcgacgaatctgggagcattctgtccgacatcagcttcgacaaaaccgatgagtctctggattgggattcatctcttgtgaaaacgttcaagcttaaaaagagggaaaagcggcgaagcacgtctcggcagttcgtcgacggaccccctgggccagttaaaaaaacacggtccatcggcagtgccgtggatcaggggaacgaaagtatcgtggctaaaacgactgtgactgtgcctaatgatggaggaccaattgaagcagtctccactattgaaacagtgccttactggactaggagcagacgcaaaacaggaacactccaaccttggaactcagactcaacattaaattctagacagctggagccccgtaccgagaccgatagtgtgggaaccccgcagtccaatggaggcatgcgcctacacgactttgtaagcaaaacagtgatcaaacctgaatcgtgcgtgccctgcggaaaacgaattaaatttgggaagctgagcctgaagtgtagggattgtagggtggtctcccatccagaatgcagggacaggtgtcccctcccctgtatcccaaccctgatcggaacccctgttaagatcggagagggcatgctcgcagacttcgtgagccagacctctcccatgattccttcaattgtggtgcactgtgtgaacgaaatcgagcagagaggtctgacagaaaccgggctgtaccggatatcaggatgtgacagaactgtcaaggagttgaaggagaaatttctgcgggttaaaactgtacctcttctgagcaaagttgacgacatccatgccatctgcagcttgttgaaggattttttgagaaatctgaaggagcctctgctcacattcaggttgaatagggctttcatggaagcggcagaaatcacggacgaagacaactccatcgccgctatgtatcaggcggtgggggagctcccgcaggcgaacagggacacattggcttttcttatgattcatctgcaacgggttgcccaatctccccataccaagatggatgtagctaacctggctaaagtgtttgggccaactatcgtagctcatgctgtcccaaacccagaccctgtgacgatgctgcaggatattaagaggcaaccgaaggtggtggaacggttgctttcactccctctagaatactggagccaattcatgatggtggagcaggaaaacatagaccctcttcatgtgattgaaaactccaatgcattctccaccccacagacgcccgatattaaagtgtccctgctgggaccagtgacgaccccagagcatcaactgctgaagacaccatcttcatccagcctgtctcagcgcgtgcggagtactctcaccaaaaacacaccccgatttgggtctaagagtaaatccgcaacaaaccttggcaggcagggcaatttcttcgcatcccccatgctgaagtag

SEQ ID NO: 31633 - DNA, 1134 bp, Artificial Sequence
  Description of Artificial Sequence: Synthetic coding sequence
atggcaacgatccctgattggaaactgcagctactggcccgacgcagacaggaggaagcgagcgtcaggggtagagaaaaggcggaaagggaacgactgtcccaaatgccggcttggaaaagggggctcctagagcggaggagagccaagctggggctcagcccaggtgaacctagtcccgtgttaggtactgtggaagcgggacccccagacccagacgaatccgccgtgctgttggaggctatcggtcccgtgcaccagaatcgatttattcgacaggaacgccagcaacagcagcaacagcagcagcggtcagaggagcttctggctgaaagaaagccagggccactcgaggctcgcgaacgcaggccgtccccaggggagatgcgagaccagtctccgaaggggagggagtctcgtgaggagcgcctgagcccccgtgagacgagagagcgcaggctggggatcgggggtgcacaggagctctcattaaggccactggaggcacgagattggaggcagagcccgggagaggtgggcgatagatccagcaggctgagtgaagcctggaagtggcggctgtccccaggggagacacctgagaggagccttaggctggctgaaagtagggagcagtctcctcgcaggaaggaggttgaatcgaggctttccccaggggagagtgcctaccagaagttaggactgaccgaagcacacaagtggcggccagactcaagggagagccaggagcagtctcttgttcagctggaagccacagagtggcgcctgcggtcaggagaggagcgtcaggattactcggaggagtgtgggaggaaggaagagtggccagttccaggggtcgcgcctaaggagaccgcagaactcagcgagaccctgacaagggaagctcagggcaacagttccgccggtgtggaagcagctgagcagagacccgtagaagatggcgagagaggaatgaagcctaccgaaggctggaagtggacactgattatgtctctcgcagggaaagggaatcaacatcttgtcacatgcttccctcacccagtttccggaggccgtgcaaattgtccaatcagcaccctgattcaatctccctggtgcggttggggctag

SEQ ID NO: 31634 - DNA, 1134 bp, Artificial Sequence
  Description of Artificial Sequence: Synthetic coding sequence
atggcaactatccctgactggaagttgcagttgctcgccagaaggaggcaggaagaagccagcgtgagggggagggagaaagcggagagagaaaggttgagccagatgcctgcttggaagcggggtttgctggaacgaaggcgcgcaaaattaggtttgagccctggcgaacctagccctgtgttgggtacggttgaggccggtcctcccgacccagatgaatctgccgtgctgctggaggccatcgggcctgtgcatcagaacagatttatacgccaagaaagacagcagcagcagcagcagcagcagagatctgaagagttgctggccgaaaggaagccaggcccacttgaggcaagagagcgacggccttcaccgggagaaatgagggatcagagccccaaagggagggaatcccgcgaggagcggttgtctccacgcgagaccagagaacgaagactaggcatcggtggagcccaggagttgtctctgagaccattggaagcacgcgattggcgccagagtcctggcgaggtgggcgatcgttcttctcggctctcggaagcatggaagtggcggctgagtcccggagagaccccggaacgaagcctccgactggcagagtctagggagcagtcccccagacgaaaggaagtcgagagtcgactgtctccaggcgaatctgcgtaccagaaactcgggctgactgaagcacataaatggcgcccagatagtcgcgaaagccaggagcaatccctggtccagctggaagctacagagtggaggctaagaagcggcgaggagaggcaggattattccgaggaatgcggacggaaggaggagtggccagtacccggagtcgcccctaaggaaacggctgagctgtcagaaacacttactagggaggctcagggaaattcttccgctggggtggaagccgctgagcagagaccagtggaggatggggagcggggtatgaaacccactgagggctggaagtggacacttatcatgagtctcgcaggcaagggaaatcaacatcttgtcacgtgcttcccacatccagtgtctggcggtcgcgctaattgtccgattagtacactgatccagtccccctggtgtggttggggctag

SEQ ID NO: 31635 - DNA, 774 bp, Artificial Sequence
  Description of Artificial Sequence: Synthetic coding sequence
atgcctcaccttcctttggcgtcctttcggccaccattctggggcctgaggcattctcgtggcctcccccgttttcactctgtgtctactcaaagtgagccccacggctcaccgatctcacgcaggaaccgggaagcaaagcagaaacgactcagggagaagcaggctaccctagaagccgaaatagccggtgaaagtaagagtcctgccgaaagcatcaaggcatggcggccaaaggagctggtgctctacgagattcccaccaaaccaggagagaaaaaggacgtgtctgggccactgccacctgcatattctccaaggtatgtagaggctgcatggtacccctggtgggtgcgcgagggcttcttcaaaccagagtaccaggccagactgccacaggccacaggagaaaccttctcgatgtgtatccccccaccgaatgtgacaggctccctccatatcggacatgcattaactgtggcgatccaagatgcactagtgaggtggcacagaatgcgcggagatcaggtgttgtgggtgccaggcagcgaccatgctggtattgccacccaggcagtagttgagaagcagctgtggaaagaaaggggggtaaggagacatgagctttcaagagaggcattcctcagggaagtgtggcaatggaaggaggcaaaaggcggagagatttgtgagcagctccgcgctctgggcgcttctctcgattgggatcgggtattttaccacggttgttggttgctttctggatgcgactag

SEQ ID NO: 31636 - DNA, 1446 bp, Artificial Sequence
  Description of Artificial Sequence: Synthetic coding sequence
atggcctcggccgcttcagtaacgagcctggctgatgaagtgaattgcccgatctgtcaggggactctccgtgaacctgtgacaatcgattgcggccacaatttttgtcgtgcttgcctcacgcgttattgcgagattccaggcccagatttggaggaatctccgacctgccctctttgtaaggagccattcaggccaggctccttcaggccaaactggcagctagcaaatgtggtcgagaatatagagaggctgcaactcgtttcaactcttggactcggggaagaagacgtgtgccaggagcacggagaaaaaatctacttcttctgcgaagacgatgagatgcaactgtgtgtagtgtgtagggaggctggtgagcacgccacgcacaccatgcggtttctggaagatgctgctgcaccttatagagagcaaatccataaatgcttaaagtgcctgcggaaagagagagaggaaatccaggagattcaaagccgcgagaataagaggatgcaggtcctgcttacacaagtgtcaactaaacggcaacaggtcatctcagaatttgcccatctccgaaaattcctggaggagcagcaatccatcctacttgcacagctggaatcacaagacggagacatcctgcgccagcgagacgaatttgacctgctggtggcaggcgagatttgcaggttttccgctctgattgaagagctcgaagagaaaaacgagaggcctgcaagggagcttttaactgacatccgctcaactctgatccgatgtgagacccgcaaatgccgtaagccagtagccgtgagccctgagctgggccagaggatccgcgattttccacagcaagccctgccacttcagcgcgagatgaaaatgtttctggaaaacttacccaatcacctggtgattcctaccgcccacatctctctggacccacagacaagccaccccaagcttctcctgtccgaagaccaccagagggctcagttcagttataagtggcagaatagccctgacaacccccagcgctttgaccgggcaacatgcgtccttgcccatacgggcatcactggcggtcggcacacctgggtagtgagcatcgacttggcccacggcggatcatgtactgtgggggtcgtcagtgaggacgtgcagcggaagggagagttgcgcctgcgcccagaggaaggtgtttgggctgtgcgactcgcatggggattcgtgtcagctctgggttctttccccaccaggctgacccttaaagaacagcctaggcaggttcgtgttagccttgactatgaggttggctgggtgacctttaccaatgccgttacacgggaacctatttacacattcacagcctctttcacaaggaaggtgatcccctttttcggcctgtggggcagggggtccagcttttcattgagcagctag

SEQ ID NO: 31637 - DNA, 597 bp, Artificial Sequence
  Description of Artificial Sequence: Synthetic coding sequence
atgactttgcggtgcttagagccctccggaaacgggggtgaaggcaccaggtcccagtggggaaccgctggttcagcagaggagccctccccacaggccgctcggctagcaaaagctttgagggaactaggccagaccgggtggtactggggttcaatgaccgtcaatgaggctaaggaaaaacttaaagaggcgcctgaaggaacttttttgatacgagattcctcgcactccgattatctgttgacaatttctgtgaagaccagcgcagggccaacgaacctgaggattgaatatcaggatggcaagtttcggttggatagcatcatttgcgtgaagtcaaaactgaagcagttcgacagcgtggttcaccttattgattattacgttcagatgtgcaaagacaagcgaactggtcccgaggcccctcgcaacggtacggtgcatctgtatcttacaaagcctttatacacatcggcaccttctctgcagcatttatgtcgcctcacaataaacaaatgtaccggtgccatttggggactgcccctgccaacaaggctgaaagattatctcgaagagtacaaattccaggtgtag

SEQ ID NO: 31638 - DNA, 345 bp, Artificial Sequence
  Description of Artificial Sequence: Synthetic coding sequence
atgacaaccagacaggctaccaaagatcctctgctgcgcggagtaagccctactccgtccaaaatacccgtccggagtcaaaagcggacacctttccctacggtgacaagttgtgcagtcgaccaggagaaccaagatccacgtcgttgggtgcagaaacctccacttaacattcagcgtccactcgtcgatagcgctggacctaggcccaaggcgaggcatcaagcagaaacatctcagaggcttgtgggtatctcacaaccaagaaacccactggaggagttaaggccgagccctcgcggtcagaatgtgggcccagggcctccagctcagacggaggcttag

SEQ ID NO: 31639 - DNA, 1446 bp, Artificial Sequence
  Description of Artificial Sequence: Synthetic coding sequence
atggcttcagctgcgagtgtgacctccttagctgatgaggtcaactgtcctatttgtcagggcactcttcgagaacccgtcactatcgactgcggacataatttttgccgtgcgtgcttgacacgatactgtgagatccctggtcccgatctggaagagagccccacgtgtccgctctgcaaggagccattcaggcctggttcctttagacctaactggcagcttgccaatgtggtggaaaacatagaacgcctgcagttggtgtctaccctgggtctcggtgaagaggacgtgtgccaggaacatggggaaaagatctactttttctgtgaggatgatgaaatgcagctctgcgttgtttgtcgcgaggccggagagcatgcaacacatacaatgcggtttctggaagacgccgctgcaccctatcgggagcaaatccacaagtgccttaaatgtcttcgaaaggaacgggaggaaatccaagagatccagtctcgtgagaataaaaggatgcaagtgttattgactcaggtctccacaaagaggcagcaggtcatctctgaatttgcccacttgagaaagttcctggaggagcaacagtctatcttattggcccagctcgagtcacaggacggagatattctgaggcaaagagacgagtttgacctcctggtagcgggtgagatttgtcgattctccgctctgattgaagagctggaagagaaaaatgagaggccagcaagggagctgctgacagatatccgcagcacactcatccgctgtgaaacaaggaaatgcaggaagcccgtggcggtgtcccccgaattgggtcaaaggattagagacttcccccagcaggctctgccgctccaacgcgagatgaaaatgttcctggagaatctgcccaaccatctcgttatcccgacagctcatatttcactcgacccccagacctctcatccgaaacttctgttaagcgaagatcaccagcgggcacagttttcttacaaatggcagaactcacccgataacccccagagattcgacagagccacgtgcgtgctggcacacactggcatcaccgggggtaggcacacttgggttgtttctatcgatctggcacatggcggttcctgcacagtgggagttgttagtgaagatgtgcagcggaagggggagttacgattgcgcccagaagaaggagtctgggccgtaagacttgcatgggggttcgtctcagcccttggctccttcccaacgagattgacactcaaagagcagccacgtcaggtaagggtgagcctggactatgaggtgggatgggtgaccttcactaatgctgtgactagggagcctatatacacgttcactgcctcattcacacgcaaagttatacccttctttggactctggggacggggaagttcattttctctaagcagctag

SEQ ID NO: 31640 - DNA, 396 bp, Artificial Sequence
  Description of Artificial Sequence: Synthetic coding sequence
atgagcaagcgctacctccaaaaagcaacaaaggggaaattactcattataatcttcatagtcacactgtgggggaaagttgtgagtagcgccaaccatcataaagctcatcatgtaaagaccggtacctgtgaagtagtggccctgcatcggtgctgtaacaagaataaaatcgaagaacggtcccagactgtcaaatgctcttgcttcccgggacaggttgcagggaccacgcgtgctgccccttcgtgcgtagatgctagcatcgtcgaacagaaatggtggtgtcacatgcaaccttgtctcgagggagaggaatgtaaggtgctcccagaccgtaaggggtggtcctgtagttctggaaataaagtgaagacaactcgcgtcactcattag

SEQ ID NO: 31641 - DNA, 765 bp, Artificial Sequence
  Description of Artificial Sequence: Synthetic coding sequence
atggttcgggaagctaacatcaagcaggcaaccgccgaaaagcagctcaaagaggcccaagggaaaatcgacgttctccaggccgaagttgcagccctgaagaccttggttctaagttcctcccctacttcccccacgcaggagccattgccagggggtaaaactccatttaaaaagggccacaccagaaataaaagtacctctagcgcaatgtccggctcccaccaggatctctcagtcatccagcccatagtcaaggactgtaaggaggctgatctgagcctctataacgaatttcggctgtggaaagatgagcctacaatggataggacctgtcccttcctcgacaaaatctaccaggaagacatcttcccctgcctgaccttcagcaagtcagaattggcgtcagccgtgcttgaggctgtggagaataacacactttctatagagcccgtcggattgcagccaattcggttcgtgaaagcctcagctgttgagtgcggtggcccaaagaagtgtgccctgacagggcagtcaaagagttgcaaacatcgcatcaagctgggggacagctctaattattattatatctcccctttctgccgttaccgcatcacttccgtatgtaattttttcacgtacattcgctacatccagcaggggctggtgaaacagcaagacgttgatcagatgttctgggaagtaatgcagctccgcaaggagatgtccttggcaaagcttggatatttcaaggaagagctatag

SEQ ID NO: 31642 - DNA, 2772 bp, Artificial Sequence
  Description of Artificial Sequence: Synthetic coding sequence
atgtgtataccaccgcctaatgtcaccggtagcctccatataggccacgctctgaccgtggccatccaggatgcactcgtgagatggcacagaatgaggggcgatcaggtgctgtgggtcccgggtagtgatcatgctgggatcgccacccaggccgtggtggagaagcaactctggaaggagagaggcgtccgaaggcatgagctttctagagaggccttcctgcgagaagtatggcagtggaaagaagctaaaggcggtgagatctgtgagcagcttcgcgctctgggcgcaagcctggactgggatcgagagtgcttcactatggacgtggggtcaagtgtggcagtgaccgaagcgttcgtgcgcttgtacaaggcaggcctactctacagaaatcatcagttggtgaattggagctgcgcactgagatcagcaatctcggacatcgaggtggagaatcgccctctgccaggacatacacagttaagactgcctggttgtccgactcctgtctcattcggtttgctgttctccgtggccttcccggtggatggcgagccagatgccgaggtggtggtgggcacaactaggccagagaccttgcctggcgatgtggcagtagccgtccatcccgacgacagcaggtacactcacctccacggcaggcagctgagacacccactcatgggtcagccactgcctcttataactgactacgccgttcaaccccacgtgggcacaggtgctgttaaggtgacacctgcacactctcccgctgatgccgaaatgggagctagacacggactatcgccgctaaatgtaattgccgaagatgggacaatgacatctctttgcggcgattggctacaggggttgcatcgatttgtggccagagaaaagataatgtctgtactatctgagtgggggctgttccgcggactgcaaaaccaccccatggttctccccatttgttcaagaagtggcgatgttatcgagtatctactcaagaatcagtggtttgttaggtgtcaggagatgggcgcaagagccgctaaggctgtggagtcaggggctctggaactctctccctccttccatcagaagaattggcagcattggttctcccatattggggactggtgcgtgagcaggcagttatggtggggtcaccagatccctgcttatctggtggtggaagaccacgcccagggcgaggaggattgttgggttgtgggacgctcagaagctgaagctcgagaagtggccgctgagctcaccgggagaccaggagctgaattgacattagagagggaccccgatgtcctcgatacctggttctcttcagcattgttccctttctccgccctgggttggccacaagagacccccgatctggcacgtttctaccctctgagtctcttagagacaggctctgacctccttctattctgggttggaagaatggtgatgctagggacgcagctcacaggccagctgcccttctcgaaagtcttactgcatccgatggtgcgcgatagacaggggagaaaaatgagtaagtcgctgggaaatgtgcttgaccctagggatattatctcaggcgtcgagatgcaggtgctccaggagaaactgcgcagtgggaacctggacccggctgagctggccattgtggctgccgcacagaagaaagatttccctcatgggatccctgagtgcggtactgatgcccttcgcttcacgctgtgttcccatggggtgcaggcaggtgatcttcatctgagcgtatctgaggtgcagagctgtcgtcacttctgtaataaaatatggaatgcattgcgattcatcctgaacgctctgggggagaagttcgtgccacagccagcagaggagctgtcaccttctagtcccatggatgcttggatactgagcagactggccctcgccgctcaggagtgcgagaggggttttctcacacgcgagctgtccctcgtgacacacgctctgcaccacttttggctacataatctatgtgatgtatacctggaggcagtgaaacctgtactctggcatagcccgcgtcctctgggcccaccccaagtgctcttctcctgcgccgacctcggtctcaggttactggcccctctaatgcctttcttagccgaagagctgtggcagagactgccccctagaccgggatgtccaccggcaccatcaatttcagtggccccttacccaagtgcctgttctcttgagcactggcggcagccagagctggaaaggagatttagcagggtgcaagaggtcgtccaggtgctacgtgctctgagagctacgtatcagcttacaaaggcaagaccaagagtgttgcttcagtcctccgaaccaggcgaccagggcctattcgaggctttcctcgaacccctggggaccctggggtattgtggagccgtaggtctgctgcctcctggagccgcagccccatccggctgggcccaggctcccctttcagatacagcgcaagtttacatggagctgcaagggcttgtggacccccaaatccagctcccccttcttgctgcacgcaggtataaactccagaagcagctggacagtctgacagctaggaccccctccgagggagaggcgggtacacagcgacaacagaaactatcaagcctccagttggagctgagcaaattggacaaagccgctagccacttgagacaacttatggacgagccaccggctcccggaagccctgaactttag

SEQ ID NO: 31643 - DNA, 5228 bp, Artificial Sequence
  Description of Artificial Sequence: Synthetic coding sequence
atgatggagggaaacggaacagagaacagctgtagccgtactagggggtggctgcagcaggacaacgacgctaaaccttggctctggaaattctcaaattgtttcagcaggccagaacagaccctcccccacagcccccagaccaaggagtacatggagaacaaaaaggtggctgttgaattgaaggacgtaccaagccccctgcatgctggctctaagctctttccagccgtccccctgccggacattcgttcccttcagcaacctaagattcaactatccagcgtccctaaggtatcctgctgcgctcactgccctaacgagccgtcaacctctcccatgcgatttggtggcggaggtggcggttccgggggaacttcctcgctcatacaccctggcgcactgctggattcacagagtacacggacaattacttgccaagttggttccggtttcgctttccagagcgcctcatccctgcaaaatgcttccgcgagaaataatctcgccggtatagcttctgattttcccagcatgtgtttggagagtaaccttagttcttgcaagcacctgccatgctgtggaaagttgcatttccagtcttgccacgggaacgttcacaagctccaccagttcccatctctgcagggctgcacctccgcagggtacttcccctgttcagatttcacgagcggtgctcctggtcatctggaagaacacatatcgcaatccgagctgactccacatctttgcaccaattctttacacctaaacgtggtcccccctgtctgccttaaaggctctttgtattgtgaggattgtttgaacaaacccgctagaaattccattatcgatgccgctaaggtgtggcctaacatccctccaccgaacactcagccggcacccctagcggtgcccctgtgcaacggctgtggaactaaaggcactggaaaagagaccacattgttgcttgcaacctccttggggaaagctgcatcaaaattcggatcacctgaggtcgctgtagcgggacaggtgttagaaaatctgccgccaatcggagttttctgggacatagagaactgcagtgtacccagtggcaggtcagccacagccgtcgttcagagaattcgtgagaagtttttcaagggacatcgggaagccgaatttatctgcgtttgcgacatcagtaaggaaaacaaagaggtcattcaggagctcaataactgtcaagtgaccgttgcgcatatcaacgccacagccaaaaatgcagctgacgacaaattaaggcaatctctgaggcggttcgcaaatactcacactgcccctgctaccgtcgtgctggtttcgaccgatgttaactttgccctggagctgagcgacttaagacatcgacacggtttccacattatcctcgtgcacaaaaatcaggcaagcgaggccttactccaccacgctaacgagttgattcgctttgaagagttcatttcagacctaccaccaaggctgcccctgaagatgccctgtcataccctactatatgtctacaacctccccgctaacaaagacggtaaaagcgtgagcaaccggcttcggagactttctgataactgtgggggtaaggtcctttcaatcaccgggtgctctgcgatcctccggttcattaaccaagactctgccgagagggcccagaaacggatggagaatgaagacgtctttgggaacaggatcatcgtttcctttactcccaagaaccgggaactgtgtgaaactaaatcgtccaatgcgattgctgataaagtcaagagcccgaaaaagctaaaaaaccccaagctatgtctgatcaaagacgccagcgaacagtcgtcaagcgctaaagcgacccccggtaaaggtagccaggccaactcagggtccgctacgaagaacaccaacgtcaagtcacttcaagagctctgtcggatggagtctaaaaccggtcatcggaactccgaacaccaacagggacatctgcggcttgtggttccaactcacggcaatagctccgccgctgtgtctactcctaagaatagcggtgtagctgagcctgtgtataagacctcccagaaaaaggaaaatctgagcgccagatctgtgaccagctctccagttgaaaagaaggacaaggaagaaactgtctttcaggtctcatatccctctgcctttagcaagctggtggcttcaaggcaagtttcccccctgctcgcaagtcagtcttggagctcttcaagaagcatgtcacccaacctgctgaatcgtgcttccccactcgcatttaatatcgctaattcctcctccgaagctgactgtccagatccttttgctaatggagctgacgtgcaagtttccaatattgactaccggctctctagaaaagagctgcagcaactccttcaggaggccttcgccaggcatggcaaggtaaagagcgtcgagttgtcacctcatactgactatcagttgaaggccgtggttcagatggagaatctacaggacgctatcggagcagtgaactctctacatcgctacaaaatcggatccaagaagatcctggtgagtttagccaccggtgcggcatcaaagtctctgagcttgctgtccgccgagactatgtccgtcttacaggatgccccagcgtgttgcttgcccctgttcaaattcactgacatttatgaaaagaaatttggacataaactaaacgtgagtgacctatacaaactaaccgacacagtcgctatccgtgagcaggggaacggcagattggtgtgcttgttaccctccagccaggccagacaaagtccactgggcagctcacagtcccatgacggatccagcaccaattgttcaccaattatattcgaagagctggaatatcacgaaccggtgtgtagacagcattgtagtaataaggacttcagcgagcatgagttcgatcccgacagctacaagattcctttcgtgatcctgagcttaaaaaccttcgccccacaggtccattccttgctacagactcatgaaggcaccgttccactgctgtcatttccggattgctatatcgcagaatttggggacttagaggtcgtgcaggaaaatcaggggggtgtgccacttgagcatttcattacctgtgtccctggagtaaacatcgcaaccgcgcagaatggaataaaggtggtgaaatggatccacaacaagcccccaccaccaaatacagacccatggttgctcaggtcgaagtcacctgtgggcaacccacagctgattcaattctctcgcgaagtgattgatctcctgaagagccaacccagctgcgttattcctatttctcacttcattccatcatatcaccatcacttcgcaaaacaatgcagagtttctgactatggatacagcaagttgatcgaactcctcgaagccgtccctcacgtgctccagattctgggcatgggatcaaaacgactactgaccctaacgcatagagctcaagtcaagaggtttacccaagacttgctgaagctgctcaaaagtcaagccagcaaacaggtgatagtccgtgagttctcccaggcctaccattggtgcttcagcaaagactgggatgtgaccgagtatggcgtctgtgagctgatcgatatcgtttcggagatccccgataccacaatatgcttgtcccagcaggataatgagatggtcatttgtatccccaagagggaaaggacccaggatgagatagagaggacaaagcagttcagcaaggatgtggttgatttactcagacatcaaccgcacttcagaatgccgtttaataaattcattccttcttatcaccatcatttcggaagacagtgcaagctggcatactatgggttcactaaactgctggaattgtttgaggcaattccagacacactgcaggtgctggaatgtggtgaagagaaaatactgactctcaccgaagttgaacgattcaaggccttggctgcccaattcgtgaagctgttacggagccagaaggacaactgcctgatgatgactgatctactgaccgagtacgcaaaaactttcgggtacaccttcaggctgcaggactacgatgtcagctctatatccgctcttacacagaaactttgccatgtggtcaaggtcgccgacattgaatctggacgccagatccagttgattaatagaaagagcctacgatcacttacagctcagttgctagtactgctgatgagctgggagggcacgacccacctttccgtcgaagaactaaaaaggcactacgagtcgacacacaatacaccactaaatccctgcgaatatggtttcatgaccctcaccgagctcctgaagagtctcccatatcttgtggaggtctttactaatgataaaatggaggagtgtgttaagctcacttcactgtatctgtttgcaaaaaatgttaggtctctcctccacacctaccactatcagcaaatattcttgcacgagtttagtatggcctacacaaaatacgtgggtgagacgttgcagcctaagacatacggtcactcttccgtcgaggaactgctcggagccataccccaggttgtatggattaaagggcacggccacaagaggattgtcgtactgaagaacgatatgaaatcaaggctgtcaagcctttcattgtcgcccgcaaaccatgagaaccagccgagtgagggggaacgaatcttggaagtaccagagtctcataccgcgagcgagctgaaacttggggctgacggctctggaccttcccacactgagcaggaattactgcgcctgaccgacgactcacctgtagatctgctttgcgcaccagtgccgagctgcctgcctagcccacagctgaggcccgaccccgtgatccttcagtcagccgatctgatccagttcgaggagcgaccccaagagccctctgagatcatgatactgaaccaggaggagaaaatggagattcccattccgggtaagtctaaaacattgacctctgacagctctagtagctgcatttctgctgccgttcctgtgcctccctgccctagctctgagacctcagagtcactcttaagtaaggatccagttgagtcaccggcaaaaaagcaacccaagaaccgggttaagctcgcggcaaactttagcctggctccaataacaaaattgta

SEQ ID NO: 31644 - DNA, 774 bp, Artificial Sequence
  Description of Artificial Sequence: Synthetic coding sequence
atgccacacctacctctggcaagttttcggccacctttctggggcctgcgacacagccggggactgcctcgcttccactctgtatccacccagtctgagccccacggaagccccatctcccgcaggaaccgcgaggctaaacagaagcgcctgagggagaagcaggccacactggaggctgaaatcgcaggcgaatccaagagccctgccgagtcaattaaggcgtggcgcccaaaggagctagtgctctatgagattccaaccaagcccggtgaaaaaaaggacgtgtctggtccacttcccccagcctactctcccaggtatgtcgaagccgcatggtacccatggtgggtccgcgagggattttttaaaccagaataccaggccagattgccacaggccaccggggagaccttttccatgtgcataccccctcctaatgtaacgggatccctgcacataggccatgctcttactgtggcgatccaagatgcattagttagatggcaccgtatgaggggcgaccaggtgctgtgggtccctggatctgaccacgccggaatcgctacccaggcggtggtagagaagcagttgtggaaggagcggggagtgaggcgtcacgaactgtcgcgggaggcatttcttagggaggtgtggcaatggaaggaagccaagggcggagagatctgtgagcagctgagagccctcggagcttccctggactgggatcgggtcttctaccatggctgttggctcctaagcggctgtgactag

SEQ ID NO: 31645 - DNA, 1134 bp, Artificial Sequence
  Description of Artificial Sequence: Synthetic coding sequence
atggccacgatcccggactggaaactacagttgttggccaggcgcagacaggaagaagcctccgtgagaggtcgggagaaggctgagagggaaaggctctcacagatgccagcttggaagagaggtctactcgaacggcgtcgtgccaagctgggactgtctccaggtgaaccgtcacctgtgctcggcaccgtcgaggcgggtccaccagaccccgacgagagcgccgtgcttctcgaggctatcggcccagtgcatcagaacaggtttattcgccaagaacggcagcagcagcagcagcaacaacagagaagtgaggagctgctggccgagagaaaacccggaccactggaggcacgagagaggaggcccagccctggcgaaatgcgcgaccaatcacctaagggcagggagagtagggaggaacggctgagtcccagagagacacgggaaaggaggctggggattggaggagcacaggagcttagcttgaggcccctggaggccagggactggagacagtccccaggtgaagtgggagacagatctagtcggttatccgaggcttggaaatggcggctgagcccaggcgaaacccctgagagatcccttagactcgcggaatcgcgcgaacaatcacctcggaggaaggaggtcgaaagtagactctctccgggagagagcgcctaccaaaagctggggctcacagaggctcataagtggcgcccagacagtagagagagccaggagcaatcgctggtgcaattggaggccaccgaatggagactgaggtccggcgaagaacgtcaagactacagcgaggaatgtggcagaaaggaggagtggcccgtgcctggggtcgccccaaaagagaccgctgaactgagcgagaccctcacgagggaggcacagggaaatagctccgccggtgtagaggcggctgaacagagaccagttgaagacggagagagggggatgaagcccacggagggatggaagtggacactcattatgagcttagccggtaaagggaatcagcacttagtgacctgttttccacatcctgtctctggcggacgcgcaaattgtccgatctccactctgatccaaagcccatggtgcggatggggatag

SEQ ID NO: 31646 - DNA, 495 bp, Artificial Sequence
  Description of Artificial Sequence: Synthetic coding sequence
atgcgcattctgatcttgggcctggatggcgctggaaaaacaactatattatatcggttacaggtgggagaggtagtgaccactattcctacgattggtttcaatgttgaaactgtcacctacaagaatctcaaattccaggtgtgggaccttggagggcagacgtctatcagaccatactggcgatgctactatagtaatactgatgcagtgatctacgtcgtggacagctgcgaccgagaccgcataggtatcagcaaatccgaactggttgctatgctcgaagaagaagagctaaggaaggccattcttgtcgtgtttgcgaacaagcaagacatggagcaagccatgacatcttcagagatggcaaacagtctcggattgcccgcactaaaggacagaaagtggcagatcttcaaaacaagcgccactaaaggaacaggtttggacgaagccatggagtggctagtggagaccctgaagtccagacagtag

SEQ ID NO: 31647 - DNA, 393 bp, Artificial Sequence
  Description of Artificial Sequence: Synthetic coding sequence
atggatactatgatgctcaatgtgcgcaatcttttcgagcaattggtccgcagagtcgagattctgagcgaaggcaacgaggtgcagtttatccaactcgcaaaagactttgaagactttcggaagaaatggcaaaggactgaccacgaattagggaaatacaaggatctcctgatgaaagctgagacagagaggtccgcactcgatgtaaaactcaagcacgccagaaatcaggtggatgttgaaatcaaacgccgtcagcgggctgaggccgattgtgagaagcttgagcggcagatacagcttattcgggagatgcttatgtgcgatacttctggtagcattcagttgtcggaagagcagaagtcagcgctcgcctttttaaatagatag

SEQ ID NO: 31648 - DNA, 324 bp, Artificial Sequence
  Description of Artificial Sequence: Synthetic coding sequence
atggataccatgatgctgaatgtgaggaatttgttcgagcaacttgtgcgacgcgttgagattctgtcggagggaaacgaggtgcagttcatccagctggccaaggactttgaagattttcgtaagaagtggcaaaggaccgaccatgagctcggaaagtacaaggacctgctcatgaaggcggagaccgagaggtcagccctggacgttaagttgaagcatgccagaaatcaggtcgatgtggagatcaagcgcaggcaacgggcagaagccgactgtgagaagctggagagacagattcagctgattcgagagatgctctag

SEQ ID NO: 31649 - DNA, 885 bp, Artificial Sequence
  Description of Artificial Sequence: Synthetic coding sequence
atggataccatgatgctgaatgtgcgtaacctattcgaacagttagtgaggcgagtggagatacttagcgagggcaacgaggtccagttcattcagctcgcgaaggactttgaggacttcagaaaaaagtggcagcgcaccgatcacgaactgggtaaatataaagatctcctgatgaaggcagagactgaacgatccgctctcgatgtgaaactcaagcatgccaggaaccaggtggacgttgaaatcaagcggaggcagcgggctgaggccgactgcgagaaactggagcgccagatccagctcatccgggaaatgcttatgtgtgacactagtggatccatccagctgagcgaggagcaaaaatctgctctagcttttcttaacagaggtcagccttcgtctagcaacgccggaaacaagcgacttagtacaatcgacgagtcaggcagcatcctctcagacatcagcttcgacaagaccgacgagtcattagattgggatagctctctcgtgaaaacattcaagcttaaaaagagggaaaaacggagaagcacttcacgacagttcgttgatggaccacccggtccagtgaaaaaaacccggagcattggctccgcggtggaccagggcaacgaaagcatcgtggccaagaccaccgtgaccgtgcccaacgacggcggaccaattgaagccgtcagcacaatcgaaaccgtgccctattggacgaggagcagacgcaagaccgggacattgcagccctggaattcagacagcacattaaacagccgtcagctagagcccagaaccgagactgacagcgtcggcaccccacaaagcaatggcggaatgcgcctgcacgacttcgtgtcaaagacggtatag

SEQ ID NO: 31650 - DNA, 504 bp, Artificial Sequence
  Description of Artificial Sequence: Synthetic coding sequence
atggaggagacatacaccgacagcctagatcccgaaaagctgctccaatgcccatacgacaagaatcaccagatacgcgcatgtcgttttccttatcatctcattaaatgcagaaaaaaccatcctgacgtggccagcaagcttgctacatgtccattcaacgctcgtcatcaggtccctagagcagaaatttcacaccacatcagctcctgtgacgatcgcagctgtatagaacaggacgtagtcaatcagactcgatccctacgtcaggaaacgcttgccgagtctacttggcaatgtccgccatgcgacgaagactgggacaaggacctctgggagcagacgagcactccattcgtgtggggaacaacccactactcagataacaactctcccgctagcaatatagtgaccgaacacaagaataaccttgcaagtggcatgcgcgttcctaaaagcctcccttatgttctgccctggaagaacaacggcaatgcacagtag

SEQ ID NO: 31651 - DNA, 882 bp, Artificial Sequence
  Description of Artificial Sequence: Synthetic coding sequence
atgctacgcgagccccgaaaacagggtcttgctggacgggctcacttgctgtcgccaggcaccactggctctatgaaaactcccgtggagctggctgtgagcgggatgcagaccctcgggcttcagcaccgctgtaggggcggataccgagtcaaggctagaacgtcgtacgtcgatgaaactcttttcgggtcccccgcagggactaggcctactccaccagacttcgatcctccatgggtcgagaaagccaataggactaggggggtgggaaaggaggcctcaaaggccctcggcgctaagggcagctgcgagacaaccccatctcggggaagtacaccaactctgactcccagaaaaaaaaacaaatacagacctatttcacacaccccctcttattgcgatgagagtctgttcggttctcgaagcgaaggggcttcttttggagcacccaggatggctaaaggagacgccgctaagctccgggctctgctgtggacgccgccaccaacacctaggggcagtcactcccctaggcccagagaggcaccacttcgggcaattcaccccgctggcccttcaaaaactgagcccggaccagcagccgattcccagaaactatccatgggtggactgcactccagccgtccgctgaagcgaggcctctctcactccctgactcatttgaatgttcctagtaccggtcaccccgcaactagtgcccctcacacgaacgggccacaggatctgcgtccctccacttcaggtgtgacctttagatccccgctggtgacttccagggccagaagcgtttcgattagcgtgccttcgaccccccgacgcggaggtgccactcaaaagcccaaaccgccatggaagtag

SEQ ID NO: 31652 - DNA, 3282 bp, Artificial Sequence
  Description of Artificial Sequence: Synthetic coding sequence
atgggtggcaaagcttggccacggagagccgtgggaaccgcgggaggcccatgtgccgagcaaatcagcgcaccatttcagacactactgatgccacacttgcccctggcgtcattccggccaccgttctgggggctccggcactcaaggggcctacctcgcttccattcggtttccacccaatctgagcctcacggcagccccataagccgtagaaacagggaagctaagcagaaacgtctcagagaaaagcaggcaaccctcgaagccgagatcgcaggcgagagcaagtctcccgcagaaagtattaaggcctggcggcctaaagaactagtcctatacgagatccctaccaagcccggagagaaaaaggacgtatctggaccgctccctcctgcctattcccccagatacgtcgaggccgcatggtacccatggtgggtaagagaaggttttttcaagcccgaatatcaggcccgtctgcctcaggccacgggggagaccttttccatgtgcatccccccacctaatgtcactggttccctgcacattggccacgccctcacagtcgccatccaggacgcgctggttcgctggcaccgaatgcggggtgatcaggtcctgtgggtgccagggtccgaccatgctggcattgctacccaggctgtcgtggaaaagcagctgtggaaggagcgtggtgtccggagacacgagctgtcccgggaggcatttcttcgtgaggtgtggcagtggaaagaggctaaaggcggagaaatttgcgagcagctgcgcgctttgggcgcatctctggactgggaccgggaatgtttcaccatggatgtggggtctagcgtcgccgtcactgaagcgttcgtgcgcttgtacaaggccggactgttgtatagaaatcatcaacttgtcaactggagctgtgcactaaggagtgcaatcagtgatatcgaagtcgaaaatcgcccactcccaggccatactcaactacgcctgcctgggtgtcccacccccgtgagctttggtctgctgttctcggttgcgttccctgtggacggagaacccgatgccgaagttgtagtgggcactacaagaccagaaaccttgcctggggacgttgctgtggctgttcaccctgacgattccaggtacacccacctgcacggaaggcagctgagacacccactgatgggtcagcctctgcccctaataacagactacgcagtacagccccacgtagggacaggcgcagtcaaggtgactcctgctcattctcccgcagatgctgaaatgggggctcggcatggcttgagccctcttaatgtgatcgccgaggacggtacaatgactagcttgtgtggtgattggttgcagggccttcaccgtttcgtggctcgggaaaagattatgtctgtgctctctgaacgtgggctattccgaggattacaaaatcatcctatggtgctccctatctgctctcgttctggcgacgtaatcgagtatttgctgaagaatcagtggttcgtcaggtgtcaggaaatgggcgcaagagcagcaaaagcagtggagagcggcgctctagaactctcaccctctttccaccaaaaaaactggcaacactggtttagtcacatcggggattggtgcgtctcccgccaattgtggtgggggcaccagatcccagcttacctcgtggtggaggaccatgctcagggcgaagaagattgttgggtggtaggacgcagcgaagccgaggccagagaggtcgctgccgagttgaccggcagaccaggagcggagctgacactcgagcgcgaccccgacgtgctggatacctggttttctagcgcgctctttcctttttcggctcttgggtggccccaggagacccctgacttagcgcgattttaccccttaagcctgctggaaaccggctctgatctgctgctgttttgggtcgggaggatggtgatgctgggtacacagctgacaggacagctgcctttcagcaaggtcctcttgcatcccatggttagagatagacagggtcgcaaaatgtctaaatctctcgggaacgtcctagaccccagagatatcatctcaggagtggaaatgcaattactacaagaaaaactacgttctggcaacctcgaccccgcagagctcgccatcgtggccgctgctcaaaagaaagattttccacacggaatacccgagtgcggtaccgacgcactgcggttcacgctgtgttcccacggggtgcaggccggtgacctgcatctttctgtgagcgaggttcaaagctgtcggcacttttgtaacaagatctggaatgctctgagattcatcctgaatgcccttggggagaagttcgttccgcagcccgcagaggagctctccccatcatccccaatggacgcttggatcctatctcggctggctctggctgcccaagagtgcgagcgagggtttctgacccgtgaactatccctggttactcatgccctgcatcacttctggctgcacaacctctgcgatgtatatttggaagcagttaagcccgttctgtggcatagccctaggccactcggaccaccccaggtccttttcagctgcgccgatctgggcctccgtctattggccccactgatgccctttctggccgaagagctttggcagagactgcctcctcggccaggctgtccgcctgctccgtctatctccgtagcaccttacccctcagcttgctcattagaacattggcgtcaacccgagctggagcgccgattttcaagggtgcaggaggtggtgcaggtgctccgcgctttgagagcaacttaccagcttacaaaggcaagaccacgtgttttactgcagtcttctgaacctggcgatcagggtcttttcgaggcgttcctggagccacttggaaccttgggctattgtggcgcagtcggtttgttgccaccaggcactgcggctccgtcaggctgggctcaggccccactgtccgataccgcccaggtgtacatggaactgcagggcctcgtggatccccagattcaattgccactgctggcggctcgaaggtataaactgcagaagcaattggacagcctaacagctcggactccaagcgaaggcgaagcaggtacgcaaagacaacagaaactctcctcactccagctggagctaagcaagttggataaagcagccagtcatttgaggcagctgatggacgagccccctgccccaggctccccggagctttag

SEQ ID NO: 31653 - DNA, 276 bp, Artificial Sequence
  Description of Artificial Sequence: Synthetic coding sequence
atgggcaagaagaccaaaaggaccgctgattccagctcctcagaggacgaggaggagtatgtcgtggagaaggtcctagataggcgcgttgttaaggggcaagtcgagtatcttctgaagtggaagggattctccgaagaacataatacatgggagcctgagaagaacctggactgccccgagctcatctctgagttcatgaagaagtataaaaaaatgaaggagggagaaaataacaagcccagagagaagagtgaaagtaataaacggaaatag

SEQ ID NO: 31654 - DNA, 390 bp, Artificial Sequence
  Description of Artificial Sequence: Synthetic coding sequence
atggcagagttaattcagaagaagttacagggggaagttgagaaatatcagcaactccagaaggacctgtctaaaagtatgtccggaagacagaaattggaagcccagctcactgagaacaacatcgttaaggaagagttggctctactcgatgggagtaatgtcgtttttaaactgttgggaccagtccttgtcaagcaggagctgggagaagcacgggcaacagtaggtaagcgccttgactacatcacagctgagatcaagcgttacgagtctcagctgcgggatctggaaagacaatcggagcagcagcgcgaaaccttggcccagttgcagcaggaatttcagcgtgctcaggccgctaaagcaggcgcaccaggtaaggcttag

SEQ ID NO: 31655 - DNA, 1134 bp, Artificial Sequence
  Description of Artificial Sequence: Synthetic coding sequence
atggctaccatacctgattggaagttacagctccttgccaggcgcagacaagaagaggcctctgtgaggggcagggaaaaggcagaacgggagcggctgtcccaaatgccagcttggaagaggggattgttagagcgtcggcgtgcaaagttaggcctctctcccggtgagccaagtcctgtcttaggtaccgtggaagctggtcccccagacccagacgagtccgctgtgcttctggaagcaattggacctgtgcaccagaacaggtttattaggcaggagcgccaacagcaacagcagcagcaacagagaagtgaggaactgctagccgaaaggaaaccaggccctcttgaagctagagaaaggcgccctagccccggagaaatgagggatcaaagccctaagggccgagagagccgagaggagaggctgagcccacgagagactcgggagagacggctcgggatcggaggagcccaagaactcagcctccgcccacttgaggctcgggactggaggcagagccccggtgaagtgggcgacagaagcagcaggctttcagaggcatggaagtggcggctctctcctggcgagacccccgaaagaagcctgagactggccgagagtagggagcaatcccctaggagaaaagaggtggagagcagactgagtccaggcgagtccgcataccagaagttaggccttacagaggctcataagtggcgacctgacagcagagagagccaggaacagagcctagtgcagcttgaagcaactgagtggaggctcaggtcaggcgaagagagacaggattatagcgaggagtgtggtagaaaagaggaatggcctgtccctggtgtggcccctaaagagacggctgaactgtcagagaccctcacacgcgaggcccaaggaaactccagtgcgggagtcgaagcggcagaacagaggcctgtcgaggatggcgagcgaggcatgaaacccacagaaggttggaagtggaccttaattatgagccttgcgggaaagggtaatcaacacctggttacatgttttccacacccagtatctggaggcagggcaaactgtcccatctccaccctgatacagtctccatggtgtggctggggctag

SEQ ID NO: 31656 - DNA, 2031 bp, Artificial Sequence
  Description of Artificial Sequence: Synthetic coding sequence
atgtctgatcagattaaattcattatggacagtctgaataaagaaccgttcaggaagaattacaacctaataacgttcgactcacttgaacctatgcagctgttacaagttttgtccgatgtcctggcagagatagatccaaagcaattggtggacattcgggaggagatgcccgagcagaccgccaagagaatgctctcacttcttggcattttgaaatacaaaccctcaggtaacgcaacagacatgtcgacattcaggcaagggctcgtaattgggagtaaacctgtcatttatcccgttcttcattggctgcttcagcggactaatgagttaaagaaacgggcttatcttgcacggttcctgattaaactggaagtgccctccgaattcctccaggatgagacagtggccgacactaacaaacagtatgaggaactgatggaggcattcaagactctccataaggaatatgaacagctgaagatcagtggctttagtaccgcggagattcgcaaagacatttcagcgatggaggaggagaaggaccagctgatcaagcgcgtagagcatctgaagaaaagggtggagaccgcccagaaccatcagtggatgctgaagatagcgaggcagctgagggttgagaaagaaagggaggagtatctcgcacagcagaagcaggaacagaagaatcagctctttcatgccgttcagcggcttcagcgtgtacagaaccagctaaagtctatgagacaggctgccgctgacgcaaagcctgagtcactaatgaagcgccttgaagaggaaatcaagtttaatctgtacatggtgaccgaaaagttccccaaagagctcgagaataagaagaaggagctgcacttcctgcaaaaggttgtgtctgagcctgctatgggccattccgaccttcttgaactggagtctaaaattaatgagatcaatacagagatcaatcaactgatagaaaagaaaatgatgcgcaacgagcccatcgaaggtaaacttagtctctaccgacagcaggcctccatcatctcaaggaagaaagaggccaaagcagaggaattacaggaggccaaggagaaacttgcaagtcttgagcgggaggcctcggtaaagagaaaccagaccagagaattcgacggtaccgaagtattgaagggggacgaatttaagaggtacgtgaacaaattgagaagcaaaagcaccgtgtttaaaaagaagcaccagattattgcagaattgaaagccgagttcggactgcttcaaagaaccgaggaactccttaagcaacgtcacgaaaacattcagcagcagcttcagacaatggaagaaaaaaaaggcatctccgggtattcttatacccaggaagaactggagagagtgagcgccctaaaaagcgaagtcgatgaaatgaagggcagaaccctggatgacatgagcgaaatggtgaagaagctctattctctggtgtctgagaaaaaaagcgcccttgcatcagtcataaaagaacttcggcagctccgccagaagtaccaagagctcacacaggaatgcgacgagaagaagagccagtatgacagctgcgccgctggcttagagagtaatcgctctaagctcgagcaggaggtgaggcggctcagggaagaatgcctgcaggaagagtctcgatatcattacactaattgcatgattaaaaacctcgaggtccagctccggagggccaccgatgaaatgaaggcttacatttcaagcgaccagcaggagaagcgaaaggccattcgggagcagtataccaagaacactgccgaacaggaaaacctgggcaagaaactcagagagaagcaaaaggttattagagaatctcatggaccaaacatgaaacaggccaagatgtggagagatctggagcagctgatggagtgtaagaaacaatgtttcttgaagcagcagagccagacctccattggccaggttattcaggagggcggagaagacagactgatcctttag

SEQ ID NO: 31657 - DNA, 456 bp, Artificial Sequence
  Description of Artificial Sequence: Synthetic coding sequence
atggatactatgatgctgaatgttagaaacctgtttgagcagctagtgcggcgtgtcgagattctgagcgaaggtaacgaagtgcagtttattcagctcgccaaggatttcgaggattttagaaagaagtggcaaaggaccgaccacgagctgggaaaatataaagatctgttgatgaaggctgagacagaacgatcagctctggatgtaaagctcaaacacgcacgcaaccaagtggatgtggaaatcaagcgaagacagcgtgcagaggccgactgtgaaaagttagaacggcagatccagctgattagagaaatgttgatgtgtgataccagcgggagtatccaactttccgaagagcagaaatccgccttggcctttcttaatcgtggacagcctagctccagtaatgctggcaacaagcgcctgtctacaatcgacgagtccgggtcctag

SEQ ID NO: 31658 - DNA, 1446 bp, Artificial Sequence
  Description of Artificial Sequence: Synthetic coding sequence
atggcgtccgctgcttctgtgactagcctggctgacgaagtgaactgtcctatctgccaggggacccttagagagccagtgactatcgactgtggtcataatttctgtcgggcatgcttgaccaggtactgcgagattcccggacctgacctggaggaaagccccacctgccccttatgcaaggagcccttccgccctggatcattcagacctaattggcagttggcgaacgttgtggaaaacatagagcgactacagctggtttcgaccctaggcctaggggaagaagacgtttgtcaggagcacggagagaagatctacttcttttgcgaagacgatgaaatgcagctgtgtgtagtctgccgtgaagccggagagcatgccacgcacaccatgaggttcctcgaggatgccgcagccccttacagggagcagatacataagtgcctgaaatgcctaaggaaggaaagagaggagatacaggagatccagtcacgagagaacaagcggatgcaggtgctgctgacccaggtctcaacaaagcgacagcaggtaatcagtgagtttgcacacttaaggaagtttctggaggaacaacagtcaattcttctagcacagctagagtcgcaagacggggatatccttcgacaacgcgacgagtttgacctattggttgccggtgagatatgtcgattctcggccctcattgaggagctggaggagaaaaatgagcgaccagccagagagctcctaaccgacattaggtccaccctcatccggtgcgagacgaggaagtgtcgcaaacctgtagcagtatccccagaactcggtcaaaggatcagagatttcccacaacaagcactgcctctccagcgggagatgaagatgtttctcgagaacttaccgaatcatctcgtgataccgaccgcacacatcagcctggatcctcagaccagccaccctaagctgctgctgtctgaggaccatcagagggcccagttttcttataagtggcaaaacagtccagataaccctcagcgatttgacagggcaacctgcgttctggctcatacgggtattaccggcggtcgccatacatgggtcgtgagcattgatttagcacacgggggatcatgcaccgtgggcgtggtttctgaggatgtgcagagaaagggagagctgaggctcaggccggaggagggggtatgggccgtccggcttgcttggggtttcgtgtccgcccttggcagctttccgacacgcctgactctcaaggaacagcccaggcaggtgcgcgtgagtctggattacgaggtggggtgggtgacgttcacgaatgccgttacgcgggaacctatttatacattcacagctagcttcactcggaaggtgatccctttcttcgggctctgggggaggggcagctctttttcactgtcctcttag

SEQ ID NO: 31659 - DNA, 765 bp, Artificial Sequence
  Description of Artificial Sequence: Synthetic coding sequence
atggttcgagaggccaatatcaagcaggctacagccgagaaacaactgaaagaagcacagggcaagatcgatgtacttcaggcagaggtggctgccctcaagacgcttgtactctccagcagccccacgagtccgactcaggagccactgccaggcggtaagactccatttaagaagggccatacccgtaataagtctacctccagcgccatgtccgggtcccaccaggatttgtccgtgatccagccaatagtgaaggattgcaaggaagccgatctctctctctataatgagtttagactgtggaaggatgagcctactatggatcggacgtgtcctttcctcgacaagatctatcaggaagatatcttcccatgtctgactttctctaagtctgagctggcttcagcggtgctggaagcggtcgaaaataacacattgagtatagaacctgtaggcttgcagcctattaggtttgtcaaagcatctgcagttgagtgcggcggtcctaaaaagtgtgctctcacaggacagtctaagagctgtaaacatcgcatcaaactaggcgatagtagtaattattactacatatcacccttctgtcgatatcgtatcacctcagtctgcaatttttttacttacataagatatattcaacagggcctggtgaagcagcaagatgtggatcagatgttctgggaggttatgcaacttcggaaagagatgtctcttgccaaactgggttatttcaaggaagagctgtag

SEQ ID NO: 31660 - DNA, 1446 bp, Artificial Sequence
  Description of Artificial Sequence: Synthetic coding sequence
atggcgtctgccgcatccgtcacaagcctcgctgatgaggtcaattgccccatctgtcaaggaaccctaagagaacctgtgacgattgattgcggtcataacttctgcagagcttgcctcacccgatactgcgaaattcctggccctgacctggaagaatccccaacatgtcccctgtgcaaggaaccattccgcccagggagctttcgcccaaactggcaactggctaacgtagtcgagaacatagaacggctgcaacttgtctctaccctcgggctaggggaagaagatgtgtgtcaggaacatggggagaagatctacttcttctgcgaagatgatgagatgcagctatgtgtggtgtgcagggaggctggtgagcacgctacacatacaatgagatttctggaagacgccgctgcaccgtatcgcgagcagatacataaatgcctgaagtgcttacgaaaggaacgagaggaaatccaagaaattcagtcccgggagaacaaacggatgcaagtgttgttgacgcaggtgtctacgaagaggcaacaagttatttcagaatttgcacacctgcgtaaatttctggaagagcaacaatcgatcttgctcgcccaacttgaatcacaggacggcgacatcttgcgtcaacgggatgagttcgacctactggtggcaggcgagatatgccgattctcagccctgattgaggaactggaagaaaagaatgagcgccctgcacgggaactactcaccgacatccggtccaccctgattcgctgcgaaacccgaaagtgccggaagcctgtggccgtctcacccgaactggggcaaagaataagggattttccccaacaggcactgccccttcagcgtgaaatgaagatgtttttggagaatcttcccaatcacttggtaatccccaccgcacatatctctttggatccccaaacctcccaccctaagctgttgctctctgaggatcaccagcgagcacagttctcgtataagtggcagaattcaccggataacccacagcgctttgaccgcgcaacctgcgtcttggcccacactggaatcactgggggaaggcacacttgggttgtctccatcgatcttgcccacggcggaagttgtaccgttggcgtggtctccgaggatgtccaacggaagggtgagctgagattgcggcctgaggaaggggtttgggcagtgagattggcttggggctttgtgtccgctctgggcagctttccaacacggttaacactgaaggaacagccacgtcaggttcgggtctcattagattacgaggtaggctgggtgacatttaccaatgcagtgacacgcgagcccatttatacttttactgcctcgtttacacgtaaggtgatcccttttttcggcctgtggggtagggggtcctcattctcactcagctcctag

SEQ ID NO: 31661 - DNA, 1974 bp, Artificial Sequence
  Description of Artificial Sequence: Synthetic coding sequence
atgctgggcccaagctgggacggagatgaggctgagagcacaggggagattatcaggctgggcgacactgcacatacattcagcctgcgcagtaatggagcccagtgtcctaacgagatgctgtcgaaaaaagctctcgccagccccagctccaaatcccatgaggacatgctgtatcccccatctgttctgagtaagtcacgaacctcattcgtggaagataccgagactctgtccgtgtccgggattcccaacgctcgtaagctcggcgaaccaataagggcggcaatccctctgcaccccccttatcatccctccgagccccgagccccttgcccaataggcaaggagtacctccattcttctcactgtagccctgccgtcaacagcaccggggagcacacagagttcagcggtgatctggacgatgggctctttctaattagtaagttgcctaagggatctaaatgggaagtgtaccccgcacaggtgcaaggaccgagaacaagaaagcctccaaaggggaaacgcaatgaaaatcgggctacagcctcctcttgcaactcccctttccctcagcgaccccgtaaaaggctaacggagcaggaactgcacgacgtcagcgagaaactcagtcaaagactgagtgagctggactggatgctcaaatccgcactgggggatcgaatcaaggagaagacagatcataaagaggagaatacggggaacgaggaagtggaagatggcaccgaggaaactctgtctcagcattcagacggaatcgttgagtacggtcccaaaaaaagccggcctggtctctctatgcggagaaagcctccgtacagatcacactccctgagtccctctccagtgaataagcacaaacaatttcatcttgaacgaaagaggcagagaaaacctcgagagacggatgtcaggcaatttcaggctcaggcttttacggaggcctttgagagagagctgcggagacacaaggtccaggaaaatattgggcctctgcggattcatgagaaggaggaggagaccgagaagatctatcgcggtgaagccgtccggaaggggacccccgaatgttctcagccttggaagatctattctagaaagactacaactcaaagtctgagaggtggactgcccaagcctaacaaagctgtcccgatgaaggtcagtgagcacagtcttctccccttgatgttggagcagttcccctttctgtacgtttctggacctactctttccaagatgtggaaacaacagatcgcacaagtcgagcaacttaagaaggaggcttgtcgcgagaatcgaagcaaaaaaaagctgcaagatgagatcgaagaggccctgcgcaggcatgacttgcttactaccttggtaaaaaaagaatatgaacacaacaagaggcttcaggacttcaaggactgcataagacgacagcggcttacacaaagtaagattaaagagaataggcagcagatcgtgagggcgaggaaatattacgacgattatcgtgtgcagctttgtgctaagatgatgcgaatgcgaacaagagaagagatgattttcaagaagctgtttgaggaaggcctcaatatacagaagcagagactccgcgatctacgcaattacgctaaagagaaacgagatgagcaacgtagacggcaccaggatgaactagattccatggagaattactacaaggatcagtttagcctactggccgaggcaatttctcaggaacatcaggaattaaaggccagagagaagagccaggcccagacattgcacaaagtgaagagagagctgcgatccaagatggagaaagagattcagcagcttcaggatatgattacacagaacgatgatgatgtctttttccgtgagctggaagccgaaaggttcaggagccgcctccagttagcctcatttcaatatagcaaatcaccctccctgtag

SEQ ID NO: 31662 - DNA, 507 bp, Artificial Sequence
  Description of Artificial Sequence: Synthetic coding sequence
atgcagacatttctcaaaggaaagagagtcggctactggcttagtgagaagaagattaaaaaactcaactttcaggcattcgccgagctgtgtcggaaacgagggatggaggtcgtccaactaaacctttcaagacctatagaggagcaaggcccacttgacgttatcatccacaagctgacagatgtgatcttggaggcagaccaaaatgacagccagtccctggagctagtgcaccggtttcaggaatatatcgatgcccatccagagactattgtgttggacccactgcccgcaatccgtacactactagacaggtccaaatcgtatgagctcattcgaaaaatcgaggcctatatggaagatgaccggatatgttcaccccctttcatggaactcacctccctgtgtggcgatgatacaatgagacttttggagaaaaacgggctgacctttccctttatctgcaaaacccgggtggcccacggcacaaattcccatgagtag

SEQ ID NO: 31663 - DNA, 2211 bp, Artificial Sequence
  Description of Artificial Sequence: Synthetic coding sequence
atgttgattccggcactgcagattagtgactctgagagcgtgggcctagaggatggcatcgagcagtcagcctacctgaccgagtctaaaatgaatgagagtaagccaggagattcccaaaatctggcctgcgtgttctgtagaaaacatgatgattgccccaacaaatatggtgagaaaaagaccaaagagaaatggaatttaaccgtgcattattattgtttgctaatgtccagcggcatttggcagcgcggaaaggaagaagaaggagtctacggattcctgatcgaagatattcgcaaggaggtgaaccgggcttcaaagctcaaatgttgcgtgtgtaagaagaatggtgcatccatcggatgcgtggctccgagatgtaaacgctcatatcattttccctgcgggctccagcgggagtgcattttccagttcaccggcaactttgctagcttttgttgggaccacagaccagtccagatcattaccagtaacaattaccgagaaagcctcccatgcactatctgcctggaattcatcgaaccgatcccgtcatataacattctccggtcaccatgctgtaaaaatgcatggttccatcgagattgtctccaagtgcaagccatcaatgctggtgtcttctttttccgctgtaccatatgcaacaacagcgatatcttccagaaagaaatgcttagaatgggcatccacattccagaaaaagacgcctcctgggagttggaggagaacgcttatcaggagttactgcaacactacgagcggtgtgacgtgcgaagatgtcgatgcaaggaaggtagggactacaatgcccctgattccaaatgggaaatcaaaagatgtcagtgttgtgggagttctggtacacatctggcctgttcaagcctgcggtcttgggagcagaactgggaatgtcttgagtgtaggggcattatatacaattccggcgaatttcagaaagctaagaaacacgtcttgcctaattctaataatgtgggaattactgattgccttctggaggagtcctcccctaagcttcctcgtcagtccccgggatctcagtccaaggacctgctgcggcagggcagtaagtttcgcaggaacgtgtctactctcctgatagagctcggttttcagattaaaaagaagaccaagcggctctatattaacaaggcgaatatttggaatagcgccctggacgcctttcggaaccgcaacttcaatccgtcttacgccatcgaggttgcctacgtaatcgagaacgacaacttcggaagtgagcacccaggcagcaagcaggaatttctgagcctgctgatgcaacatctcgaaaacagttccctgttcgagggaagcttatccaagaacttgtctttgaatagtcaagcccttaaagagaacttgtactacgaggcgggtaaaatgttggccatttcacttgtgcatggcggtccaagccccggttttttttccaagaccctcttcaactgcttggtgtatggtccggagaatactcagcctattctggatgacgtatcagattttgatgttgcccagatcattatccgcataaatacagccaccacagttgcggacttaaagtccattattaacgaatgctacaattaccttgagcttatcggctgcttacgactgataacaactctctctgataagtatatgctagtcaaggacatccttgggtatcatgtgatccagcgcgtgcacacgccttttgagagttttaaacaggggttaaaaaccttaggtgtgcttgagaagattcaggcgtaccctgaggccttttgcagtatactctgtcacaaacctgaaagtctatccgccaagatcctatcggagctattcaccgtgcatacgctgcccgacgtcaaagccctcggcttctggaactcatatctccaggcggtggaggacggaaagtctacgacaaccatggaggacatcctgatctttgcgaccggatgctcctccatcccccctgccggattcaagcctacgccaagcatcgaatgccttcacgtcgacttcccagtcggtaataaatgtaacaattgcctggctatcccaataacgaacacatacaaagaattccaggaaaacatggactttacaataaggaacacactgcgcctggaaaaagaggaatccagccattatatcggtcactag

SEQ ID NO: 31664 - DNA, 1131 bp, Artificial Sequence
  Description of Artificial Sequence: Synthetic coding sequence
atggccaactctgccaataccaacaccgttcctaaactatatcgatctgtgattgaagatgtgattaatgacgtgagggacatcttcctggatgatggggtggacgagcaggtgctaatggagctgaagaccctttgggagaacaagctgatgcagagcagggcagtcgatgggtttcattccgaggagcagcaactgctgttgcaagtgcaacagcagcaccagcctcaacagcagcagcaccaccaccaccaccatcaccagcaggctcagccacagcaaactgtacctcagcaagcacagacacagcaggtgttaatccccgcatctcagcaggcaactgctcctcaagtgatcgtgccagactcaaagttgatccagcacatgaacgcctctaacatgagcgccgctgcaacagccgcaaccttagccctgccagccggtgtgacaccggtgcaacaaattctgaccaactctggccagctcctgcaggtggttcgagctgcaaacggtgctcagtatatattccagccccagcaatccgtagtcctacagcagcaggtgattcctcagatgcaaccaggtggagtccaagcaccagtgatacaacaagtgctggctccactcccagggggtataagcccacagacgggggtgattatccagccccagcagattttatttaccggaaataagacacaggtaataccgacaacagtggcagccccaacgccggctcaagcccagatcactgccactggccagcagcagccccaggctcagcccgctcagacacaggcccctcttgttttgcaggtggacgggaccggggacacatcatctgaggaagacgaggacgaagaagaggactatgatgatgatgaagaagaagacaaggagaaggacggcgcagaggacggtcaggtcgaggaggagcctctgaacagcgaagacgatgtctccgacgaagagggccaagagctgtttgataccgaaaatgtggtggtctgtcagtacgacaaaatccatcggtcaaagaataaatggaaattccacctaaaagacggaataatgaatctcaacggacgagactacatcttctctaaagcaattggagatgctgaatggtag

SEQ ID NO: 31665 - DNA, 237 bp, Artificial Sequence
  Description of Artificial Sequence: Synthetic coding sequence
atggaaacagattgcaatccaatggaactttctagcatgtccggctttgaggaagggagtgagctcaatggttttgaaggcactgacatgaaggatatgcggctagaggctgaggctgtggttaatgacgtgcttttcgcggttaataacatgtttgtcagcaaaagtctgaggtgcgccgacgacgtagcctatataaatgttgaaaccaaagaacgtaaccgctattgtttgtag

SEQ ID NO: 31666 - DNA, 747 bp, Artificial Sequence
  Description of Artificial Sequence: Synthetic coding sequence
atggccttttccggccgagctagaccctgtattatccccgaaaatgaggaaatacccagggctgctctcaataccgtgcatgaagccaacggtaccgaggacgaacgagccgtgtcaaaactgcagcgaaggcattccgatgtgaaggtctataaagaattttgcgatttctacgcgaaattcaatatggcaaatgccctcgccagtgctacctgcgaacggtgcaaagggggatttgcccctgccgaaactattgtgaatagtaatggggagctctaccacgagcaatgcttcgtttgcgcccaatgctttcaacagtttcctgagggcctgttctacgaatttgagggtcgtaaatactgtgagcacgacttccaaatgctattcgcaccctgttgccaccagtgcggggagttcataatcggtcgagtgattaaggccatgaacaactcttggcaccccgaatgtttcaggtgcgacctgtgccaggaggtacttgctgacattggcttcgtcaaaaacgctggacggcatctatgtcggccttgtcataatagggaaaaagccagggggctgggcaaatacatttgccagaagtgccacgcaattattgacgagcagcccctgatcttcaagaatgacccctaccatcccgaccactttaattgcgccaactgtggccaggagggaagtgactgccggtgtactggcgctgagaggggagccattctgcctgctatgccttag

SEQ ID NO: 31667 - DNA, 2370 bp, Artificial Sequence
  Description of Artificial Sequence: Synthetic coding sequence
atgagtgcccagacctcacctgcggaaaaagggctgaatccaggcttgatgtgccaggaatcttacgcctgctctggtaccgatgaggctatctttgagtgcgacgaatgctgctccctgcagtgtctgcgctgcgaagaggaactgcataggcaggagaggctgaggaaccatgagagaattaggctgaaacctggacacgttccgtactgcgacctgtgcaagggcctttctggacatctgcccggtgtgcggcaaagagcaattgtcagatgtcagacatgtaagattaatttgtgtctggagtgtcaaaagagaacccattcaggcggaaacaagcgccgacaccctgttaccgtgtataatgtatctaatttgcaggaatccctcgaagccgaagaaatggatgaggaaacgaagagaaagaagatgacggagaaagtcgtgtctttcctgttggtcgatgaaaatgaagagatccaggtcaccaatgaggaagatttcattaggaaactcgattgcaaaccagaccagcatttaaaggtcgtgagtatatttggaaacactggagacgggaagagccacaccctgaaccacacattcttttacggcagggaggtgtttaagacatcacccacacaagaatcctgcaccgttggcgtgtgggccgcttatgatcccgtgcataaggtggccgtaatagacaccgaaggactccttggggctactgtgaacctgtcacagaggacccgactactgttaaaagtgctggcaataagcgacctggtaatctaccgaacccatgctgaccgtcttcacaatgacttgtttaaattcctgggcgatgcgagcgaggcgtatctgaagcattttacgaaggaactcaaggcgaccaccgcacgttgcgggctggatgtgcccctcagtacattaggcccagccgtcattattttccacgaaactgtgcacacgcagctgctcgggagcgatcacccatctgaagtgcccgagaaactgatccaggaccgcttccgcaaattagggaggttccccgaagcattttcctctatccactacaaaggaactagaacatacaacccacctacagacttctctgggttgcgcagggcgcttgaacagttgctggagaacaatacgacgcggtcacccagacacccgggtgtgatcttcaaagcgttgaaggctctgtcagaccgtttttctggcgaaatccccgatgatcaaatggcgcattcttcgttttttcccgatgagtacttcacatgctccagtttatgcctgtcttgcggcgtcgggtgtaagaagtctatgaatcatggaaaggaaggagtccctcacgaagccaaatccaggtgtcgctactcgcaccagtatgataatagagtctacacctgcaaggcgtgttacgagcggggagaggaagtgtccgtcgtgcctaagacttctgcaagcaccgactctccttggatgggattggctaagtacgcatggagcggttatgttatcgagtgtcccaattgcggcgtcgtgtatagatccaggcagtattggtttggtaatcaggatccggtggacactgtggtaaggacggaaatagttcatgtgtggccgggtaccgatggattcctgaaagataataataatgccgctcagcgattgctggatggcatgaacttcatggctcagtccgtaagcgaactgagcctaggccctacaaaggccgtcacctcctggcttacagaccaaattgcgcctgcatactggcggcctaacagccaaatcctaagttgcaacaagtgcgctacctcattcaaggataacgacacaaagcatcattgcagagcttgtggtgaggggttttgtgatagttgctcctctaaaactcggcctgttccagagcgcggatggggccctgccccagtgcgggtctgtgacaactgctacgaagcacgcaacgtacagctggctgtgacagaggcccaggtggatgatgaaggcggaaccctgatcgccagaaaggtgggtgaagctgttcagaatactttgggcgctgttgtcactgcaatcgacatccccctgggactcgttaaggatgctgctcggccagcctactgggtgcctgatcacgagatcctgcattgccacaattgcaggaaagagttttcaataaagctgtcaaaacatcactgccgggcatgcggacagggcttctgcgatgagtgcagccatgaccggcgtgcggtaccctcacgtggatgggaccaccctgtgcgagtgtgttttaattgcaataagaagcctgcatggacatccttgagcgtgatgactggcaaaggccctctctgctag

SEQ ID NO: 31668 - DNA, 2271 bp, Artificial Sequence
  Description of Artificial Sequence: Synthetic coding sequence
ctggcgggtaatgaaaccgagtgggtgacaattgctaacaatctgctgttcaaatgtcacatccacctcagaatccatgagctacaagactgtgatgccaatgtgtttatcgctctgtaccagtccatactgggcgaaaaggtgcctgatctgatcgttatacctcggtcacaggaggacgacgcacataacgtgcaggccgtgatcgattctctcgccttggattacttacaggtgagcctcagtcacatcactgccctgtacagtgtgtctcgtcgtaagtatagtgagaggagaatgttgggacccagttgggatggtgacgaagcagaaagtacaggagagataatacgccttggggataccgctcacaccttctctctccggagtaacggagcacagtgtcccaatgagatgttaagtaaaaaggccttggcatcaccatcaagcaaaagtcatgaagacatgctctacccaccttccgtgctgagcaaaagcagaacctccttcgtggaggacaccgaaacactttcagtgtctggcatcccgaatgcaaggaaactgggggaaccaatcagagccgctatcccccttcatccaccataccatccatctgaaccacgcgcaccatgcccaattggaaaggaatacttgcatagctctcattgttcccctgcagtaaacagcactggagaacacactgagttttcaggtgatctggatgatggactgttcctgatctccaagttacccaaaggctctaaatgggaggtgtatcctgcccaagtccagggcccaaggacacgaaagccacctaagggaaagagaaacgaaaacagagccaccgcatccagctgcaactccccttttcctcagcgcccaaggaaaagactcacagagcaggagctgcatgatgtctccgagaaacttagtcagcgcctctcagagctcgactggatgttgaaatctgcactgggagatcgcataaaggaaaaaaccgaccacaaggaggaaaatacaggcaatgaggaggttgaagatgggacagaagagaccttaagccagcattccgatggcattgtggagtatggaccaaaaaagtctcgcccaggactatcgatgagacgcaagcccccttatcgcagtcacagcttatctcccagcccggtgaacaaacataaacaattccacctagagagaaaacgccagaggaaaccgagggagacagatgttcggcagtttcaagctcaggctttcacggaggcattcgagcgggagcttagacgtcataaagttcaggagaacatcggtcctcttcgcattcatgaaaaagaagaggagacagttggcaagaacattcagaggagaagtttcgtgaaggagctccaaaacgtggtgagtccgggtcgatttacactagagaagccccagcgtcgggtgaggggtggcttgccaaagccaaataaggctgtgcccatgaaggtttccgaacactctctattacctcttatgcttgaacaatttccattcctgtatgtgtctggcccaactctgagtaaaatgtggaagcaacagatagcgcaggtcgaacagcttaagaaagaagcgtgtagggagaacagaagtaagaagaaactgcaggatgagatcgaagaggcccttaggcgacacgatctgttaaccactcttgttaagaaggaatatgagcataataagagactccaggactttaaggattgcattcgacggcagcggctgacacagagcaaaatcaaagagaaccggcagcaaatcgtgcgggctcgaaagtactacgatgactaccgagtacagctatgcgccaagatgatgaggatgcgaactagagaggagatgattttcaaaaaattgtttgaagaaggccttaacattcaaaagcagcgcctcagggacctgaggaactatgccaaagaaaagcgggatgaacagagacggagacatcaggatgaactggatagtatggagaactactacaaagatcagttcagcctgctggcagaagcaataagtcaggagcaccaagagctgaaagccagagagaaatcacaggcacagactttgcataaggtgaaaagagaactccgcagcaaaatggaaaaggagattcaacagctgcaggatatgatcacccagaacgatgacgacgtgttcttccgggaacttgaggccgagcggtttcgctcccggcttcagctcgcatcattccagtactcaaaatcgcctagtctgtag

SEQ ID NO: 31669 - DNA, 420 bp, Artificial Sequence
  Description of Artificial Sequence: Synthetic coding sequence
atggagaccgattgcaacccaatggagctttcaagcatgtcaggtttcgaagagggttctgagctcaatggttttgaaggcactgacatgaaagacatgagactcgaggccgaagctgtcgtgaatgacgtactctttgccgtcaacaatatgttcgtttccaagtcactccgatgtgctgatgacgttgcctacattaatgttgagaccaaggaaagaaacagatattgtctggagctcacagaggctgggctcaaggtcgtgggctacgctttcgaccaggtggatgatcatttacagactccctaccacgaaacggtgtattctctcctcgatacgctttcacctgcataccgggaggcttttggcaacgccctattgcagagattggaagctttgaagcgcgatggtcaaagttag

SEQ ID NO: 31670 - DNA, 300 bp, Artificial Sequence
  Description of Artificial Sequence: Synthetic coding sequence
atgaccgatacacgcaggagggtcaaggtgtatacccttaatgaagacagacagtgggacgaccggggtactggccatgtttcctctggatacgttgaacggctgaaaggaatgagcctcctagtgagagccgagtctgatggttctctgctgttggagtctaaaatcaaccctaatacggcctatcagaagcagcaggatacactgattgtctggtccgaagcagagaattatgatcttgcgctgagtttccaggagaaagccggttgtgacgagatctgggagaaaatctgccagtag

SEQ ID NO: 31671 - DNA, 2463 bp, Artificial Sequence
  Description of Artificial Sequence: Synthetic coding sequence
atgactgatactaggagaagagtgaaagtgtataccctcaacgaagaccgacagtgggatgaccgcggaacaggtcacgtgtcctccggctacgtggagcggctgaaaggaatgtcactacttgtaagagcggagagtgatggctctttactgctggagtccaagatcaatcccaacaccgcctaccagaagcaacaggatacattaatcgtttggagcgaggcagagaattacgatcttgccctcagttttcaggagaaagctgggtgtgacgagatctgggagaagatctgccaagtgcagggaaaggacccaagcgtggacatcacgcaagatcttgtggatgaaagcgaggaggagcgatttgatgacatgtctagccctggcttagaattacccagctgcgagctgtccagactggaagagatcgctgaactcgtagccagttctttgcctagtcctctgaggcgcgaaaaactggctctggctctggagaacgagggctacatcaaaaagttgctggaactgttccacgtgtgtgaggacctagaaaacatcgaaggtctgcatcacctgtatgaaattataaagggaatcttcttactgaaccgaactgccctgtttgaggtgatgttttccgaggaatgtatcatggacgtgatcgggtgtttagaatacgatcctgctctttcacagccacgtaagcaccgtgaatttttgaccaagaccgccaagttcaaagaggtgatccccatctctgatccagaactgaagcagaagatacaccaaacataccgagtgcagtatatacaggatatggtgctacctacaccctccgtctttgaggagaacatgttgagtacattacactccttcattttttttaacaaagtcgagatagtggggatgctgcaagaggatgagaagttcttgacagatctattcgcccagttaacggatgaggccacagatgaggaaaaacgacaggaactggtcaacttcctgaaagagttttgcgcattctcccagaccctgcaaccacagaatagggacgccttcttcaagactctctccaacatgggcatcctgccagcactggaggttatcctggggatggatgacacccaggtcagaagtgccgctactgatattttttcctacctcgtcgagtacaacccctctatggtgagagaatttgtcatgcaggaagcccagcaaaacgatgacgatatactgctgattaacttgataatagagcatatgatctgcgatactgaccccgagttgggaggtgccgtccagctgatgggccttcttaggactcttgtcgatccagaaaatatgcttgcgaccgccaacaaaacagagaagaccgagttcttagggtttttctacaaacattgtatgcacgttctcactgcccctcttctggctaacacgacagaggataagcccagcaaagatgactttcagacggctcagttactggcactggtgctggagcttttaacattttgcgttgagcaccatacatatcacatcaagaattatataatcaacaaagacatcctccgcagggtcctcgtactgatggcttccaaacatgcgttccttgccctctgtgcgctgcgctttaagcgcaagatcataggcctgaaggatgagttttataaccggtacataatgaaaagttttctgtttgagccagttgttaaagccttcttgaataatgggtcccggtacaatctgatgaattctgcaatcattgaaatgtttgagtttatacgtgtggaagacatcaagagcctgaccgcacacgtaatagaaaattactggaaggctcttgaggatgtcgattacgtacagacttttaaggggctgaaactgagatttgagcagcagagagaaagacaggacaacccaaaactggactctatgcgaagcatcctgcggaatcatagatacaggagggacgccaggaccttggaagacgaggaagagatgtggttcaacacagacgaggacgacatggaggatggagaggcggtcgtgagtccatcggacaaaaccaaaaacgacgatgatataatggaccctatctccaaattcatggagcgcaagaaacttaaggagagtgaggagaaagaggtgcttcttaaaaccaatctttctgggcgacaaagcccatccttcaagctgagcctgtcctccggtaccaaaacaaacctgacctctcagagctccacgacaaacctccctggtagccctggaagtcctgggtctccaggcagccccggatccccgggttccgtgcctaagaacacctcccagactgctgcaatcacgacaaaggggggtctcgttgggttggtcgactatcccgatgacgatgaggatgacgatgaggatgaagacaaggaggacacgctgcctctgagcaaaaaggccaaatttgactcgtag

SEQ ID NO: 31672 - DNA, 396 bp, Artificial Sequence
  Description of Artificial Sequence: Synthetic coding sequence
atgaacgaatctaagcccggagattcccaaaatctggcctgcgtcttctgtcgcaagcacgacgattgtcctaacaagtatggagaaaagaaaaccaaggagaagtggaatttgacagttcactattactgcctgctgatgtcctcaggcatttggcagcgtggtaaggaagaggaaggagtgtacgggtttttaattgaggacattagaaaggaggtgaaccgcgcatcaaaactgaagtgctgcgtgtgtaagaagaatggtgcctccatcggatgcgtggccccacggtgcaaacgtagctatcatttcccttgtggtcttcagcgcgagtgtatcttccagtttactggaaatttcgcttccttttgctgggatcaccgaccagtccaatag

SEQ ID NO: 31673 - DNA, 5933 bp, Artificial Sequence
  Description of Artificial Sequence: Synthetic coding sequence
atggcggcaagaagtgcacctagttgccacttaagactagaatgggtgtacggctaccgtggccaccagtgccgaaataatctatattacacagccgcaaaggagattgtctacttcgtggctggagtgggcgttgtgtattcccccagggagcatagacagaagttctaccgtggccactccgatgacatcatcagccttgccctccacccagaaagggtgctcgttgccactggccaggtgggaaaggagccctacatctgtatctgggattcttacaccgttcaaacaatctccgtgctgaaggatgtgcacacgcacggaatagcatgtttggccttcgacctggatgggcagaggctggtgtcagtagggctggattcaaaaaatgccgtgtgcgtttgggattggaaaagagggaaaatgctcagtatggccccaggtcacacggacagaatttttgacatatcttgggatctgtatcagcctaacaagttggtctcatgtggtgtgaagcacataaagttctggtcactgtgcggcaacgcactcacccccaagagaggcgtctttggtaagaccggcgatttacaaacgatactttgcttggcatgcgccagggatgagcttacttattccggggctctcaatggcgacatctatgtgtggaagggcatcaacctgatccggaccatccaaggggctcacgcggctgggatcttcagtatgaatgcatgcgaggaaggatttgctacaggagggcgagacggctgcataagattgtgggacctcacttttaagccaataactgtaatcgacctgcgggagacagatcagggatacaaggggctgtctgtccgcagcgtgtgttggagaggtgatcacatccttgtggggacgcaggacagcgaaatatttgagattgtcgtacaggaacgcaacaagcctttcctgataatgcaggggcactgtgagggtgaattatgggccttagcagttcaccctacaaaacctctggctgttaccggttcagatgataggtccgttcgcatttggagcctcgtggaccatgcgctaatcgcacgatgcaacatggaagagcccataagatgtgcagccgtgaatgccgatgggattcacttagccttgggcatgaaagacggttccttcacagtgctcagagttagggatatgacagaggtcgtgcatataaaagacagaaaagaggctatccatgaactcaaatactcccccgacgggacctatctggccgtgggatgcaacgactcctcagtggatatctacggagtggcgcagaggtacaaaaaggtgggcgaatgcctgggatccctgtcttttattacgcacttggactggtcctcggactcacggtacttacaaaccaacgacggaaatggtaagcgcttgttttatcggatgccgggtggaaaggaggtgactagtaccgaggaaatcaaaggcgtacattgggcatcctggacctgcgtcagcgggctggaggtgaatgggatctggccgaaatactcggatattaacgacattaacagcgtagatggcaactatatcggacaagtgcttgtgaccgcagacgattatgggattataaagttgtttcgctacccttgtctccggaaaggagctaaattccggaagtatattggacactcagcccatgtcactaacgttagatggagccacgactatcagtgggttatctctatcgggggagccgatcattcagtattccaatggaagttcattcccgagcgcaagctgaaggacgccgtgcatatcgcccctcaggaatctctggctgacagccattcagacgagtcagactccgatctgagcgatgttcctgaattagactccgagatcgagcaggagactcagctgacatacagacggcaagtatacaaagaagatctgccccagttgaaggaacagtgtaaggaaaagcagaagtccgcgaccagcaaacggagagaacgagcccctggaaattctattcgcctgcattttgtccacggctatcggggttatgactgcagatccaacttgttctacacccagataggcgagatcgtctatcacgttgctgctgtgggcgtaatctataacagacagcagaatacacagagattctatttaggtcatgacgacgacattctctgtttgacaatccacccattaaaggattatgtcgctactggacaggtaggacgcgacccatccattcacatatgggatacagagaccatcaagccactgagcatcctgaagggtcaccaccaatacggagtgtcagccgttgactttagcgcagacggaaagcggcttgcctccgtggggatcgatgatagtcatacggtagtgctttgggattggaaaaagggcgagaaactgtcaatcgctcgcggtagcaaagacaaaatctttgtcgttaagatgaatccatacgtgccagataaactcatcacagcagggataaagcacatgaaattctggaggaaagcaggaggcggactaattgggagaaagggatatatcggcacactggggaaaaacgatacaatgatgtgcgctgtgtatgggtggaccgaagaaatggctttcagcggcacatccacaggggacgtctgtatctggcgagatatatttctggtgaagacagtcaaggcacatgacggacctgttttctcaatgcacgccctggaaaaaggctttgttactgggggaaaagacggaatcgtggcgttgtgggacgacagtttcgagcggtgcctcaagacctacgccatcaagcgtgcggcattggctcccggaagtaagggattactgctcgaagataatccctctatccgggctataagcctgggccacgggcatattctggtgggtactaagaatggggagatcttggaggtcgacaaatccggcccaataactctactggtccagggacacatggaaggcgaggtgtggggtctagcaacacatccttatctacctatttgcgctactgtgtcagacgacaaaacgctgcggatctgggatctcagtcctagtcattgcatgctggccgtgcggaaactcaagaaagggggacgatgctgttgtttcagccccgatggaaaggctcttgcagtcggactgaatgatgggtcattcttgatggctaatgctgacaccctcgaggacctggtttcttttcaccaccgcaaggacatgatttccgacattcgcttctcgccaggcagtgggaagtatcttgccgttgccagtcatgactctttcattgacatctataatgttatgtcaagcaaacgggtgggtatttgtaagggcgcaacctcttatatcacccatatcgactgggatatccgcggtaagttgctgcaggtgaacactggcgcaaaggaacaactctttttcgaagctcctagaggcaagaaacaaacaattccatctgtcgaagtggagaagattgcctgggcgtcatggacgtctgtgctgggcctgtgttgcgagggcatctggcccgtgatcggcgaagtaaccgacgtgactgctagctgcctgacatctgataagatggtgctggcaaccggggacgatctaggctttgtaaagctgtttaggtaccccaccaaaggcaagtttgggaagttcaaacgctacgtggctcactctacacacgtgacaaacgtaaggtggacttacgatgattcgatgctggtaacgctggggggaacagatatgtccctgatggtatggactaacgaaatggaaggctacagagagaagagaccgtgtgattccgaagagtccgacattgacagtgaggaagatggaggttacgattccgatgttactcgggagaatgagatttcatatactatccgggctttgagcaccaacattcggcctatgctgggcataaagcctcatttacaacagaaggaaccaagcattgatgaacggcaaggtgtcgtgaggggaagcaggcccccagtttcccgggctccccctcagcctgagaagctgcagaccaacaatgtgggaaaaaaaaaacggccaatagaagatcttgtgctggaactcattttcggctatagggggcgagactgccgcaacaatgtgcactacctgaacgatggcgacgacattatctatcatactgccagcgtgggaatcctccacaacgttgccacaggtagtcaaagtttctaccaggaacataatgacgacatcctgtgcctgaccgtgaatcagcaccccaaatttattaacatcgtggcgactggccaagttggtgactcagctgacatgagtgccacagccccaagcattcacatttgggatgccatgaataaacagacccttagcattctacggtgttatcattccaaaggcgtgtgcagcgtttctttctcagccacgggtaaactgttgctctccgtgggcctcgatcctgaacacactattacaatctggcgctggcaggagggagcgaagatcgctagcagagctggtcacaaccagcgcatcttcgtggctgagttcaggcccgactccgatactcaatttgtttcggtgggcgtcaaacatgtgaagttttggaccttggccggaagagccctcctaagtaagaagggcttactctccaccctagaggacgccagaatgcaaacgatgctggccatcgctttcggagccaataacttaacattcactggcactatctctggggatgtgtgtgtgtggaaagaccatattctgtgtaggatcgtggcgagagcacataacgggcctgtgttcgccatgtacactaccctcagagatggtttaatcgtaaccggcggaaaggaaaggccaagcaaggagggaggggctgtgaagctgtgggaccaagaactacgcaggtgtcgcgctttccgtttggaaacagggcaagcgaccgactgcgtacgctcagtatgtaggggcaagggtaaaatcttggtgggtacccggaatgccgaaatcatcgaagtgggtgagaaaaatgccgcatgtaatatcctggtcaatggccacgtagacgggccaatctgggggctagcgactcatccctctagggatttttttctgagcgctgcagaggatggcactgtccgcctctgggatattgcagataaaaaaatgttgaataaggtcaatctggggcacgccgctcggacagtctgctactcgcccgagggcgatatggttgccatcggcatgaagaatggtgagtttataattctgttggtgtcatccttgaagatctggggcaagaagagggataggagatgcgcgattcacgacattcgtttttcccctgacagtcgctaccttgccgtgggttcttctgagaattcagtcgatttctatgacctgactctaggtcccacactaaacagaattagttattgcaaggatataccttcgttcgtgatccaaatggacttcagcgccgattcgtcttacctgcaagtatccagcgggtgctacaaacggcacgtatacgaagtaccatctgggaaacatctgatggatcacgcagccatcgatagaatcacctgggcaacctggactagtattctcggcgatgaggtgctgggcatctggtctaggcatgcagaaaaggccgacgtcaactgcgcctgtgtgagccactctgggatttcccttgtcactggcgatgacttcggcatggttaaactgtttgacttcccctgccctgagaagttcgccaagcacaagcgcttcctggggcattctcctcatgtaacgaacatcaggtttacgagcggcgataggcacgttgtctcagccggaggtgatgactgcagcctctttgtgtggaagtgcgtccatacccctcatta

SEQ ID NO: 31674 - DNA, 2502 bp, Artificial Sequence
  Description of Artificial Sequence: Synthetic coding sequence
atgacagacactcgcaggagagtgaaggtctacactctgaatgaagacagacagtgggacgatcgcggaaccgggcacgtgagcagcggctatgtcgagagactaaaggggatgtccctcctggttcgggcagagtcagacggctccctactcctggagagtaaaattaaccccaatactgcctaccagaaacaacaagatacactaattgtgtggtctgaggcggagaattacgatctggccctgtcattccaagaaaaggccggttgcgacgaaatctgggaaaaaatttgccaggtccaaggcaaggacccatctgtggatattacacaggacttagtggatgagtccgaggaagagcgatttgatgacatgtcctctccagggctggagttgccgagctgcgaattatctcggctggaagaaatagccgagctggtggcttccagcctgccaagtccccttagacgagagaagctggcactggctttggaaaacgaggggtacatcaagaagttgctggagctttttcacgtgtgcgaggatcttgaaaatattgagggcctgcatcatctctacgaaattattaaaggcatcttcctgctgaatcggactgccctgttcgaggtgatgttttccgaggaatgcatcatggacgtcatcggatgcttagaatatgatccggctttatcacagcctcggaaacatagggaatttctgaccaagactgcgaaatttaaggaggtgattcctatttctgaccctgagcttaagcagaaaatccaccaaacctacagagttcagtacatccaggatatggtgctacccacaccgagtgtattcgaggaaaacatgctgtcgacgctgcattcatttatcttcttcaacaaagttgaaattgtgggcatgctccaagaggatgagaagttcctgaccgacctctttgcccagctgactgatgaagccactgatgaagagaaacggcaagagctcgtaaactttctgaaggaattttgtgcattttcccaaacactgcagccacagaacagggacgcatttttcaaaacactcagcaatatgggcatcctgcctgctcttgaggttatcctgggcatggacgacacacaggtccgcagtgcagccacggacattttctcttacctcgtcgaatataaccctagtatggttagggaattcgttatgcaggaggctcaacaaaacgacgacgtgtcaaagaaactcaccgaacagaagattacgtccaaagacatccttctgattaacctcatcatcgagcatatgatatgcgacacggatccagagctgggcggagcggttcagcttatgggcctgctccgcacgctggtggatccagaaaatatgttggcaaccgcaaataagacagaaaagacagaattcctgggctttttttacaaacattgcatgcacgtactcacagccccattgctcgcaaataccaccgaggataaaccctccaaagatgattttcagacggcgcaactgctagctctggtactcgaacttctgactttctgcgtcgagcatcacacctatcacatcaagaactatatcatcaacaaagatattctgcgcagagttcttgtgctgatggcttctaaacatgctttcctggcactatgtgcgctgaggttcaaacggaagattatcggtcttaaagacgagttctacaacaggtatatcatgaagtccttcctgttcgagcctgtggtgaaggcatttctgaacaatggcagcaggtacaatctgatgaattctgccatcattgaaatgttcgagtttatacgcgtcgaggatattaaaagcctgacagctcacgtgatagagaactattggaaagccctcgaggatgtggattacgttcagacgttcaaaggactcaagctacgcttcgagcagcagagggagaggcaggataatcctaaactcgacagcatgagatcaatcctcagaaatcacagatataggagggacgcgaggacacttgaggacgaagaggagatgtggtttaatacagatgaggacgatatggaggatggggaagccgttgtgtcaccatccgataagactaagaatgacgatgatatcatggatccgatcagtaagtttatggagcgaaagaaattgaaggaaagcgaagaaaaggaggtgctgctgaagactaacctctccggacgacaatccccaagctttaagctgtctctaagttccgggaccaagacaaatctcactagccagtcttcaacaacgaatctccccggaagccctggcagccccggttcaccaggcagtccagggtctcccggaagcgtcccgaaaaacacaagccaaaccgccgctatcactactaagggcggattggtgggcttggtcgattaccccgatgacgatgaggacgatgatgaagatgaagataaagaggatactttacccctgagtaagaaagctaagttcgattcatag

SEQ ID NO: 31675 - DNA, 3987 bp, Artificial Sequence
  Description of Artificial Sequence: Synthetic coding sequence
atgtggagacgaaagcatccacgcacttctggcggaactcgcggtgtgctgtccggaaaccggggagttgaatacggctccgggagaggacaccttggcactttcgaaggcagatggagaaaactacctaagatgcctgaggcggtagggacagacccctccacttctcgaaaaatggccgagctggaagaggtgacactcgatggaaaacctcttcaggccttacgtgttacagaccttaaggccgctcttgagcagcgcggtctggctaagagcgggcaaaaatctgcactcgtgaagagactgaagggggctctcatgttggagaatttgcaaaagcatagtacaccacacgccgctttccaaccaaacagtcagattggagaagaaatgagccaaaacagctttatcaagcagtatttagagaaacagcaagagctccttagacaacggttggagcgggaagcgagagaagccgcagagctcgaagaggcctcggcagaatccgaggacgaaatgatacatcccgagggtgtggcttccctactccccccagacttccagtcaagcctggagaggcccgaactggaactgtctagacacagtccccgtaagagcagcagtatatcagaagaaaaaggggattccgatgatgagaagcccagaaagggggagaggaggagcagtcgggtgcgccaggccagggccgctaagctgagtgaggggtcgcaacccgctgaagaggaagaagaccaggagacgcccagtaggaatctgcgggttagagcggaccgcaacctcaaaacagaagaggaagaagaagaagaggaggaagaagaggaagatgatgaagaggaggagggggatgatgaggggcaaaagagtagggaggctccaatacttaaggagttcaaggaggaaggcgaggagattcccagggtaaaacccgaggaaatgatggacgagagacccaagacccggtctcaggagcaggaagtgctggagaggggtgggagattcactcggagtcaggaggaggcaagaaagagccatctggcaagacaacaacaggaaaaggagatgaaaaccacttccccgcttgaggaagaagaacgcgagattaaatcgagccagggcttgaaggagaagtcaaagagtccgtccccccctagacttaccgaggaccgaaagaaggcatctctggtggccctgccagaacagacggcgtccgaagaagaaacaccgcctccactgctcaccaaagaagcttccagtccccctcctcatcctcagctgcattctgaagaggaaatagagccaatggaagggcctgctcctgccgtcctgatccagctgagtccacctaacactgatgctgacactcgcgaactgttggtgagccagcacactgtccagctagttggtgggctttcacctctttctagtccttcagacaccaaggccgaaagtcctgcagagaaggtgcctgaggagtccgtgttacccttagtacaaaagtctacactcgcggattactctgcccaaaaggaccttgaacctgaaagcgaccgctccgcgcagcctctccctctgaaaatcgaggagctggcactcgccaagggcatcaccgaggagtgtcttaagcaaccttccctggaacagaaggaaggcaggagggcgagccatactctgctgccatctcacagactgaaacagagcgccgactcgagctctagccgctcttcttcaagcagtagttctagcagccgctcacggagtaggagtcctgattcctcgggcagcaggtctcattcacctttgcgctcaaagcaaagagatgtcgcacaggcaaggacccatgccaacccacgcggacgacctaagatggggtctcgatccacctcagagtctcggagcaggagccgttcaaggtctcggtcagcctcttccaacagtcgcaagagcttaagccctggcgtgtctagggactccagtacctcctatacggagactaaggacccatcttctggtcaggaagttgccacaccacccgtgccacagctacaagtttgcgaacctaaagagaggacctccacaagtagcagttctgtgcaagcgcgaagactgagtcagcctgaaagcgctgaaaagcatgtcactcagcgcttacagcctgaaagaggttcaccaaaaaagtgtgaggctgaagaggcagagccacccgcagccacccagccccagacaagcgaaacccaaactagtcatttgcctgaaagtgaaaggatacatcacacggtggaagagaaggaggaagtgacaatggacacctcagagaaccgacccgagaacgatgtccctgagccacccatgccaatcgcagaccaggtttccaacgatgatcgccctgaaggatctgtggaagacgaggaaaaaaaagagagctccttaccgaaatccttcaaacggaagattagcgtcgtgagtacaaagggcgtgcccgctggcaacagtgacactgagggcggacagcccggacgcaagcgaagatggggcgcaagcactgccaccacccagaaaaaacctagcattagcataactaccgaatccttgaaagaggccgtggttgacttacacgccgacgattcaaggatttcagaagacgaaaccgagagaaatggagatgatggtacacatgataaggggctgaagatctgccggacggttacccaagtcgtcccagcggaggggcaggaaaatggacagagggaagaggaagaggaagaaaaggagccagaagcagagcccccagtgcctccccaagtgtcggtggaagttgccttaccacctccggctgagcacgaggtgaagaaggtaaccttgggcgatactttgaccagaagaagcattagccaacaaaaaagcggtgtctctattaccatcgacgacccagtccgcactgcccaggtgccttctcctccacgcggaaagatttcaaacatcgtccacatcagtaatctggtgcgaccttttacccttggacagctgaaagaacttctgggacgcaccggcaccctagttgaggaggctttttggatcgataagatcaagtcgcattgttttgtcacgtatagcacagttgaagaggcggtagcgaccaggacagccctgcatggagtaaaatggccccaaagcaacccaaagtttctgtgcgcagattatgccgagcaggatgaacttgactatcatagaggcctcctggtggatcgtccttctgaaacgaagactgaagaacagggcattcctagacccctgcaccccccaccaccccctcccgtacagcctcctcaacatcctagagcagaacaacgggaacaggagagggccgtgagagagcagtgggcagagagggaaagagaaatggaacgccgtgaaaggacccgttcagagcgggaatgggaccgcgacaaggtgcgcgaggggcctagaagtaggtcaagatccagagatcgcaggaggaaggaacgggctaagagcaaagaaaaaaagagtgaaaaaaaagagaaagcccaggaggaacctcccgctaagctgctggatgatctgttccgtaagacaaaggcggctccttgtatctattggttgccactaaccgatagccagatagtgcaaaaggaagccgaaagagcagaaagggccaaagaacgcgagaagcgaagaaaagagcaggaggaggaagaacagaaagagcgcgaaaaggaggcagaacgagaaagaaatcgacagttagaaagggaaaaaagaagagagcatagccgggagagggatcgtgagcgggaaagagaacgtgagcgcgacaggggcgacagagatagggatcgggaacgtgatagagagaggggacgggaaagagataggcgtgataccaagcgccatagcagatcacgcagccggtcaacgccggtgcgggacagaggaggcaggcgttag

SEQ ID NO: 31676 - DNA, 1089 bp, Artificial Sequence
  Description of Artificial Sequence: Synthetic coding sequence
atggcccactccagctttttcccagacgagtattttacatgttcttctctttgtttgagttgcggtgtggggtgtaaaaagtccatgaatcacggcaaagaaggagtgccacatgaggcgaagagccgttgtcggtattctcaccagtacgacaatcgggtttatacctgtaaagcttgttacgagcgcggagaagaggttagcgtggtaccaaagacaagcgcctctaccgactctccgtggatggggctggctaagtacgcttggtctggatacgtcatcgaatgcccgaactgcggcgtcgtctatcgctcccgacagtactggttcggtaatcaggatcctgtagataccgtagtccgaactgagattgtccacgtgtggcctggcaccgacggctttctcaaggacaataacaacgcggctcaacgcctgctcgacggcatgaattttatggcacagagtgtctccgagcttagtttggggccaaccaaagccgtaacatcttggctgaccgatcagattgccccagcctactggcgccctaactctcagatcctctcctgtaacaaatgcgctactagtttcaaggataacgacacgaagcaccactgtagggcttgtggagagggcttttgcgattcatgctcaagcaagacaaggcccgttcctgaacggggatggggccctgcaccggtccgcgtctgtgacaactgctacgaggcaaggaatgtacagcttgctgtgacggaggcacaagttgatgacgaagggggtacgcttatcgcacggaaggtcggggaggctgtccagaatactctgggtgccgtcgtgacggcaatagacattcccctgggactggtgaaggacgctgcacgccctgcttactgggttcctgatcacgagatattgcactgccacaactgccggaaagagttttctatcaagctgtccaaacatcattgccgggcatgcggccaagggttctgcgatgaatgtagtcacgaccggcgtgccgttccatctcgaggctgggaccatcccgtgcgtgtgtgtttcaattgcaacaagaagcccggtgacctttag

SEQ ID NO: 31677 - DNA, 420 bp, Artificial Sequence
  Description of Artificial Sequence: Synthetic coding sequence
atggagactgactgcaatccaatggagttatcctccatgagcggcttcgaagagggaagcgaactcaatggttttgaagggacagatatgaaagatatgcgactagaagcagaggccgtggtaaacgacgtcttatttgctgttaacaacatgtttgtgtccaaatctttgaggtgtgcggatgatgttgcatatataaacgtggagactaaggaacggaaccgatattgtctggagctaactgaagccggtcttaaagtggtaggatatgccttcgaccaggttgacgatcatctgcagacgccttaccatgaaaccgtgtattccctgctcgacacactgtcacctgcgtaccgcgaagcgtttggcaacgcgctgttacagagactagaggcgcttaagagggacggtcagtcctag

SEQ ID NO: 31678 - DNA, 2256 bp, Artificial Sequence
  Description of Artificial Sequence: Synthetic coding sequence
atgtccgaggaggagctgaccaaagccatggaaggcctcggaatggacgaaggggatggagagggaaacatcctccctattatgcaaagcattatgcaaaatctgctctccaaagacgtcctttaccctagcctaaaagagattactgagaagtacccagaatggctgcaaagccatcgggagtcgctgccccctgaacaattcgagaagtatcaagaacagcattccgtcatgtgcaaaatctgtgaacagttcgaggccgagacacccacagattcagaaacgactcagaaggccagatttgagatggtcctggatttaatgcaacagttgcaggacctggggcacccaccaaaggaactcgcgggagagatgctgacctggctgttcttctgcggatcccaatgggtatacggaccgtggctaacatatgtcggctggctccagcagacatctttcaaaatgagtagcaaggggtcaagcaccgatggacggacggacctggctaatggctccctttctagtagcccagaagaaatgagtggggcagaggaaggacgggaaacttcgtcagggattgaggtggaggcaagcgatctgtctttaagcctgacgggcgatgatgggggtcccaaccgcacttctacagaaagcaggggcaccgatacagaaagctctggtgaggacaaagatagcgacagcatggaggacacaggtcattactcaatcaacgatgaaaacagagtacacgacaggagtgaagaagaagaggaagaggaagaagaggaagaagaagagcagccaaggcgacgagtacagaggaaacgcgcaaatagagatcaggactcctctgacgacgaacgcgctctggaggactgggtgagctctgagacatcagccctaccccgaccccgttggcaggcccttcccgctctgagagagcgggaattaggttcgtccgccagattcgtatatgaagcgtgcggcgctagggttttcgtgcagaggttccgactgcagcacgggctggaagggcacacaggctgcgtgaacacacttcatttcaatcagagaggaacttggttggcaagtggcagcgatgatttaaaggtcgtcgtttgggattgggtgaggcgtcagccggtgctggactttgagagcggtcacaagagtaatgtctttcaagcaaagtttttgccaaactccggggacagtaccttggccatgtgtgctcgggatgggcaggttagggtcgccgagctgagcgctacacagtgctgcaagaacactaagagggtcgcccaacacaagggtgcctcccacaaacttgcattggagcctgacagtccctgcacgttcctgtctgctggcgaagatgccgtggtcttcacaatcgacctccggcaggatcgaccggcttccaagctggtggtgaccaaagaaaaagaaaaaaaagtgggcttgtataccatctacgtcaatcctgccaacactcaccagttcgccgtcgggggaagggaccaattcgtacgcatctatgatcagcgcaagatcgatgaaaacgaaaataatggcgttttaaagaagttttgcccacatcatctggtgaatagcgaatctaaagctaacataacatgcctggtgtattcgcacgacggaaccgagctgctcgcatcctataacgatgaggatatatacttgttcaattcctcccactctgacggggctcagtacgtgaagcgctacaagggccacagaaacaatgccacagtgaaaggggtaaatttttacggccctaaatcagaattcgtcgtcagtggcagcgactgcggacacattttcttatgggagaagtcttcttgccaaatcatccagttcatggagggcgacaaggggggtgtggtgaattgcctagagcctcaccctcacctgccagtgctcgctacgagcggcctcgaccacgatgtgaagatttgggcccctacagccgaagcatctacagaattaacagggcttaaggacgtgattaagaagaacaagcgcgaaagggatgaagattccctccaccagaccgatctgttcgactctcacatgctgtggttcctcatgcaccacctccgacaaaggcgacatcatcgaaggtggcgtgaacccggagtgggcgcaaccgacgccgactcggatgaatctccttccagtagcgacacctccgacgaggaagaaggcccagaccgtgtgcagtgcatgcccagctag

SEQ ID NO: 31679 - DNA, 1056 bp, Artificial Sequence
  Description of Artificial Sequence: Synthetic coding sequence
atgatcgtgcaacgagttgttctgaatagccggccaggtaaaaatggaaatcctgtagcggaaaattttcggatggaggaagtctacctgcctgataacatcaatgaggggcaagtgcaggtgcgaacactgtacctgtctgttgatccttacatgcggtgtcgaatgaacgaggataccggaactgactacattactccctggcaactgtcccaggtcgtcgatgggggaggtatagggatcatcgaggagtcaaagcataccaacctcaccaaaggtgactttgtcactagtttttattggccctggcagactaaggtgatcctcgacggaaattccctcgaaaaggtggatccccagctcgtggatggacatctgtcttattttttaggggctatcggaatgccgggacttacgtctctgattgggatccaggagaagggccatatcacagctggatcgaataagactatggtggtcagtggcgctgccggagcatgcggtagcgtagcaggccaaattgggcactttctgggctgttcccgtgtggtcgggatctgcggaactcatgagaaatgtatccttttaacttccgagcttggattcgacgcagccattaattataaaaaagacaacgtggccgagcagctcagagaatcctgtcctgccggagtggatgtgtattttgacaacgtggggggtaatatttccgacactgtcatatcacagatgaacgagaacagccacattattttatgcggccaaattagtcagtataacaaggatgtgccttatccacccccactcagtccggcaatagaagccattcagaaggagagaaacattactagagaacgctttctcgtgctgaattataaagacaagttcgaacctggaatattgcagctctctcaatggttcaaagaaggaaagctaaaaataaaggaaacagtcattaatggacttgagaacatgggagcagcctttcagtccatgatgactgggggaaatataggtaagcaaatcgtgtgtatcagcgaggagatcagcctatag

SEQ ID NO: 31680 - DNA, 588 bp, Artificial Sequence
  Description of Artificial Sequence: Synthetic coding sequence
atgccactcccgtttggccttaagttaaaaaggacaagacggtacaccgtatctagcaagagctgcctcgtggctaggattcaactcttgaataacgagttcgtagaattcactctgagcgtggagagcaccgggcaggagtcactcgaagctgtggcccaacgcctggagttacgagaagtaacttatttttccttgtggtattacaataaacagaatcagcggcgatgggtagacttggagaagccactgaagaagcaactggataagtacgccttggaacctacagtttacttcggcgtcgttttttacgtgccaagcgtgtcccagctgcaacaggaaatcactcggtaccagtattacctgcagttaaagaaagacattcttgagggctcgatcccttgtaccctggagcaggctatccagctggccggactggccgtgcaggcagactttggcgatttcgaccagtacgaaagccaggatttcttacagaaattcgccctcttcccagtgggatggcttcaggatgagaaggtcctcgaggaggccacccaaaaggttgccctattgcatcaaaagtattag

SEQ ID NO: 31681 - DNA, 354 bp, Artificial Sequence
  Description of Artificial Sequence: Synthetic coding sequence
atgggggataaaaagtctcccacccggcctaagaggcagcctaagccctccagcgacgagggatattgggactgtagcgtttgtacgttccgcaactctgcagaagccttcaagtgtatgatgtgtgacgtgcggaaagggacctctacccgcgacagcaaagaaggcggtaagctcgtaagttatagcacagcctcactgggcgtaaggggaaccttacggaatcgggtgggagggggaagctcagaggagaaaaagcaggctgaatacctggctcctggcagaagacgaaacatcgtccatcgaggggtagggccagggcagcgttcaggcccttcgctgaaggaggcatag

SEQ ID NO: 31682 - DNA, 3285 bp, Artificial Sequence
  Description of Artificial Sequence: Synthetic coding sequence
atggcagagagttcctccgagagcgatcactttcgctgccgggataggctgtccccttgggccgctagaagcactcataggggaacccgctccctcccaactgtagaggtgacagaaaaagttaacacaatcacctcaacactgcaggatacatccaggaatctgcgccaggtggatcaaatgctgggcaggtacagagagtactccaatggacaggccggagctatcgagcatttaaaggaaagcttggaacagtcaatagaccagctgcggtcccagagactgctgcgcaactctggcggtagatcgatctctgtgacctcgctgtctgcatccgacctggacggcggaactggaagtgaattacatcacttccctcccacatcaccactgaaggactacggagacccacaggggatcaaacgaatgcgctcccgaacaggcgtgcgcttcgtccaggagactgacgatatgactcagctgcacggattccatcagagccttagggacctttcatctgaacaaatccggctgggagacgactttaatagagaactgtcacgccgtagccggagcgacgcagagactaagcgagctctggaagagttgacagaaaaactcaacgaggcccagaagcaggaggtcgtgtccgatcgggttgaacgccgactgcaggaactggagcgggagatgagaaccgaacgcgagctggtggagcggaggcaggatcaactggggctgatgtcactgcaactgcaggaggccttaaagaaacaagaggccaaggcggacgaacacgagggggcaatcaaaaacaaactgcggcagaccgagacagaaaagaaccagctggagcaagagcttgagcttagcaggcggttattgaatcagtctgaaggcagcagagaaacactgctccaccaggtagaagaactgcgaacacaacttaccaaagctgagggcgatcgtaaaggactgcaacaccaagtatcccagataagcaaacagcagtctaactaccaggacgagcagggggaggattggaggttccgaaggggcgttgagagggagaagcaggaccttgagaaacagatgtccgatctccgcgtccagctcaatttctcagctatggccagcgaactggaggaggtgaagcgttgcatggagcgaaaggacaaagaaaaggcccatcttgcctctcaagtggagaatttgaccagggaattagagaatggagaaaagcagcaactgcaaatgctggacaggctcaaggagattcagaaccactttgatacgtgcgaggctgagaggaagcacgccgatctgcagatatccgagctgactcggcacgccgaggacgctactaagcaggctgaaagatacttgtccgagcttcagcaatcagaagcgctgaaggaggaggccgagaaaaggagggaagacctcaagctgaaagcccaggaaagtatacgccaatggaagctcaagcataaaaagctcgagagggccttggaaaaacagtcggaaaccgttgacgaactgactggaaaaaacaaccagattttgaaggaaaaagatgagcttaagacccagctctacgccgctctacaacaaattgagaaccttcgaaaggaactgaatgacgtcttaaccaagcgggctctgcaagaggaggaacttcattcaaaggaggagaagctgcgagacatcaagagccaccaggcagatctagaattggaagttaagaactctctggatacaattcaccgcttagagagtgaacttaagaaacagagcaagatccagtcccagatgaaagtcgaaaaggctcatctcgaagaggagatcgctgaactgaaaaagagtcaagcccaggataaagccaaactgcttgaaatgcaggaaagtatcaaagacctctctgcaataagggccgatttagctaataaactggccgaagaagagagagcaaagaaggccgtcctcaaagacctgtcggatttgacggcacaggccaagagtagggatgaagaaaccgctactatcatcacccagctcaaactggagcgcgacgtgcatcagagagaactgaaagatctgacttcaagcctgcaaagcgtgaagaccaaacatgagcagaacatccaagaactgatgaaacattttaaaaaagaaaaatcagaggccgagaatcacattcgaacacttaaggcagagtcgttagaggaaaagaacatggccaaaattcatagaggacagctagaaaaactaaaatcccagtgcgatcgtttaacagaagagctaacccagaacgagaacgagaataagaagcttaagctgaaataccaatgcttgaaagaccaattggaggaacgggagaagcatatttctatagaagaggagcacctccgaagaatggaggaggcacggctacagcttaaggaccagttgttgtgcctggaaacggagcaggagagcatcctcggagtaatcggtaaagagatcgatgccgcttgtaagacttttagcaaagattctgtcgagaagctgaaagtattttcttccggacccgacatccactacgacccacatcgctggcttgccgaaagcaagaccaagctgcaatggctttgtgaagaactgaaggaacgcgagaacagagagaaaaatctgcggcatcagctcatgctgtgcagacaacagttgaggaacctcactgaaaataaggagtcagagctccagtgtttgtttcagcaaatcgaaagacaagagcagctcctcgacgaaatccacagagagaaaagagacctgcttgaagagactcagcgcaaagacgaggagatgggctccctgcaggatcgagtgatcgcattggaaaccagtacacaggttgccctcgatcatcttgagtccgtacctgagaagctgtctttgctggaagattttaaagatttccgagattcttgcagctcatcggaacgaaccgacgggaggtattccaagtatagagtacgaagaaactccctccagcaccaccaggacgacaccaagtaccgcacaaaaagttttaagggcgataggacgtttctggaaggtagtcatacaagaggattggaccacagcagctcctggcaagaccattctcgattcctatcctcccccagattcagctatgtgaattctttcacaaagaggacagtcgctccagatagcgcgtctaataaggaggacgccaccatgaacggtactagcagtcagcccaagaaagaggaatacggaagctag

SEQ ID NO: 31683 - DNA, 1353 bp, Artificial Sequence
  Description of Artificial Sequence: Synthetic coding sequence
atgagagagatcgtgcacatccaggctggccaatgtggtaatcaaattggtgcaaagttctgggaggtcatatccgacgaacacgggattgacccttccggcaattatgtgggagatagtgaccttcaactggagcgcataagcgtatattacaatgaggcgtccagtcacaaatacgtcccccgagcaatcctggtggacctagaacccggtactatggatagcgtaaggtcaggagcatttggacatttatttaggcccgacaactttattttcggccagtccggtgccggaaacaattgggctaaaggacattatacagagggagcggagctggttgattcagtgttggacgtagttcggaaagagtgcgagaattgcgactgtttacagggattccagctgactcactctctgggagggggtacaggctccggaatgggcactctcctaattagcaaagtacgggaggagtaccccgaccgcattatgaacaccttctcagtggtgccctcacccaaggtgtctgatacggtcgtggagccatacaacgcaacgctcagcatccaccagctggtcgagaacacagatgagacgtactgtatcgataacgaagccctctacgatatttgttttcggacactcaagctggccactccaacctacggcgatttgaaccacttagtctcagcgactatgtcaggcgtgacgacatcgcttcgctttccaggacagctgaatgcagatctcaggaagcttgctgtgaatatggtcccattccctagattgcatttttttatgcctgggtttgcccctctgaccgcgcgaggatcacaacaatatagggctctgaccgttccagaactgacccagcagatgtttgacgccaaaaatatgatggcagcttgtgaccccaggcatggacggtacctgactgtggcaacagttttccgaggtcggatgagtatgaaggaggttgatgagcagatgctggctattcagtctaagaatagctcatatttcgtcgaatggattcccaacaatgtcaaggtggctgtatgcgatattcccccacgtggattgaaaatgagttccaccttcattggtaactctaccgcaatccaagagttgttcaagcgcatcagtgagcagttcacggccatgtttcggcgaaaggcattcctgcactggtatacaggagaaggcatggacgaaatggagttcaccgaggccgagagtaatatgaacgacctggtgagcgagtatcagcaataccaggacgcaactgctgaagaggagggtgaaatgtatgaggacgatgaggaagaatccgaagcacagggacccaagtag

SEQ ID NO: 31684 - DNA, 240 bp, Artificial Sequence
  Description of Artificial Sequence: Synthetic coding sequence
atgaatgagtcaaagcccggagactctcagaatcttgcatgtgtgttttgccgcaaacacgatgattgcccaaacaagtatggcgagaagaagaccaaggaaaagtggaaccttacagtgcattattattgtttactgatgtccagtggcatttggcagcggggtaaagaggaggaaggtgtctatggcttcttgatcgaggacattagaaaagaagttaacagggcttccaaattgtag

SEQ ID NO: 31685 - DNA, 1785 bp, Artificial Sequence
  Description of Artificial Sequence: Synthetic coding sequence
atgaccgacacgagacgcagggttaaggtgtacaccttaaacgaggacagacagtgggacgatcgcggaacgggacacgtgagctctgggtatgttgaaaggctgaagggtatgtctcttctcgtccgggctgaaagcgacggcagccttctcctggaatcaaaaatcaacccaaacacggcctatcagaaacaacaagaagatgagaagttccttaccgacctcttcgcacagctgacggatgaagccactgacgaggagaaacgacaagagctcgtgaacttcctgaaagaattttgcgccttttcacaaacgctgcagccacaaaatcgggacgccttcttcaagaccttgagcaacatgggcatccttccagcccttgaggtaatcctcgggatggatgatacccaagttaggtcagctgcaacagatattttctcctacctggttgagtacaatccttccatggttcgggagttcgtaatgcaggaggcacagcagaacgatgacgtcagtaagaagctgactgaacagaagattacctccaaagacatactgctgatcaatctcatcattgagcacatgatctgtgatacagaccctgagctgggcggtgccgtccaattgatgggactgctgcggactctggttgatccggagaatatgctcgccaccgcgaacaagacggaaaaaacagagtttctgggatttttttacaaacactgcatgcacgtgctaacagcgccattactagcaaacacaactgaggataagccttcgaaagatgactttcaaaccgctcaactgctggcactggtgttagagttactaactttttgcgtcgagcaccacacataccatattaaaaattacatcatcaacaaagatatcttgagaagagtgctcgtcttgatggcatctaaacatgctttcttggccctgtgcgctctgagatttaagaggaagatcatcggcctgaaggacgaattctacaatcgttatatcatgaagtccttcctcttcgagcctgtcgtcaaggcatttctcaacaatggttctcgttacaacctcatgaattccgccatcatagagatgttcgagttcatccgggtggaagatatcaagtccttaaccgctcacgtcatcgagaattactggaaggctctggaagatgtggactatgtgcagacctttaaagggctgaagctgcgtttcgaacagcagcgcgaaagacaagataaccccaagctggatagtatgaggtccatcttacgcaaccatcgctatcgcagggacgcaaggaccctggaggacgaggaggagatgtggttcaacacggacgaagacgatatggaggacggcgaagcggttgtgtccccctccgacaagacaaagaacgatgatgatatcatggatcccatctccaagtttatggagaggaagaagctgaaagaaagtgaggaaaaagaggtattactgaagacaaatttgtctggcagacagagtcccagtttcaaactgagtctcagcagtgggacaaaaactaatctgacttcccagagttcaacaacgaacttgcccggaagccccggaagccccggttcccccggttcacctgggtcaccaggttcagtaccaaaaaatacctcacaaaccgccgctattacaacaaagggtggcctcgtgggtctggtggattacccagacgatgacgaggatgacgacgaggacgaggataaggaagataccctgcccctgagcaaaaaagcaaagttcgacagttag

SEQ ID NO: 31686 - DNA, 540 bp, Artificial Sequence
  Description of Artificial Sequence: Synthetic coding sequence
atggcagagtcaagcagtgaaagcgatcactttcgatgcagggataggctgagcccatgggcggcaagatccactcaccgcggaacacgttccctccctacagtggaagttactgaaaaagttaatacaatcacgtccaccttgcaggacacctcccgaaacctgaggcaggtggatcagatgctggggagatacagggagtacagtaacgggcaggcaggcgcaatcgaacacttaaaggagtccttggaacagagcatcgaccagctgagatcccaacggctcctccggaacagtgggggacgcagtatctcagtcacctccctctctgcgagtgacctcgatggaggaaccgggtccgagcttcatcactttccacccacctctcctcttaaggactacggtgatccacaggggattaagagaatgcggtctagaaccggcgttcggtttgtccaggagacggacgacatgacccaactgcatggctttcatcaaagcttgagagatctctcaagtgagcagattcgcctgggatag

SEQ ID NO: 31687 - DNA, 1056 bp, Artificial Sequence
  Description of Artificial Sequence: Synthetic coding sequence
atgatagttcaacgcgtggtacttaacagtcggcctggcaagaatggcaaccccgtggccgaaaacttcagaatggaggaggtgtatttgcctgataacattaacgagggacaggttcaggtgcgtaccctttatctttctgtggacccatacatgagatgtaggatgaatgaagacacagggactgactacatcaccccctggcagctttctcaggtggtcgacggtgggggtatcggcattattgaggagtcgaaacacaccaacctgaccaagggggacttcgtgactagcttttactggccttggcaaacaaaggtcatcttagacggcaatagtctagaaaaagttgacccccagcttgttgatggtcacctgagttattttctaggggcaataggtatgccaggattgacgagcctcataggcatccaggagaagggacatatcacagccggaagcaataagacaatggtagtctcaggagcagcgggtgcctgcggcagcgtagctggtcagatcggtcacttcttagggtgtagtagagtcgttggcatttgtgggacacacgagaaatgcatcctgcttactagcgaacttggctttgacgcagccatcaattacaagaaggataacgtggccgagcaattgcgggagagctgccccgcaggggtggacgtgtacttcgataacgtgggcggtaacataagcgatactgttatttcccagatgaatgaaaatagccacattattctctgcggccagatctctcagtacaataaggacgtgccctaccccccaccactgtctccagcaattgaggccattcaaaaagagcgaaacatcacacgcgagcggttcctggtccttaactacaaggataagttcgagccaggaatcctgcagctctcacagtggttcaaagagggaaagctgaagataaaagaaacagtcattaacggactcgagaacatgggtgctgccttccaaagcatgatgacaggcggaaacatcggtaaacagatcgtctgtatttcagaggaaatcagtctttag

SEQ ID NO: 31688 - DNA, 330 bp, Artificial Sequence
  Description of Artificial Sequence: Synthetic coding sequence
atggagacggactgtaaccccatggagttatccagtatgtcaggattcgaggaagggagcgagctgaacgggttcgaaggcacagacatgaaagacatgaggctagaggctgaagctgttgtaaatgatgtcctgtttgctgtaaataacatgttcgtgtccaagagccttaggtgcgccgatgacgtggcctatattaacgtggagacaaaggagcggaatcgctactgcctcgagctgactgaggctggactgaaagtggtgggttatgcttttgatcaggtggacgaccatctccagactccttaccacgaaacagtgtattcttag

SEQ ID NO: 31689 - DNA, 387 bp, Artificial Sequence
  Description of Artificial Sequence: Synthetic coding sequence
atggcagaatccagctccgaatccgaccactttcggtgcagggatcggctctccccttgggcagcccgatcaacgcataggggcaccaggagtctccccactgtagaggtaacggaaaaggttaataccattacgagcactttacaagacacatcccgcaaccttcgccaagtcgatcagatgctcggtaggtatcgagagtacagtaatgggcaagctggcgctatcgagcacttgaaagaatctctagaacagtcgattgatcagctgcggtcacagaggcttcttcggaattccggcggacgctctatcagcgttacatcactgtccgcctccgatttggacggcggaacgggttccgaactacaccacttcccacctacctag

SEQ ID NO: 31690 - DNA, 369 bp, Artificial Sequence
  Description of Artificial Sequence: Synthetic coding sequence
atgttattcgctccctgctgtcatcagtgtggggaattcattattggcagagtgatcaaagcaatgaataattcctggcatcccgaatgttttcgatgtgatctgtgtcaggaggtgctggcggacatcggtttcgtgaaaaacgctggacggcacttatgccgaccatgtcataatcgggagaaagctcgaggtctgggcaaatacatttgtcagaaatgtcacgccattatagatgagcagcctctgatctttaagaatgacccttaccaccccgaccattttaattgtgcaaactgcggtcaggaggggtccgactgtcgctgcaccggagcagagcgcggagccatactgcccgcaatgccctag

SEQ ID NO: 31691 - DNA, 420 bp, Artificial Sequence
  Description of Artificial Sequence: Synthetic coding sequence
atggaaacagattgcaaccccatggagttaagtagtatgtcagggttcgaagaggggtcagaactgaatggattcgaggggaccgatatgaaagacatgaggctcgaagccgaggcggtagtgaacgatgtcctgttcgctgtgaacaacatgttcgttagtaagagcctgcgatgcgccgatgatgttgcttatatcaatgttgagacaaaagagcggaatcgttattgtcttgaattgaccgaagctggtttaaaggttgtggggtacgctttcgatcaggtggacgatcacctgcagactccctatcatgagacagtgtacagcctgcttgataccctttcgccggcatatcgggaggctttcggcaatgctctgcttcagaggctcgaggcactgaaaagggatgggcaaagctag

SEQ ID NO: 31692 - DNA, 4602 bp, Artificial Sequence
  Description of Artificial Sequence: Synthetic coding sequence
atgcctgttaagcgattgcgtgaagtggtatctcagaatcacggagatcacctggttctgctcaaggatgaactgccatgtgtgcccccagccctgtccgccaacaagaggcttcccgtgggcaccggcacctccttgaacggaacatcccggggtagcagcgacctgacgagtgctaggaattgctaccagcctctcctagaaaatcccatggtcagcgaaagtgacttctctaaggacgtggctgttcaggtgcttcctcttgacaaaatagaagagaataataaacaaaaagccaatgatatattcatttcacagtacaccatgggtcagaaagatgcgcttagaacggttctaaaacagaaagcccagtcaatgcctgtgtttaaagaggttaaagtccacctgctcgaagatgcgggaattgagaaggatgcagtgacacaagagacccggatttctcccagcggcatcgatagtgctactaccgtcgccgcagctaccgccgctgccatcgctactgccgcacccctcatcaaggtgcagtccgatttagaggcgaaggtgaattctgttactgagttgctgtcaaaactgcaggaaaccgacaagcacctccagagagtgaccgaacagcagacgtctattcaaagaaaacaggaaaaactccattgtcatgaccatgagaagcagatgaatgtgttcatggaacagcatattaggcatctggaaaaactgcagcagcaacagatcgacatacagacccacttcatttccgcggctctaaaaacatcctcctttcagcccgtgagtatgccatcctcccgagccgttgaaaagtactccgtcaaacccgaacaccctaatctgggctcttgcaacccaagcctatacaatacttttgcgagtaagcaagctcctttgaaggaggtcgaagacaccagcttcgataagcagaagtcgcctttggagacccctgccccaaggcgatttgccccagtaccagtgagcagagacgacgagctctctaaaagggagaacttgctggaggagaaagaaaatatggaagtgagctgccatcggggtaatgttcgactcctggaacagattcttaacaacaacgactcactcactaggaaatcagagtcctcgaacactaccagtcttacacgctcaaaaatagggtggacccctgagaaaacaaatcgatttcctagctgtgaggagcttgaaaccacaaaagtgacaatgcagaagagtgacgacgtgcttcacgatctagggcagaaagaaaaggaaactaatagtatggtgcagccgaaggagtccctatctatgctgaagctaccagacctgccccagaacagtgtcaaattacagaccacaaacacaacgcggagcgttctaaaagacgcggaaaaaatacttagaggggtgcagaacaataaaaaggtgttagaagagaacttggaggccattatcagggcaaaagatggggctgctatgtattcattgatcaatgccttaagcacaaaccgggagatgtccgaaaaaattagaataaggaagacggtcgatgagtggattaaaacgatttctgccgagatccaagatgagttgtcacgcaccgactatgaacagaaacgatttgatcagaaaaatcaaagaactaaaaaggggcaaaatatgactaaggatatcagaacgaatactcaggacaagactgtgaataaatcagtgatcccgcgaaaacactcccagaagcagattgaagagcacttcagaaaccttccgatgcggggaatgcccgctagcagcctacagaaggagagaaaggagggacttctgaaagcaaccactgtcattcaggatgaggattacatgctgcaggtgtatgggaaacctgtgtatcaaggtcaccgtagtaccttgaagaaggggccatatctccggttcaactccccttcccctaagtccaggccacagcgcccaaaggtcattgagcgcgttaaaggcaccaaggtgaagagcatcaggacgcagactgacttctacgccacgaagcctaagaaaatggattcgaagatgaaacactcagtacccgtcctcccccacggtgaccagcagtatctgttcagcccttcccgcgagatgccaacattctctggaaccctggagggacacctgatccctatggccattttactgggtcagacacagagcaactcagacaccatgcctccagcaggagtgatagtatcaaaaccccacccggttaccgtcactacctctattcctccatcgagtagaaaggtggagactggggtgaagaagccgaatattgcaatcgtcgagatgaaaagtgagaaaaaggaccctcctcaactcacagtgcaggttctgcccagcgtagacattgatagcatctccaattccagtgctgatgtgctgtccccgctgtctagccctaaggaggcatcattgccaccagtgcagacctggatcaagacaccagaaatcatgaaggtggacgaagaggaggtcaaattccctggcactaacttcgacgaaatcatcgacgtgattcaggaggaagagaagtgcgatgagattccggattctgaacccatcttagagttcaaccgctcagtgaaagcagattcaaccaaatataacggacctccgttcccgccagtcgcctccacctttcaacccacagctgacatcttggataaagttatcgagcgtaaagagacactggaaaattctctgatccagtgggttgagcaggaaattatgtctcggatcatctcaggcctgttcccagtgcagcagcaaattgccccttcaatcagcgtgagtgtaagcgagaccagcgagccattgactagcgacatagtggagggtacctcaagtggggcactgcaactctttgttgacgcaggagtacccgtgaacagcaatgtgattaagcactttgtcaatgaagcactggctgaaaccattgctgtcatgctgggcgacagggaggctaagaaacaagggcctgtggcaacaggcgtttccggcgatgccagcacaaacgaaacataccttccagctcgcgtgtgcacacccttgcctactccccagcctacacctccttgctctccctcatcccctgcaaaagaatgtgtgctggtcaaaacccccgactcgtccccctgcgactctgaccacgacatggcctttccagtaaaggagatttgtgctgaaaaaggggacgatatgcctgccataatgttggtgaataccccgaccgtcacacccacaactaccccgccacccgcagcagccgtgtttactcctacgctctcagatatctccatcgataagctgaaggtttcgtcaccagagctccccaaaccctggggggacggagatctacccttagaggaggaaaatcctaactccccccaagaagagttgcacccacgggcaattgtgatgtctgtagccaaggacgaggaacccgaaagcatggattttccagctcagccacctccaccagaacctgtacccttcatgccctttcccgcaggtaccaaggccccatccccatcacagatgccgggatcggactcatcgacactggagtcaacactgtcagtgaccgtgacagagactgaaacactcgataagccgatcagcgagggcgaaatcctgtttagctgtgggcaaaagctcgcacccaagatattagaagacattgggttatatctgactaacctgaacgatagcctaagcagtactttgcacgacgccgttgaaatggaggatgacccccctagcgagggccaggtgatccggatgagccataagaagtttcacgcggacgctatcctcagctttgctaaacaaaaccaggagagcgcagtgagccagcaagcggtctatcattcggaggacctggaaaactccgtgggcgagctgtctgagggccagcgtcctcaattgaccgccgcagccgagaatatcctaatggggcactctctgtatatgcagcctccggtgaccaatacgcagtccctggaccagcagtgtgaccctaagccactttcccgacagttcgacaccgtctctggcagtatctacgaagattcttgcgccagccatggaccaatgtctcttggcgaactcgagttggagcccaatagcaaactcgtgctgcctactacccttcttaccgcacaggagaacgatgtcaatcttcccgttgccgctgaagactttagccaataccagcttaagcagaatcaggacgtaaaacaggtcgagcataaaccctcccaatcctatctgagagtgcggaataaaagcgatattgccccatcccagcagcaggtctccccaggagacatggatcgtactcagattgaactgaacccgtatctcacatgtgtgtttagtggcggaaaggccgtacctctatcagcctctcagatgcctccagctaagatgtccgtcatgctgcccagcgtcaacctcgaggattgcagtcagagcctttccctgtcaacgatgcaggaagatatggagtcatctggtgcggacaccttttag

SEQ ID NO: 31693 - DNA, 2334 bp, Artificial Sequence
  Description of Artificial Sequence: Synthetic coding sequence
atgtccgcccagacctccccagcagaaaagggactgaaccccggacttatgtgtcaagaatcttacgcctgctcaggtaccgatgaagccatttttgaatgtgatgagtgttgtagcctccagtgtctgagatgtgaagaagagttacacagacaggagagattgcgtaatcatgaacgtatcaggttaaagcccggacacgtgccctattgtgacttgtgcaaagggctcagcggacacctgcccggagtgcgccagcgggcaatcgtgcgatgccagacatgtaaaatcaatttatgtctcgagtgtcaaaaaagaacccactctggcggaaacaagcgtcgacaccccgtgacagtgtataatgtgtctaacctacaggaatcactggaagccgaggaaatggatgaggagacaaagaggaaaaagatgactgaaaaggtcgtcagcttccttctggtggacgaaaacgaagagatccaggtgacgaacgaagaagattttatccgcaaactagactgtaagcccgatcagcacctcaaggtcgtatcaatttttggcaatacaggggatggaaagagccacacactgaaccacacattcttttatggaagagaagtgtttaagacctccccaacccaagaatcctgcacggtgggggtgtgggcagcttacgatcctgtgcataaggtggccgtcatcgatactgaggggctgttgggcgcaactgttaatctctcccagaggacgcgcctgctgcttaaggtactggcaatctcagatctggtcatctataggactcatgccgaccggctgcacaatgatcttttcaagtttttgggcgatgctagtgaggcctacctgaaacacttcaccaaggagcttaaagcgacaacagccagatgcgggctggacgtccccttaagtactctcgggccagctgttatcatcttccatgagacagtccacacccaacttctgggcagcgaccacccctcagaagttcccgaaaagttgatccaggatcggttcaggaagctggggcgatttccagaggcgttctcttcaattcactataagggtactaggacatacaacccacccaccgacttctccggcctccgccgtgcccttgagcagctattagaaaataataccaccaggtcgcctaggcatcccggtgtcatcttcaaggcccttaaggccttgagtgaccgtttttctggggaaattcccgacgaccaaatggcacattctagtttctttcctgacgagtacttcacatgctctagcctgtgcttgtcctgcggagtgggctgtaagaagtccatgaaccacggaaaagaaggagttcctcacgaggccaagagccggtgccggtattctcaccagtacgataaccgcgtttatacgtgtaaggcttgctacgaacgcggtgaggaagtgtccgttgtgcccaagacttccgccagtacagatagtccgtggatgggactcgcaaagtacgcctggagtggatatgtgattgaatgccccaactgtggtgttgtgtatcggagccgacaatactggtttggtaatcaggaccctgttgacacagtagtgcgcaccgagatcgtgcatgtatggccaggtacagacggtttcctcaaagataataataacgcagcccagcgtctgttggacggcatgaacttcatggcccaatcagtgagcgagctaagtctgggtcccacaaaggccgtgactagctggcttaccgatcagattgctccagcgtattggaggcctaatagccagatcctgtcatgcaataagtgtgcgacttctttcaaagacaatgatacgaaacaccattgtagagcttgtggcgaaggattctgcgacagctgctctagcaagacaagaccagtgcccgaacgcggatggggacctgcgcctgtacgagtctgcgataattgttatgaggcgagaaatgtgcagctagccgtcacagaggctcaagtggatgatgaaggcggtaccctcatagcaaggaaagttggtgaagctgttcaaaacacactgggtgcggtggtgacagccatcgatatcccattaggactcgtgaaggatgctgcgcgacctgcctattgggtgcccgaccacgaaatcctacactgtcataactgtcgtaaggaattttccatcaagctatccaagcaccactgcagagcatgtgggcagggcttttgtgacgaatgttcacacgatcgcagagcagttccatcaagagggtgggatcatccggttagggtctgctttaactgtaataaaaagcctggggacctgtag

SEQ ID NO: 31694 - DNA, 867 bp, Artificial Sequence
  Description of Artificial Sequence: Synthetic coding sequence
atggagaagttgtcggccttacaggaacagaaaggggagctgcgaaagcgcttgtcatatactacacacaagctagagaagttagagacggagtttgattcaacccgtcattacctcgaaattgaactgagaagggcccaggaagaactcgagaaagttaccgaaaaattgcggcgtattcagtctaactacatggctctccagcgcatcaatcaagaacttgaggataaactgtataggatgggacagcattacgaggaggaaaagcgggctttgtcccatgaaatagtggcccttaactctcacctgttggaggctaaggtgacaatcgacaagctgagtgaggataatgaactttaccgcaaggactgtaacttagctgctcaactgctacagtgtagtcagacttatgggagagtccataaagtgtccgagctcccaagcgacttccaggagagagtgagtcttcatatggaaaaacacggctgctccttgcccagcccactgtgtcaccccgcttacgccgactctgtccctacttgtgtcattgccaaagtcctagagaaacctgatccggcttccttatcaagcagattaagcgatgcatccgccagagacttggccttttgtgatggtgtggagaagccaggcccacggccaccgtacaaaggggacatctattgttctgatactgcactctattgcccagaggaacgacgaagagacagaaggccctctgtcgatgcccctgtgacagatgtcggttttctgcgggcacagaactctacagacagcgccgcagaagaggaagaagaagccgaggccgcagcctttccagccggattccaacatgaggctttcccctag

SEQ ID NO: 31695 - DNA, 1263 bp, Artificial Sequence
  Description of Artificial Sequence: Synthetic coding sequence
taaacacaggcgatggcgctggagacccccactccaggacctcctagggaaggccagagccccgctagtcaggctgggacacagcacccacccgcacaggctactgcccatagccagtcctctcccgagtttaaaggttctctcgcaagcctgagtgattccctgggcgtaagtgtgatggcaacagaccaggactcgtactccacgtcctctactgaggaggaactggagcagttttcgagtccatccgttaaaaaaaaaccttctatgatcctcgggaaggccagacatcgcctatccttcgcgagcttttccagtatgtttcatgcattcctgtctaacaatcgtaagctgtacaaaaaggtggttgaacttgctcaggacaaaggatcttatttcggcagtctcgtgcaggattacaaggtgtattcattggagatgatggcacgccagacaagttctactgagatgctgcaagaaattcggacaatgatgacacagctaaagtcttacctgctccagagcacggaacttaaggcgcttgtcgaccccgctctccattccgaggaagagctggaggctatcgtggagtccgcattgtataagtgtgtgctcaagccacttaaggaggcaataaactcctgtctgcatcagattcactccaaggacggctccctgcaacagttgaaagaaaatcaattggtcatattagccaccacaacaaccgatcttggggtcaccaccagcgtccccgaagttcccatgatggagaaaatcctgcagaaattcacgtccatgcataaggcttacagtcccgagaagaaaatctctattctgctgaagacgtgtaaactaatttatgactctatggcactggggaatcccggaaaaccttacggcgcagacgattttctccccgtcctgatgtacgttttagcccgttctaaccttaccgagatgctcctgaatgtggaatacatgatggaactcatggaccccgctctgcagctgggtgaggggtcttactacctcactaccacatacggggcactcgaacacatcaagtcctatgacaagataacagtgactagacaattaagtgtggaagtgcaggactcgattcatcgctgggaacggcgacgtacattgaataaagcaagggcctccagatcatccgttcaggtgaggcccgaatccggacggggacctgtcggcccttgcccaagacatcacccctgctgccttctagctaaagaaccatag

SEQ ID NO: 31696 - DNA, 2466 bp, Artificial Sequence
  Description of Artificial Sequence: Synthetic coding sequence
atggctggtagcgacgcagaatgggtgactattgccaataatctgctattcaagtgccatatccacctgcgcattcatgagttgcaagactgtgatgctaatgtgtttattgccctttaccagagcattctcggcgagaaggttcctgatctgatcgtgatccccagaagtcaggaggatgacgcccacaacgtccaagcggtcattgatagtttagcactggactatctccaggtaagtctgagccatattactggcgagaatattgttaagggcgataaggaatcgatcaagaatctgctcgagatctttgacggactgctagaatacctgactgagagaatatctgagacttcccacgaaaagtcagagaccgagcagtacttcaaagagtccgacaggggcgagcgactcgaggaacccgagtccaccaaagagtcaaagtcttcatggaaacgcgtatccttcggtaggtgctctctgtcctctgagatgctagggccatcatgggacggagacgaagccgaatcaactggtgagataatccggctcggcgatactgctcatactttcagcctcaggtccaacggcgctcagtgtccaaatgagatgctttcaaagaaagccctcgcaagcccctctagcaagagtcacgaggatatgctctaccctccctcggtcctgtctaagtcccggacctctttcgttgaggacacagagactctgtccgtatctggtatcccaaacgcacgcaaacttggggagccaatccgagccgctattcctcttcaccctccttaccaccctagtgaaccgagggctccgtgtccgatagggaaggagtatctgcactccagtcactgcagccctgccgttaatagcaccggggagcatacagaattcagtggggatctggacgatgggctctttctgatttcaaaactccctaagggttctaaatgggaagtgtaccccgcacaagtgcagggcccacgtacccgcaaaccgccaaaggggaaacgtaatgagaatcgggcaaccgcctcttcttgtaatagcccctttccgcagcgccctaggaagcgcctgaccgagcaagaactacacgatgtgtcagagaaactaagccagcgcctgtcagagctcgactggatgctgaaatcagctcttggcgacaggatcaaggaaaagactgaccacaaagaagagaataccggaaacgaggaagtggaggacggcaccgaagaaactctgtctcaacacagcgacggtattgtggaatacgggcctaagaaatcaagacccggactgagcatgaggcgaaagcccccttacagatcccatagcctgtcaccctctcccgttaacaagcacaaacagtttcatcttgagaggaaaagacagcggaagcccagggagaccgatgttcggcagttccaggcccaggccttcactgaagctttcgaacgcgagttgcgccgtcataaagtacaggagaatataggcccactgcgcattcatgaaaaggaagaggagactgagaagatataccggggtgaggccgttcgcaaaggaactcctgaatgttcacagccttggaagatttatagtagaaaaaccaccacccagtccttgcgcggaggactgcctaaacccaataaggcggtcccaatgaaggtctctgagcactctctgctgcccctaatgctagaacagtttcccttcctttatgtttctggaccaactctgtctaaaatgtggaagcagcaaatcgcccaggttgaacagttgaagaaggaagcctgtagagagaatcgttccaagaagaagctgcaagatgagatagaggaggctcttaggcggcatgatctcctgactacactggttaagaaagagtacgaacataacaaacgcctgcaggatttcaaagactgtattagaaggcagagactgactcaatcaaagattaaggagaatcgccagcagattgttcgcgcacgtaagtactatgacgactacagagtccaactctgcgcgaaaatgatgcgtatgagaaccagggaggaaatgattttcaaaaaattgttcgaggagggactgaatattcagaagcagcgactccgggacctcaggaactacgcaaaggagaagagggatgagcagagaagacggcaccaggacgaactcgactcgatggagaactactacaaggaccaatttagcttgctcgcagaagcgatttcgcaggaacatcaggagttaaaagccagggagaaatcccaggcacagacgctccacaaagttaaaagggagctgagaagtaagatggaaaaggaaatccagcagctgcaagacatgattactcagaacgacgacgatgtgttcttcagggagctcgaagctgaaagattcaggagcaggttgcagcttgccagcttccagtactcgaaaagtccgtccctctag

SEQ ID NO: 31697 - DNA, 4560 bp, Artificial Sequence
  Description of Artificial Sequence: Synthetic coding sequence
atgcgaatccccgaccagaaatatgtaaccctgaaactcaacgatgtcatcaggttcggctacgattccaacatgtacgtgctggagcgtgtgcagcatcgtgttcccgaagaagctttgaagcacgagaaatacactagccagctgcaggtgagcgtaaaaggcctcgcacctaaacggtcagaggccctgcccgagcatacgccatattgtgaggcgagcaacccaagacccgaaaagggtgaccgacgcccagggacggaagccgcttcatatcggacacccctgtacgggcaaccaagttggtggggggaagatgacgggagcacactgccggacgcccaaagacagggggagccatatcccgagcgacctaagggccctgtgcagcaggacggtgaactgcatggctttagagccccagccgaaccccaagggtgctccttcagacgagagcctagctattttgagattcccaccaaggagacaccacagcccagccagccacccgaagtgccagcccatgagatgcccacgaaagacgcggaggcgggagggggaggggcagctccagtggtacaatcccacgctagctttaccatagagttcgacgattgttcccctggcaagatgaaaatcaaggatcacattactaaattttccctaagacagcggcgacctccaggaaaggaggcaactcccggagagatggtttccgctgagactaaggtggctgactggttggttcagaacgatccgtcccttctacatcgggtaggccctggtgatgaccggcactcgactaagtctgatctacccgtgcataccaggactctgaaaggacacaaacacgaagacggcacccagtcagatagcgaagatccactcgctaaggcagcatcagcagcgggagtgcccctcgaggcctccggtgaacaagttaggctgcagcgccagataaagcgagatccgcaggaactactccacaaccagcaggcctttgtgatcgaattttttgatgaagatactcctcgcaaaaagagatcacaatccttcacacattcaccgtccggagacccaaaggccgacaagcgacgaggcccaacaccagcagacagggacaggccatctgtgcccgcacccgtccaggccggaggacgctcctccggaccacaacgtgctgggtcattaaaacgggagaagaccgaagaaagattaggatccccttctcctgcttccaggacacctgcgcgaccttttggcagcgtaggaaggagaagcagactggcgcaggactttatggcccagtgtctgagagagtcgtctccagccgctagaccttccccagagaaggtgcctccagttctaccagccccattgacacctcacggtactagccccgtaggacccccaacgccaccccctgctcctactgacccccagcttaccaaggcaagaaagcaggaggaagatgactctctgtcagatgccggaacctacaccatcgagactgaagctcaagacaccgaggtggaagaagccaggaaaatgatagatcaggtttttggcgtccttgaaagtcccgagttgagcagagctagctccgcaaccttcaggccggtcattaggggtgaccgggatgagtctgacgacggcggtgtggcccagcgaatggctctgctgcaagagttcgcttctcgcccactgggggctgcccctcaggccgagcaccaaggtctgccagtgccaggaagcccagggggacagaagtgggtatcgaggtgggccagcctggctgattcatattctgaccctggcctgacggaagatgggctgggccgtagaggaggagagccggagggttcgctgccggtgcggatgcggaggcggctaccacagctgccatctgaacgggcagacagtcctgccggtcctgagagttctcgtcggtctggtccgggtcccccagagctagatagcgagcagccatccagactgtttggacaggaggaactcgatccagacagcttgtccgatgcttcagggagtgacgggggtcggggtcctgaacctggggtggagcctcaagattcgaggaggagaagcccacaggaggggcctacctggtccaggggtcgaagaagcccacgcgcaccaggggagccaactccagcgagcttctttatcggtgaccagaacggggacgccgtgttgagtcggaaaccactagcagcgcctggggatggggagggcctggggcagacagcccaaccctctccacccgctagagatggtgtgtatgtctcagcaaacgggaggatggtcatccagctgaggcccggacgaagtcccgagccagacggccctgcccctgccttcctgagacaagaaagcttcaccaaggagcctgcaagtggacctcccgctcctggcaagcccccacacatcagtagccacccactgcttcaggacctggcggctacaagagccgctcgaatggacttccattctcaggacacccacctcatattgaaagagactgaaaccgctctagccgcacttgaggctcgactattatctaattctgtcgatgccgagtgcgagggcggatcgacgcctcgaccccctgaggacgccttaagtggggactcagacgtcgacacagccagcacagtcagccttcgcagtggcaaaagcggcccaagccctaccacgccacagccactgcgcgctcagaaggaaatgtcccccagtcccccagcagcacaggatcccggtggcacggcgctggtctctgccagagagcagtcttcagaacgccaacaccacccattaggcccaactgacatgggaagaggagagcccgtccgtcgaagcgcaattaggcgaggccacaggcctagaggctcattagactggccgtcggaggaacgcggacccgtgctggctcaccttccttcaagcgatgttatggccagcaatcacgagacccccgaagcaacaggggctgggaggctgggctctaggcggaaacctgcggcacctcccccatcccccgcagctagggaagaacagagtagatccagcgcaagcagtcaaaaggggccacaagcgctgacacggtccaattcattgtccactcctcgtcccaccagagcaagccggctccggagagctcgcctcggtgacgcttctgatacggaggctgccgacggcgagagaggaagtctgggcaaccctgaacctgtggggagacccgctgccgagcaggcgaagaagttgtcaaggttggacattctggccatgcctcggaaaagagcgggttctttcacaggaacttctgatccagaggctgcccctgccaggaccagcttttccgggaggagcgtcgaattatgctgcgcttcaagaaaaccaaccatggcagaggctcgggctgtctctcgcaaagccgctaacaccgcgacaactacagggcctaggcaaccctttagcagggcccgttccggatctgcgagatatactagtaataccagacgcagacagcaggggtctgactatactagcacatctgaagaggaatatggaagccggcacggctccccgaaacatacgcgttcccacacaagtaccgcaacccagacgcctcgcgctggatctagttccagggcacggagcagagctcccggtccccgagacaccgacgacgacgaagaagagcctgatccctatgggtttatcgtccagacagcggagattgccgagattgctcgcctttcgcaaacactggtgaaggatgtagcaatcctcgctcaggagattcacgacgtggccggagacggagataccctgggatcaagcgaaccagcacatagtgcgtcactgagtaatatgccaagtacacccgcaagcaccatcagtgcaagagaagagctcgtgcaacggatcccagaggcatctctcaactttcagaaggtgcctcccggaagccttaactccagagacttcgaccagaatatgaacgacagttgcgaagacgccctggccaacaagacccgccctcgcaaccgtgaggaggtgatctttgacaacttgatgctgaatccggtgtcccagctttcccaggccattagagagaatacagagcatctagccgagaagatgaagattttgttccaaaataccggaagggcctgggaggatctggaggcacgcattaacgcggagaatgaagtgccaatcctcaagacttcaaacaaggaaatctctagcattctgaaggagctgcgaagggtccagaagcagcttgaggtcatcaacgctatagtggacccttcaggctccttggacctactcaccggaaatcgctcactcgctagcagtgcccaaccaggcctgggcaagggacgggtcgcggcacagtctccacctagcccagcttccgccgaagccctgctacccgctctgccactgcgcaactttccgcaaagggcctcctgtgggcctccatcactgcccgatcctacattcttgccagatgcggaacggttcttaatctag

SEQ ID NO: 31698 - DNA, 378 bp, Artificial Sequence
  Description of Artificial Sequence: Synthetic coding sequence
atgccatccgagaaaactttcaaacaacgcagaacattcgagcagagggtagaggacgtgcggctgatacgcgaacaacaccctacgaaaattcctgtaattatcgaacggtacaagggcgaaaagcaactgcctgtcctcgataagacgaagttccttgtgcctgatcacgtgaatatgagcgagctgatcaagataatcaggcggaggctccagttgaatgctaatcaggccttttttcttctcgtcaacggccacagcatggtgtctgtgagtaccccaatctctgaagtctatgaatcggaaaaggatgaagatggattcttatacatggtgtgcgcctctcaggagacctttgggatgaagctgtcggtttag

SEQ ID NO: 31699 - DNA, 3525 bp, Artificial Sequence
  Description of Artificial Sequence: Synthetic coding sequence
atgcctctgccctttggactgaagttgaaacgtaccaggcgatacacagtgagcagcaaaagctgtctggtggcacggatccagttactcaataacgaatttgttgagttcactctcagcgtggaatcaacagggcaggagtccttggaggcggtggcgcagaggttagaactgcgcgaagtgacttacttcagtttgtggtattacaacaagcagaatcaacggaggtgggtcgatctggagaagccattaaagaaacagctagacaagtatgcgctggaaccgactgtatactttggggttgtgttttatgtgccttcggtgagccagctccagcaggaaattaccagatatcagtattatttgcaactcaaaaaggatatccttgaaggaagtatcccctgcaccctggaacaagccatccaattggccggtctggctgtgcaggctgactttggggacttcgaccaatacgagagccaggacttcttacaaaaatttgcgctgtttccagtagggtggctccaagacgagaaagtcttagaagaagccacgcaaaaggttgcactacttcaccagaaatatcggggactcacggctcctgatgccgagatgctctacatgcaggaggtggagaggatggatggttacggggaagaaagttaccctgcaaaggatagccagggctccgatattagcatcggagcttgtctggaaggaatttttgtgaagcataaaaacggcagacatcccgtggtgtttcgctggcatgacatcgccaacatgtcccataataagtcctttttcgcactggagctagccaacaaggaggagacaatccagttccagacagaggacatggagacagccaaatacatctggcgattatgcgtcgctcggcacaaattttatcggctgaaccagtgtaatcttcagacgcaaaccgtcacggtgaaccctattcgaaggaggtctagtagtaggatgagcctgcccaagccccagccatacgtcatgccccctcccccacagctgcactacaatggacattacacggaaccctacgcaagcagccaggacaacctgtttgtaccaaatcagaacggatactattgtcactcccagacgtctttggatagagcccagattgacctgaacggtcggatccgcaacgggtctgtctatagcgctcacagtacgaacagtctgaacaatccacagccctatctgcagccttccccgatgtctagcaatcccagcatcacagggtcagacgtgatgaggcccgattatctcccatcccaccgccattctgccgtaataccaccatcttaccggccaactcctgactacgagacagtgatgaagcagctgaaccgcggactggtccatgccgaacgtcagagtcacagcctccgcaacctgaacatcggctcttcctacgcctatagtcgacccgcagctctcgtgtattctcagcctgagattagggagcatgcgcagttgccaagcccagccgcagctcactgtcctttcagcctctcctacagttttcattctccgtccccctatccgtaccctgccgagaggaggcccgtggtgggtgccgtgtcagtacccgagctgaccaacgctcagctacaggcgcaggactaccccagtccaaatatcatgcgtacccaggtataccgaccccctcctccttatcctcctccacggcctgccaactccacaccagacttgagccgtcacctgtacatcagcagttctaacccggatcttattacgcgcagggtgcaccatagtgtccaaacgtttcaggaagattccctccctgtagcccactccctacaggaggttagcgagcccctcacagccgcacgacacgctcagctacataaaaggaatagtatcgaggtggcgggtctgtctcatggactggaggggttgcgtctaaaagaacggacactctcagccagtgctgccgaagtggcccctcgtgccgtgtctgtgggtagccagccctcggtgtttaccgagcgtactcagagagagggcccagaagaggccgagggcctcagatatggtcataaaaaatcactaagcgacgctacaatgctaatccatagctcggaggaagaagaagacgaagactttgaagaggagagcggggctagagcacccccagccagggcaagagaaccacgccctggtctcgcccaagatcccccagggtgtcctagggtactgctggccggacctctgcacattttggaaccaaaagcgcacgtgccagatgcggaaaaacgcatgatggactcatcgcctgtgagaacaaccgccgaggcacagagaccctggcgcgatggattattgatgccttctatgagcgaatccgatctcacaacaagcgggcgataccgggcacgaagggattcattgaaaaaacggcctgtttctgatctactttccggcaagaagaacatcgtggaggggttaccccctctggggggtatgaaaaagacccgagttgatgcgaagaagatcggcccattaaagttggccgctctgaatggcctctccttgagccgcgtgccacttcccgatgaaggcaaagaagtggctaccagagctacaaatgacgaaaggtgtaagatattggaacagcgtcttgaacagggtatggtcttcacagagtacgagcggatcctgaagaaacggttagtcgacggcgaatgcagtacagctcggctgcctgaaaacgccgagcggaatagattccaggatgtactaccatacgacgatgtacgcgtggagctggtcccaactaaagagaacaatacgggctatataaatgcctcacatatcaaggtatctgtgtccggcatagagtgggactacatcgcaacgcagggcccactccagaacacttgccaggacttttggcaaatggtatgggaacagggaattgcaataattgcaatggtcactgccgaggaggaagggggacgagagaaatcctttcggtattggccccgactgggaagcagacataataccgtgacatacggcagatttaaaatcacaacacgatttagaaccgacagtgggtgctacgcaaccaccggccttaagatgaaacatctcttgactggccaggagcggacggtatggcaccttcagtacactgactggcctgagcacggatgcccagaggacttgaagggatttctgtcatatctggaggaaatccagagcgttaggcgccatactaactccaccagtgatcctcaatcccctaacccgccactgttggttcactgttcagcgggagtaggtaggactggcgtcgttatcctgtctgaaattatgattgcctgcctggaacacaacgaggtcttggatatcccgagagtgctggatatgctcagacagcaacgcatgatgttggtccagaccctgtgtcagtacacgttcgtgtatagagtgcttattcagttcctgaaatcttctcgcctgatttag

SEQ ID NO: 31700 - DNA, 1245 bp, Artificial Sequence
  Description of Artificial Sequence: Synthetic coding sequence
atgcagacattcctgaagggaaaacgcgtgggatactggctgtctgaaaagaagatcaaaaaattgaatttccaggcgttcgccgaactgtgccggaaaagaggaatggaggtggtgcagttgaatctatccagaccaattgaggagcagggacccctcgacgtgattatccacaagctcaccgacgttattctcgaagccgaccagaacgatagccagtccctagaactggtccatcgcttccaagagtatattgatgcacatcctgaaaccatagtactggacccgctcccagcaatccggacattgttggacaggtcaaaaagttacgaactaattcgtaagattgaggcctacatggaggacgatcggatttgtagtcccccattcatggaacttacttcactctgcggcgatgatactatgcgattgctggagaagaacggcttgactttcccattcatatgcaagacacgcgtcgctcacgggaccaatagccatgaaatggccatcgtattcaatcaagagggcctgaacgccatccagccgccttgtgttgtacagaactttatcaaccataatgcagtgctgtacaaggtatttgtcgtgggcgaaagctacaccgtggtgcaaagaccaagcctgaagaacttctcagccggaaccagcgatcgcgaatcaatcttctttaactcgcacaatgtcagcaagcctgagagcagctccgtcctgacagaactagataagattgaaggtgtgtttgagagaccaagtgatgaggtgattagggaattgagcagagcccttcgccaggccttaggagtgtccctgttcgggattgacattatcatcaacaaccagaccggtcaacacgcagtgatcgacataaacgcctttccaggctacgaaggagtcagcgagtttttcactgatctgctcaatcacattgctaccgtactgcagggccagagtactgctatggctgctacaggcgatgtagctcttctgcggcattctaaactgctggctgaacccgcagggggactcgtgggtgaacgaacatgcagtgcgtcacccggttgttgtggtagcatgatgggtcaagatgccccttggaaggccgaggccgatgcaggcggaacagccaaattgccccaccagagactcggatgcaacgcaggtgtttctccctcattccaacagcattgtgtcgcctcactcgctaccaaagcatcgtcccaatag

SEQ ID NO: 31701 - DNA, 2256 bp, Artificial Sequence
  Description of Artificial Sequence: Synthetic coding sequence
atgtccgaggaagagctgacgaaggcgatggagggcctggggatggatgagggtgacggagagggaaatattctacccattatgcagtccatcatgcaaaatctgctttcaaaagacgttctctacccttctctcaaagagattactgaaaaatatcctgaatggctgcagagtcaccgtgaatcactgccaccagaacaatttgagaaatatcaggagcagcactcagtcatgtgcaaaatctgcgagcagttcgaggctgagacaccaaccgacagcgagaccactcagaaggcccgattcgagatggtcctcgacctcatgcaacagctgcaagatctgggacatccgcctaaggagctagcaggggagatgcttacttggctctttttctgtggatcccagtgggtctacggaccctggctgacctatgttggctggctgcaacagacctctttcaagatgtcttccaaggggtcaagtaccgatggtagaaccgacctggccaatggaagtctgtctagctcacccgaagaaatgtccggggctgaagaaggtcgggagacgtcctctggaatcgaagtggaagcctcagatctttctctttcattgacaggcgacgatgggggacctaaccgcaccagcacggaaagcagaggcactgacaccgagagtagtggggaggacaaggattcagatagcatggaagataccggccactatagcattaacgatgagaatcgggtccatgaccgttcagaagaggaagaagaggaggaagaagaggaggaggaggagcagccacggagaagagttcagcgtaaacgggctaacagagaccaggattcctcagacgatgaacgcgcattagaagactgggtgagctctgaaaccagtgccctgccacggcctcggtggcaagccctgcctgctctgagggagcgggaactcgggtcatccgctcgattcgtgtatgaggcatgcggcgctcgggtgtttgtgcaacgcttccgcttgcagcacggcctggaaggacataccggttgtgtgaacactcttcatttcaatcagcgtggcacttggctcgccagcgggtctgatgacttgaaagtggttgtatgggactgggtcaggaggcagcctgtgctggattttgagagcggacacaaatccaatgtcttccaggccaagtttctgcccaattccggcgattcaacccttgcaatgtgcgcgagagatggccaggtaagagtggctgaactctctgcaacccagtgttgcaagaacactaagagagttgcacagcataaaggggcttctcacaagcttgccctcgaaccggattcaccgtgtacatttctctcagccggtgaggacgcagtcgttttcacaatcgatttgagacaggatcgccctgctagtaagctcgtagtgacgaaagagaaggagaagaaggtcgggttatacaccatctacgttaaccctgcaaatactcatcagtttgcagtgggcggaagggatcagtttgttcggatctatgatcagcgcaaaatcgatgagaacgaaaataacggggtgctaaaaaaattttgcccacatcatctggtgaacagcgagtctaaggccaatatcacctgcctggtgtactcccacgacggaactgagctcctggcgtcgtataatgacgaagacatctacttatttaatagctctcacagtgatggggctcaatacgtgaagaggtacaaaggacaccggaataatgctaccgttaagggggtcaatttttatggccctaagtccgaatttgtagtgagcggctccgactgcggccacatctttttgtgggagaagagttcttgtcaaattatccagtttatggagggagataaaggtggggtcgttaattgtcttgaaccgcatccacacctcccggtgcttgcaacaagcggtctggaccacgacgttaagatttgggcgcctacggccgaggccagtactgagctcactggactgaaggatgtaataaaaaaaaataaaagggagcgtgacgaagacagcctgcatcagaccgacctgttcgacagtcacatgctgtggttcttgatgcaccacttacgacagcggcgacaccatcgaaggtggcgtgaacctggagtgggcgcaacggacgccgacagcgatgagtctccttcctctagtgatacctccgacgaagaagagggtccggatcgcgtgcaatgtatgcccagttag

SEQ ID NO: 31702 - DNA, 1056 bp, Artificial Sequence
  Description of Artificial Sequence: Synthetic coding sequence
atgactctaaggctgctggaggactggtgtaggggcatggatatgaacccacgcaaggccctgctaattgctggcatcagccagtcatgcagcgtggcagaaattgaggaggcccttcaggcaggtctggcacctctgggggaatacagactgctggggcgaatgttcaggagagacgagaaccggaaggtggcccttgtcggtctgaccgctgagacaagtcacgccctggtccccaaggaaatccccggaaaagggggtatctggcgcgtcatttttaagccgccagatccagacaatacgtttctaagtagattgaatgagtttctggccggtgaagggatgacagtcggggagctgagtagagcgttaggccacgaaaacggaagcctcgatcctgaacaaggaatgattcctgagatgtgggccccaatgttggctcaggctctcgaggctctgcagcctgcgttacaatgtttaaagtacaagaaactcagggtgttcagcggaagggaatcacctgaaccaggagaggaagagtttggccgatggatgttccacacaacgcagatgatcaaggcttggcaggtgcctgatgtggaaaagaggaggcggctgctggagagcttacggggacctgcgttagacgttatcagggtgttaaaaattaataatcccctgatcacagttgatgaatgtctgcaggccctggaagaagtattcggagttacagacaatccacgcgaacttcaagtgaagtatctgaccacctaccagaaggatgaagagaaactcagcgcttacgtcctgagattagaacctctgctgcaaaagcttgtgcagaggggagccatcgaaagagatgcagtgaatcaggctaggctcgatcaagtgattgctggtgccgtccacaaaaccataagaagggagctgaacctccccgaggacgggccagctcctggcttcctgcagctgttggtgctaatcaaggattacgaagcagccgaggaggaagaggcactgcttcaggccatcctggagggcaactttacctag

SEQ ID NO: 31703 - DNA, 2394 bp, Artificial Sequence
  Description of Artificial Sequence: Synthetic coding sequence
atggccgtgcaggggtctcagcgtcggttgctcgggtctctgaacagcacgccgacagcaatccctcagctgggactcgctgcgaaccagactggggcacgttgccttgaggtttccattagcgacggccttttcctgagcctaggactcgtgtcacttgtggaaaatgctctggtggttgccactattgctaaaaataggaatcttcattccccgatgtactgtttcatctgttgtcttgctcttagtgacctccttgttagcggcagcaacgtcctggaaactgctgtcatcctgctgctggaggcaggggctctggtggctagggcagctgtgctgcagcagttagataatgtgattgacgtcattacgtgtagttccatgttgagcagcctatgtttcctcggtgccatcgcagtcgatagatacatttctattttctacgctcttcgctaccacagtatcgtcactttgccgagagccagacgtgcagtcgccgctatctgggtggcctctgtggtgtttagtactctttttatagcctattacgaccacgttgcagtgctgctgtgcctggtggtttttttcctggccatgttagtgttgatggccgtgctctatgtgcacatgctggcaagagcatgtcaacacgcccaggggatcgccaggctccacaagcggcagcgtccagttcatcagggctttggcctgaagggggcagtgaccttaactattctgctgggaatcttcttcctttgctggggaccattttttctgcatttaacactgattgtactgtgcccagagcaccccacatgtggctgcatctttaagaactttaatctctttttagcccttataatatgcaatgccatcatcgacccccttatctacgctttccattctcaagaactgcggagaaccctaaaggaggtcctgacctgttcatgttctcaggacagagctctggtcagttgggacgtcaagtccctggggggtagcgtgtgtcaggagttgctccctcagcaaccgcaggagaaaggactctgcgaccagaaagcctcatccacggctcttcagcgattgctgcagaaggagttttgggaagtgatctcggatgagcacggcatcgacccctctgggaattatgtgggggacagcgatcttcaactggaacgcatcagtgtgtactacaatgaggctagtagtcacaaatatgtccctcgagccatcctggttgatctcgagcctggaaccatggacagcgtgcgatccggagcattcggacacctcttccgacccgataattttatcttcggccagtctggagcaggaaataactgggccaagggtcattatacggaaggcgctgagctggtcgatagtgtcctagacgtcgtgaggaaggagtgtgaaaattgtgattgcttacaaggattccagttaacccacagcctgggagggggtacaggttcaggcatgggcacattgttaatctctaaagttcgcgaggagtaccctgaccgcattatgaacaccttttcagttgtgccgagtccaaaggtatccgacacagttgttgaaccatataacgccaccttatctattcaccagctagtcgaaaacactgatgagacatactgcattgataacgaggccctctatgatatatgtttcagaactttgaaactggcgacgccaacgtacggcgatctgaatcacctcgtcagcgcaactatgtctggcgtaacgaccagcttgcgattcccgggacagctgaacgcggatctgcgtaagctggccgtcaacatggtgccattccctagacttcactttttcatgcctggctttgccccactgactgccagaggaagccaacagtaccgcgcactgactgtgcccgaattgacacagcagatgttcgatgccaaaaatatgatggccgcatgcgaccctagacatggcagatacctcacagttgccacagtattccggggtcgtatgtccatgaaggaggtagacgaacagatgttggctattcagtctaagaatagtagctacttcgtggagtggatccccaataacgtgaaggttgctgtgtgcgacatcccacctaggggactgaagatgtctagcacctttatcggtaacagcacagcgatccaggagcttttcaaacgcatctccgagcagtttaccgctatgttcaggcgcaaggctttcctccattggtatactggagaaggaatggatgagatggaattcaccgaagctgagagtaacatgaacgacttagtttcagaataccagcaataccaggatgcaacagccgaagaagaaggcgagatgtatgaggatgacgaagaggagtccgaagctcagggacccaaatag

SEQ ID NO: 31704 - DNA, 99 bp, Artificial Sequence
  Description of Artificial Sequence: Synthetic coding sequence
atggccgaaagtagtagcgaatcggatcacttcagatgccgcgatcggctgtcaccctgggcggcaaggtcgacccatagggggaccaggagtctgtag

SEQ ID NO: 31705 - DNA, 453 bp, Artificial Sequence
  Description of Artificial Sequence: Synthetic coding sequence
atgacggacacccgcaggagagtgaaagtgtataccctgaacgaggacaggcagtgggacgatcgtgggactggccacgtgagctcaggttacgtcgagcggcttaaaggaatgtccctactggtgcgggctgagtccgacggttctctcctgttggaatccaagattaatcctaacacagcctaccaaaagcagcaggacacgctcattgtctggtctgaggccgagaactacgatctggccctgagctttcaggagaaggctgggtgtgacgaaatatgggaaaaaatctgccaggtacaaggcaaagaccccagtgtggacattacacaggatctagtcgacgagagcgaagaggaaaggtttgacgatatgtcctcgcctggcctggaacttcctagctgcgaactatcccggctcgaggaaatcgcggagttagtagccagctcctag

SEQ ID NO: 31706 - DNA, 504 bp, Artificial Sequence
  Description of Artificial Sequence: Synthetic coding sequence
atggactggaaagaggtcttgcgcagaagactcgcgacgcccaatacctgcccaaacaagaaaaaaagcgaacaagagctgaaggatgaggaaatggatctgtttaccaaatattatagcgaatggaagggcggacgaaaaaacacaaatgagttctacaagaccatcccccgtttctactatcgtctgcctgccgaagacgaagtgctactccaaaaattaagagaggagagccgagccgtcttcctgcaacgcaaatctcgcgagctgctggacaatgaagaactccagaacttatggtttttgctcgacaaacatcagacgcctcccatgatcggcgaggaggctatgataaattatgaaaacttccttaaggtaggggaaaaagcgggagccaagtgcaagcagttttttactgcgaaggtgtttgcaaaacttctgcacaccgactcctacggtcggatttcaatcatgcagtttttcaattacgtgatgaggaagtag

SEQ ID NO: 31707 - DNA, 507 bp, Artificial Sequence
  Description of Artificial Sequence: Synthetic coding sequence
atgcagactttcttgaaaggcaagcgcgtcggctattggctgagcgaaaagaagatcaaaaagctgaatttccaggccttcgccgagctgtgtagaaagcgcggaatggaggtggtgcagttaaacctcagccgtcctatagaggaacaaggaccattggatgtgataattcataaacttacagacgtgatcctcgaggccgaccaaaacgactctcagtccttggaactggtacataggttccaggagtacattgatgcgcacccagagaccattgttttagaccctctgcctgccattcgtactctgctcgatcgaagtaagagctatgagctaatccgcaaaatcgaagcatacatggaagatgataggatctgcagccctcccttcatggagcttacctccctatgcggggacgatacaatgcggctcctggagaaaaatggcctcacatttccgttcatatgcaagacccgcgtggcgcatggaactaatagccatgaatag

SEQ ID NO: 31708 - DNA, 822 bp, Artificial Sequence
  Description of Artificial Sequence: Synthetic coding sequence
atgccaggacttagctgcagattctaccaacacaaatttccggaggttgaagacgtcgttatggtgaacgtacgatccatagccgaaatgggcgcatatgtgagcctcctggaatacaataatatcgaaggaatgatcctgctcagtgagctaagtcgcagacgcataagatctattaacaaacttatcagaatcggcagaaacgagtgcgtcgttgtgattagggtggataaggagaagggttatatcgatctgagcaagaggcgcgttagtcctgaagaagccataaagtgtgaggacaagttcacaaaatccaagacagtttactctatattgagacatgtggccgaggtcttagagtataccaaggacgagcaactggaaagcttgtttcagagaactgcctgggtctttgacgataagtataaacgcccaggttacggagcctacgacgcctttaagcacgccgtttcggacccatcaatcctggattcattggatctgaatgaggatgaaagggaagtgttgattaacaacatcaatagacggctcacacctcaggctgttaaaatccgagccgatattgaagttgcttgctacggctacgaaggcattgacgctgtgaaggaagctcttcgcgcaggtttgaactgttctaccgaaaacatgccaattaaaatcaacctaattgcccctcccaggtacgttatgacgaccaccacactggaacgaactgaggggctgagtgtgctctcacaggcgatggccgtgataaaggagaaaatcgaggagaaaaggggagtcttcaatgtgcagatgtag

SEQ ID NO: 31709 - DNA, 2757 bp, Artificial Sequence
  Description of Artificial Sequence: Synthetic coding sequence
tgacggactaactcacgctttgttaaggttgtccttatgtctgccactattagttgcaaggaattcgcggattactttgctgtgcccgtacagaataaaatgaacccagcttacattttcgaggttgaaggaaaaccacatagtgtggaagagtactacctcaacgacttggagcatatacatcattcaaaacttagcccccacttactggaggaaccggtcatcaccaaggacatttatgaagttgctgtgtctctgatccaaatgttcgacgacctagatatgaaggaatccgggaacaaagcctggagcggagcgcagttcgtgcttgagagatcatcagtcctggttttcctgccaggtctgggggaaatcaactatatgcatgaactcctcacaagtttagtacacaagagactgcaagtctatcccctgcactcgtctgtggcactagaagaacagaacaatgtgttcctgtctcctgtacccggataccgcaaaattatcctgagcacgaacatcgcagagagctcagtgacggttcctgacgtgaagtacgtgatcgatttctgcttaacaaggaccctagtctgcgacgaagatactaattatcagagcctcaggttgtcttgggcgtctaagacgtcctgtaaccagcggaagggcagggctggtcgagttagccggggttattgttacaggctggtgcacaaagatttctgggacaactcgatccctgatcacgttgttccagagatgctacgctgtcctctgggaagtacgattctgaaggtgaaacttctcgatatgggtgaacctcgcgcactccttgcgaccgccctttctccgccaggactgtcagacatcgaacggactatactgctccttaaagaagtgggtgctttggctgtcagtggccagagggaagatgagaaccctcatgacggagagctgacattcctgggtagagtcctcgctcagttaccggttaaccagcagctggggaaactgatcgttcttgggcatgtgttcggatgcctcgatgagtgcctgattattgctgctgcactgtccttgaagaacttcttcgccatgccttttaggcagcacttagatggctataggaataaagtaaacttcagtggttcatccaaaagcgactgcattgctctggtggaggcctttaagacttggaaggcatgtagacagaccggcgagcttcggtacccgaaagacgagctaaactggggtagacttaattatatccagatcaagagaataagggaggtggccgagctctacgaagagctgaaaactcggatttcccagtttaacatgcatgtggactcacggcgtcccgtcatggatcaggagtatatttataagcagcggttcatattacaagtcgtcctggctggggctttttaccccaattattttacatttggacaaccagacgaagaaatggccgtcagggagctcgccggaaaggaccctaaaaccaccgtggttctcaaacatattcctccatatggattcctgtactacaagcagctgcagagcctgtttcgacagtgcggtcaggtcaagtcgatagtgtttgacggcgcaaaggcctttgtcgaattctcccgcaatcctaccgagaggtttaagacattgccagccgtctatatggccataaaaatgtcgcagctgaaggtgagtctcgaactgtcggtgcacagcgctgaagagatcgaaggcaaggtgcaggggatgaatgtttccaaactcaggaacacccgcgtcaacgtggattttcagaaacagaccgttgatcccatgcaggtgtcctttaataccagtgatcgatcacaaaccgttacagatttactgttaaccattgacgtaacggaggttgtcgaggtgggacacttttggggctataggatcgacgagaacaactccgaaatcctaaagaaactcacggccgaaattaaccagctcactcttgttccactgcccacacatccccacccagatctagtctgcttagcgccttttgccgatttcgacaaacagcgctacttcagagctcaggtactgtacgtgagtggaaattccgctgaggttttcttcgttgactacggtaataagagtcacgtggatctgcaccttttgatggaaatcccctgccagtttctggagcttcccttccaagccttggaattcaaaatatgtaaaatgcgaccaagcgccaagagtctggtctgcggcaaacactggtcagatggtgcatcacaatggtttgcttcgttggtaagcggctgcacactgctggtgaaggtcttctctgtagtccactcagtgttgcacgttgacgtctaccagtacagcggcgttcaggatgcaattaatatcagggacgtcctgatccagcagggctacgccgaactgactgaggaatcttacgaaagcaaggtgaatatcctgagagcagctataaataagttagtgtgtgacggaccgaacggttgtaaatgtctagggcctgagcgcgtcgcacagctgcaagatatcgccagacagaaactccttggcctattttgtcagagtaaaccgagagagaaaattgtcccaaaatggcatgagaaaccctacgagtggaaccaggtggatccaaaactggtaatggagcaagccgacagagagagttctcggggtaagaacaccttcctgtatcagctacataagctggtcgtacttgggacttag

SEQ ID NO: 31710 - DNA, 507 bp, Artificial Sequence
  Description of Artificial Sequence: Synthetic coding sequence
atggagaagctgtccgctctgcaggaacagaagggcgaactgaggaagcgtcttagctatacaacccacaagcttgagaagcttgaaaccgagtttgatagtactcgccactacctagagattgagttgcgcagggcacaagaggaactcgagaaagttactgagaagcttcgcaggattcagtcaaattacatggcactgcagaggattaatcaggagttggaggataagctctaccgcatgggccagcactacgaggaggagaagcgcgctctgtcacatgaaatcgtggcactgaactcccatctcctggaggccaaagtgacaattgataagctctcagaggataacgagctgtaccggaaggattgtaacctggctgcccagctgctccagtgcagccagacatatggcagggttcataaggtgagcgaactgccaagcgatttccaggagcgggtgagtctccacatggaaaagcatggctgcagcctaccatccccctag

SEQ ID NO: 31711 - DNA, 636 bp, Artificial Sequence
  Description of Artificial Sequence: Synthetic coding sequence
atggatatgggtaatcaacacccttccatctcgagattgcaagagattcagaaagaagttaaaagcgtcgaacagcaggtcattggattttcgggacttagcgacgataagaactataagaaactggaacggatactcacaaaacagttgtttgaaatagactccgtagatactgagggaaaaggggacatccagcaggctcgtaagagagcagcccaggaaactgagagactcctgaaggagttggagcaaaacgccaaccacccccacaggatagaaattcagaacatatttgaagaagctcagagtctggtccgcgagaaaattgtccctttctataacggtgggaattgtgtcaccgatgagttcgaggaaggaattcaggacattatcctgcggctgacccacgtgaaaacaggcggaaagattagcctgcgcaaagctcgataccacacactcacgaagatatgtgcagttcaggagattattgaagactgcatgaagaagcagccttctctccctctgtctgaagatgctcaccccagcgtggctaagatcaacttcgtcatgtgcgaggtaaataaagcccgtggagtgctaattgccctactgatgggcgtgaacaacaatgagtag

SEQ ID NO: 31712 - DNA, 2985 bp, Artificial Sequence
  Description of Artificial Sequence: Synthetic coding sequence
atgagccagtggacacccgagtataacgaactgtataccctcaaagtggatatgaaatcagagatcccgtccgatgcccctaaaacgcaggaaagtctgaaaggtattctgcttcatccggagcctatcggcgctgccaagtcgttccccgcaggtgtggaaatgataaactctaaggtgggcaacgaattctcccatctctgcgatgactcccaaaaacaggagaaggagatgaacgggaatcagcaagaacaggaaaagagcctggtcgtgcggaagaagagaaaaagccagcaagcaggaccttcctacgtgcagaattgcgtgaaagagaaccagggcatccttggactgcgccaacacttgggcacaccgtccgatgaggataacgacagttctttcagcgactgcctgagcagccctagcagttcccttcactttggcgattcagataccgtcactagcgatgaagataaagaagtaagtgtgagacatagccaaaccatactgaacgctaaaagcaggtcccactccgccaggtctcataaatggccgagaaccgagaccgaaagtgtgtccggactcctgatgaagaggccatgcctccatggctcttcattgcgcagactgccttgtagaaagagattcgtaaaaaacaattccagtcagcgcactcagaaacagaaggagaggatactaatgcagcgtaagaagagagaagtgctagcgagacgcaaatacgccctccttcctagttcatcttcttcctccgagaacgacttgagttcagagtctagttcatcctctagtactgagggcgaagaagacctgttcgtgagcgcttctgagaaccaccagaacaatccagccgttccatcggggtccatagacgaagacgttgtagttatcgaggcttcttctaccccacaagtaacagcaaacgaggaaatcaatgtgacctccactgactcagaggtggagatagtgactgtcggcgagtcctaccggtcaaggtccactctgggacattcacgatcccactggtcccaaggcagtagttctcatgcgtctaggccacaagagcctcgtaaccgaagcaggatctcgaccgttatccagcctctgcgccagaatgctgccgaagttgtagatctgaccgtagacgaggatgagcccacagtcgtccctacgactagcgcaagaatggaatctcaggcaactagcgctagcattaataactcgaacccatctactagcgaacaggcctccgatacagcttctgccgtcaccagcagccaaccgagtaccgtcagcgaaacatcagctactcttacctctaactctacaactggcacgagcatcggcgatgactccagaaggaccactagttccgctgtcacagaaactggaccgccagccatgccgaggctgccctcctgttgcccgcagcactctccatgcggagggtccagtcagaaccaccacgcacttggccatccacacacgtcttgtttccaacagcatgggcatcactttcagcatcaccaccatcaccaccacaccccacatcctgctgttcctgtgagtcctagcttctcagatcctgcatgccctgtagaaaggcctcctcaggttcaggcaccatgcggagctaactcgtcgtccggcacttcttaccacgagcagcaggccttgcccgtggacctgagtaattctgggatcagaagccacggaagcggtagctttcatggcgctagtgcatttgacccttgctgccctgttagtagttcgagagcagctatttttggccaccaggcagcagcagctgcaccgtcacagccgctctcctcgatagacggctacggctctagcatggtggcacagccacaaccacagcctcctccccagccgagtctatcctcttgtcgccattacatgcccccaccctatgctagccttactcgacccctccaccatcaggcttccgcatgcccccactcgcacggaaatcccccaccacaaacacagccgcctccccaagtcgactatgtgataccccaccctgtgcatgccttccacagccagatctcttctcacgcgacatcccatcccgtagctccaccaccccctacacacctcgcttcaaccgctgctccaatcccgcagcacctgcctcccacacaccaacccatatcgcatcacattcctgccacagcccctcccgctcagcgactccacccgcacgaggtcatgcagcggatggaggttcaacgaaggaggatgatgcagcaccctacacgcgctcacgagcgcccacccccacatcctcaccggatgcatccaaactacggtcatggtcatcatatacacgtaccccagactatgtctagccaccctcgacaggcaccagagaggagcgcctgggagctggggatcgaggctggcgtgacagccgctacatacacacctggcgctctgcacccccaccttgcacattatcatgctcctcctcgcctgcaccacttacagttaggcgcactgcctctcatggtgcccgacatggccggttatccccatatcagatacatcagttcaggcctggacgggacctccttccgcggaccctttaggggcaattttgaggagctgattcatctcgaagagagacttggtaacgtgaataggggggctagtcagggaaccatcgagagatgcacctatccacataaatataagaaggtgactaccgactggttctctcagaggaagctgcactgtaaacaggatggcgaggagggcacagaagaggacacagaggagaaatgtaccatctgcctgtccatcctggaagagggtgaagacgtcaggcgattaccctgcatgcacctgtttcatcaggtgtgtgtcgatcagtggctgatcactaataaaaagtgcccaatctgtcgggttgacatcgaagcccagttgcctagcgagtcctag

SEQ ID NO: 31713 - DNA, 1158 bp, Artificial Sequence
  Description of Artificial Sequence: Synthetic coding sequence
atggctcttccacacgattcaaatgaaacctcttatttactcccaccaaacaatgaggattgggggcgacagacaatccccgacttcgtatacggacagaaagatctcatggctgagggcattcagtggcctcggaacgctcccggaattcccgatgccctgccccagagcccattcgacgcagcgttgtgtagcgcttggaaacagcgggtggaactggggctcttcagatatcgactgagagaactgcagactcagatcctccctggggcagtgggtttcgtggcccagctgaacgtggagcgcggagttcagcgcaggcccccacagacgataaagtcggtgagacaggccttcgatcctgtccagttcaattttaacaagattcggcctggagaagtactcttccgcctgcatcgggaaccagatctaccaggaactctgcttcaggaggatattttagtcgtgatcaatgtgtcgcccctggaatggggacacgttctgctggtcccggagcctgcacgacagctgccgcaacggcttcttcccggtgccttaagggccggaatcgaggcggtactgctgtccctgcacccaggctttcgagttggatttaatagtctcggaggactggcttcggtgaaccatctgcacctgcacggatactatctcgctcatcgtctccccgtcgaacaggctccgagtgaaccactggacccaggcggacaccttcacttactccaagatctgcccgctcctggttttcttttttatacccgaggcccaggacctgatctggagtctttgattagccgtgtgtgtcgcgctacggactacctgaccgaccacgagatcgcacataatctgtttgtcactcgaggagcaccacctgggaagacttcgccaagctctgccctcaccggagtccgcgtgattctgtgggcaaggaagtcatcattcgggattaaagatggcgaggctttcaatgtggctttatgcgaattagctgggcatctgcccgtgaaaacttcacaggatttctcttccctgacggaagcggctgcagtcgcacttatccaggattgcaggttaccaccatcccaggccgaggatgtgcaggccgcacttgtggccctcatgtcccaggaggagcagtag

SEQ ID NO: 31714 - DNA, 7463 bp, Artificial Sequence
  Description of Artificial Sequence: Synthetic coding sequence
tgagaggaagaggaggatgatgacgacgaggaagaagaagttagtgaggtggaatcattcattctcgatcaggacgacctggagaacccaatgctcgaaaccgcgtcaaagctgcttctgtctggtacagcagacggtgccgatttaagaactgtggatcctgagacacaagctcggcttgaggcgctgttagaagccgctggaattggcaagctgtcaactgcagatggcaaagccttcgctgacccagaggtgctgagacgccttacatcatctgtgtcctgtgcactcgacgaagccgctgcagcgctaacaagaatgcgcgcagaaagtaccgctaatgccggacagagcgataaccgctctctagcagaggcttgttctgagggtgacgtaaatgctgtacgcaaattgcttatagagggaaggtccgtgaatgaacacactgaagaaggagagtctctgctctgtttagcatgcagtgccggatattacgagctggcgcaagtgctgctggcaatgcatgcgaatgtggaggaccgcggtattaaaggcgatattacgcctctaatggccgcagccaacggaggccatgtcaagattgtgaagcttctgttggcccataaagccgacgttaatgcccagagttccacggggaacacagctctaacctacgcctgtgccggagggtacgtggatgttgttaaggtgcttctggagagcggagcctccattgaagaccacaacgagaacggccatactcctctcatggaggcaggcagcgcaggacacgtagaggtcgcccgactgttgttggaaaacggagcgggaatcaacacgcattcaaatgaatttaaagagagcgccctaaccctagcctgctacaaggggcatctggagatggtccggttcctccttgaagccggtgcagatcaagaacacaagacggatgaaatgcataccgccctgatggaagcctgcatggacgggcacgtggaggtcgcccgactcctgctggattcaggagctcaggtgaacatgcccgctgacagctttgagagtccgttgaccctggccgcttgcggcggacatgtggagctcgctgccctgttaattgaaagaggagccagcctggaagaagttaacgacgagggctatacccctttaatggaggctgcgagggagggccacgaggaaatggtagcactcctcctgggacaaggcgctaacatcaatgctcaaacagaggagacccaagagaccgccctgacgctggcgtgctgcggcggattcctggaagtggctgactttttgattaaggcaggcgctgatatcgaacttggatgttcaactccgctgatggaggcggctcaagaaggccacctcgaattggtaaaatatttgctggcagctggcgctaacgtgcatgctaccactgctaccggggacacagcactgacttatgcctgcgaaaatggacatactgatgtcgccgacgtgcttctgcaggctggagcagacctggaacacgagtcagaaggaggacgcacccccttaatgaaggcagctcgagctggccacgtctgcaccgttcagtttctgattagcaagggagctaacgttaataggaccacggcgaacaatgaccacacggttctttcacttgcatgtgctggaggtcatctggctgtcgtggagctgttgctggcccacggcgcagatccgacacacaggcttaaagatggatcaacaatgttgattgaggcggctaaaggtggccacacctctgttgtatgctatctgttggactacccaaataacttactttccgcccctccccctgacgttacgcaactgaccccaccaagccacgaccttaacagagctcccagagttcccgttcaggctctgcccatggtggttcccccacaggaacctgataaaccacctgcgaatgttgctacgacgctcccaatacggaataaagctgcgagcaagcaaaaatcttcttcacatttgcctgccaacagccaggacgtgcaaggttacataaccaaccaatctcctgagtcgatcgttgaggaggctcagggaaaattgacagagctggaacagcggatcaaagaagctattgagaagaacgcacagctgcagtcgctggaacttgctcatgcagatcagcttacaaaggagaaaatagaggaactgaataagaccagggaagaacaaatccaaaagaagcagaagatactggaggagctgcaaaaagtcgaacgcgaactgcaactcaagacacagcagcagctgaaaaagcagtacttagaggtaaaggctcagcgcatacagctgcaacagcagcagcagcaatcatgccagcatctgggcctgctgactcctgtgggcgtcggcgagcagctgagcgagggggactacgcccgattacaacaggtggatcctgtgttactgaaggacgaaccccaacagacagccgctcagatggggtttgctccaatccaaccactggccatgccccaggccctgcctctagcagctggacccttgccccctggctccatcgccaacctcaccgagctgcagggtgtgattgtcggccagccagtattaggccaagcccagcttgcaggcctgggtcaggggattttaaccgagacgcagcagggcctaatggtcgctagccccgctcagactctaaacgatacactggacgatatcatggcagtatcaggaagggcatcagcaatgtccaatacaccaacgcacagcatagccgcatctatctcacaaccccaaaccccgaccccatcacctataatatcccctagtgctatgctgcctatataccctgcaatcgacattgatgctcagaccgagtcaaaccacgacaccgcactcacactggcctgtgcaggcggacacgaagaacttgtccagaccctgctggagcgcggagcctccatcgaacaccgcgacaaaaagggctttacacccctgattctcgccgctacggcaggacacgtcggcgtggtggagattttgctagataacggggcagatatcgaggcacaatcagagaggaccaaagacacaccgttgtcattggcttgttcggggggaaggcaagaagtggttgaattgcttctagcgagaggcgcaaataaagaacatagaaatgtttcagattacactccattatcacttgccgcttctgggggttacgttaacatcattaagatactgcttaatgctggcgctgagattaactccagaaccggatccaaattgggcattagcccactcatgctggcagctatgaacgggcataccgctgctgtaaaattgctcctggatatggggtccgatatcaacgcccagatcgagaccaatcggaacaccgccctaacactcgcctgtttccaggggaggacggaggtggtgagcctgttattagatagaaaggctaacgtggagcaccgcgctaagactggccttacacctctaatggaggcagcgagcggcggttacgccgaggttggtagggtcttgcttgacaaaggagccgacgtgaacgctccacccgtcccctcctctcgcgacacagctttgactattgctgccgacaaaggccactataaattttgtgaacttctgatcggcaggggggcacacatagatgtgcggaataagaaaggtaatacccccctttggctggcagctaacgggggacacctcgatgtcgtccagctgttagtccaggcgggagccgatgtagatgcagctgataaccgcaagatcactcccctgatggccgcatttcgcaaggggcatgtcaaggttgtaaggtatttagttaaagaggttaaccaattcccaagtgacagtgagtgcatgcgatatatcgctactataactgacaaggagatgctcaagaagtgccacctttgtatggaaagtattgtacaggcgaaggataggcaagccgcagaagcgaacaagaatgccagcattctcctggaagagctggacctcgagaagctgcgcgaggaatcccggcgactggctctcgcagccaagcgcgaaaagcggaaggaaaaacgcaggaagaagaaggaagaacagcgcagaaagctggaggagatcgaggccaagaacaaagaaaacttcgaacttcaggccgcacaggagaaggaaaagctcaaggtggaagatgagcctgaagttctgacggaaccacctagcgccaccaccactactaccataggtatcagtgctacctggacgaccttggctggctcccacggcaagagaaacaacaccattacaacgacgtcttctaagagaaagaaccgcaagaacaagatcacacctgaaaacgtgcaaatcatctttgacgacccattacccatcagctactctcagcccgaaaaggtcaatggtgagagcaaaagcagctctacgtcagaatcaggcgactcagacaacatgcgaatctctagctgctccgatgagtcgtcaaacagcaattctagtaggaagtctgacaatcacagcccagcagttgtcaccactaccgtgtccagtaaaaaacagccttcggtcctggtcactttccccaaagaagaaagaaagtccgtgagtgggaaggcctccatcaagctgagcgagactataagtgagggcacttccaactctctatctacctgtactaaatccgggccttccccgctgtccagccctaatggaaaactcactgtggcatcccccaagcgaggccagaagcgagaagagggctggaaagaagtggtgagacggtccaaaaaagtgtcggtgcccagtaccgtaatcagtcgggtgattggaagaggcggatgtaacatcaacgccatacgggagttcacaggtgctcacattgacattgacaagcagaaggataagactggggaccgaataattacgatccgcggtggcaccgagagcacgcgccaggccacacagctgatcaacgctctgatcaaagatcctgacaaggagatagatgagctgattccaaagaataggctgaaaagtagctccgctaatagcaaaatcgggagctctgcccctacgactacagcagcgaacacatctctgatggggatcaaaatgacaactgtagccctctcgtcgacctcacaaaccgccaccgcactgacagttcccgctatatccagtgctagtacccacaaaaccattaagaaccccgttaataatgtgcgccctggctttcctgtgtcacttcctttggcttacccccctccgcagttcgcccacgcgctcctcgcagcccaaacgttccagcagatcaggcccccacgcctgccaatgacacactttgggggtacttttcctccggcacagagtacctggggaccctttcccgtgagacctcttagccctgcaagagcaacaaatagccccaagccccacatggtgcctcgacacagcaatcagaactcttcagggtcccaggtcaatagcgcaggaagcctgacctcatctcctaccactacgacatcctcttcagctagtactgtccctggcacttctaccaatggatcccctagttcccctagtgtgaggcgacagctgtttgtcacagtggtcaagacctccaacgctacaactacaacggttaccacaacagctagtaacaataacaccgcccctacaaacgcgacctaccccatgccaaccgccaaagaacattaccccgtgtcaagcccctcgtctccttcgccacccgcacaacccggtggcgtgtctcgcaattctccactcgattgcggctcagcctcccccaacaaggtggccagctcctctgaacaagaggcaggctctccacccgtggttgagacaactaatacacggccaccgaatagttcttctagctcgggcagctctagcgcacacagcaatcagcagcagccgcctgggtctgtgtctcaagaaccaaggcctccattgcagcaatcccaggtccctccgcctgaggtgcgaatgactgtgccacccctggccacctccagtgctcccgtcgctgttccatcaacagcccctgtgacgtacccaatgccccaaacacctatgggttgtccacagcccactccaaaaatggagaccccggcaattcgtccgccacctcatggtacaactgcccctcacaagaattcagcctccgtccaaaactcaagcgtggccgtgctgtcagtgaatcatatcaagcgccctcattccgtccccagctcagtccaactacctagcacactttccacccaatcggcttgccagaactccgttcacccggctaataagcctatcgccccaaacttctcggctcctctgcctttcggccctttcagtacactatttgagaatagcccgacatctgcccacgccttctggggcggatctgtagtgagctcacaatcgacgcctgaatcaatgctgtctgggaagagtagttatctgccaaactctgatcctctgcaccagtccgataccagtaaggctcctggcttccgccctcctttacagcggccagccccatctccgagcggaattgtgaatatggactctccttacgggagtgtgacaccatcctcaacacacttggggaatttcgcttccaatatcagcggcggacaaatgtatggtcctggcgcacctttggggggagcaccggctgctgccaacttcaatcggcagcacttctctcctctgtccctacttacaccatgttcaagtgccagtaatgactcaagtgcccagtctgtttcctcgggcgtgcgtgccccttcccctgcccctagctcagtgcctctagggtccgagaaaccaagcaacgtgtctcaagataggaaggtccctgtgcctatcggtacggaacgctctgcaaggatccggcaaacagggaccagtgccccaagcgtgatcggaagcaacctatcaacttcggttggtcactctgggatttggtcatttgaaggaataggcggtaaccaggacaaagtcgattggtgtaacccaggcatgggcaatcccatgattcatcggcctatgagtgatcccggtgtgttctctcagcatcaggccatggagagagactccactggcatagtcaccccttctggaaccttccatcaacatgtccccgcaggctatatggatttccctaaagtaggagggatgccattttccgtttacgggaacgccatgatcccgccagtagctccaatccccgatggcgctggaggccctatttttaatggccctcatgccgctgacccatcctggaacagcttgatcaaaatggtatcaagcagcaccgaaaataacggacctcagacggtatggactggtccatgggccccacacatgaatagtgtccacatgaaccaactgggtta

SEQ ID NO: 31715 - DNA, 33 bp, Artificial Sequence
  Description of Artificial Sequence: Synthetic coding sequence
atggccctcccccacgactcaaatgagacctag

SEQ ID NO: 31716 - DNA, 462 bp, Artificial Sequence
  Description of Artificial Sequence: Synthetic coding sequence
atggcaaccatgattcccccagtcaaactgaagtggctagagcatctcaatagctcgtggattactgaggacagtgagtccattgctaccagagaaggagtggccgtgttgtacagcaagctggtgtccaacaaggaggtagtcccactgccgcagcaggtactgtgtctgaaaggcccacaactgccagatttcgaacgagaatcacttagcagtgatgagcaggatcattacctcgacgccctcctttctagccagctggccttggctaaaatggtctgctctgactccccctttgccggtgctcttcgcaaaagactgctggtgctgcaaagggtcttctacgccctgtctaataaatatcacgataagggaaaggtcaagcagcagcagcactcacctgagtccagcagcggcagtgccgatgtgcactctgtttccgaacggccacgctcttcatag

SEQ ID NO: 31717 - DNA, 111 bp, Artificial Sequence
  Description of Artificial Sequence: Synthetic coding sequence
atgctacctcccaaacacctttccgcaacaaagcccaagaagagttgggctcccaatctttacgagctggattctgaccttactaaagagcctgacgtgatcatcggctag

SEQ ID NO: 31718 - DNA, 315 bp, Artificial Sequence
  Description of Artificial Sequence: Synthetic coding sequence
atggcgcagagtggcggagaggccaggcccggtcctaaaaccgctgtgcagatccgggtcgcgatacaggaagctgaagatgtcgacgagctggaggacgaggaggagggggcagagaccaggggtgcaggggatcctgcccgatatctgtcccccggttgggggtcagctagtgaggaagagccgtcacgcggtcacagaaccgcacagctgccatggctcgagtcgcagcaggtattttctctcaagccatttctgctgccaacagggattgaactgactccggaaaacccgtggggttcatccgtcagttag

SEQ ID NO: 31719 - DNA, 645 bp, Artificial Sequence
  Description of Artificial Sequence: Synthetic coding sequence
atggctctgccccacgattcaaatgaaactagttatttactgcctccaaacaatgaagactggggtagacagacgatccccgactttgtatacggacagaaggatcttatggccgaggggatccagtggcctcgcaatgcccctggcatccctgatgcgctgccccaatccccattcgacgcggctctttgcagcgcatggaaacagcgggtggagctgggtctgtttcgttacaggctacgggagctccagacccagatcctgcccggagctgtggggtttgtggcccagttgaacgtggagcggggagtgcagcggaggccccctcagaccattaaatcggtacgacaggcctttgacccagtgcaatttaattttaataagattcggcctggggaggtcctttttcgactgcacagagagccagatctccctggaacattgctgcaggaggacattctggtcgtcataaacgtctccccactggaatggggacacgtcctgctggttcctgaacctgctaggcagcttcctcagagactgctgcctggagcgctccgcgcagggatcgaagcagtgttgctgtccttgcatcctggcttcagggtggggttcaatagcctgggcggtctggcctccgtttag

SEQ ID NO: 31720 - DNA, 2988 bp, Artificial Sequence
  Description of Artificial Sequence: Synthetic coding sequence
atgtcacagtggacccccgaatacaatgagctatatactctgaaagttgatatgaagtcggaaatccccagcgacgcacccaaaacccaagagagcctgaaagggatactgctacaccccgaacccattggagccgcaaaatcgtttcccgctggggttgagatgattaactccaaggtgggtaatgaatttagccatttgtgcgatgatagccaaaagcaggaaaaggaaatgaacgggaatcaacaggagcaggaaaaatccctggtggtgaggaagaagcgtaagtcacagcaggcaggtccatcatacgtgcagaactgcgttaaggagaaccagggcattctaggcctgagacaacaccttggtacccccagcgatgaggataatgatagcagcttttctgactgcctcagctcccccagctctagcctgcacttcggagatagcgacacagttacttcagacgaggataaggaagtcagcgtgagacactcgcagacaatcctgaacgctaagagtagaagccacagcgcaagatctcacaagtggcctcggacagagacagagtccgtctctggattgctgatgaaaaggccatgtctccacgggtcctctctcagaaggctgccatgtaggaaacgattcgtaaagaacaacagcagccagagaacacaaaagcagaaagagaggatcttaatgcaaaggaaaaagagggaagtactggccaggaggaagtacgccttgctcccttccagtagctctagttcagagaacgatttgtcctccgaaagctcttcttcatcctctaccgaaggagaagaagacctgttcgtaagtgcaagtgagaaccatcagaacaaccccgctgtaccgagcggtagcattgatgaagacgtagtggtcatagaggcatctagcacacctcaggtcacagccaacgaagagatcaacgtcacctccaccgactcagaagtggaaatagttacggtcggcgagtcgtaccgctctagaagcactttaggccacagtcgctcgcactggagccagggctcttcgtctcatgcgtctaggccccaagagcctaggaaccgcagccgcatctccaccgtgattcagccacttcgacagaacgccgcagaagtggtcgatctgactgtagacgaggatgaacctacagtggtgccaacaacctcagcaagaatggagtcccaagcaaccagtgcatccatcaataactccaacccatccacaagtgagcaggcctccgataccgcatccgctgtgacgtcttcccagccctctacggtctccgagacgtctgccacactgactagtaactccactacaggaacgagtatcggggatgacagtaggcggactactagctccgcagtaacagagactggccctcccgctatgcctagactgcccagctgttgtccacagcatagtccatgcggtgggtctagccagaaccaccacgccttaggccatccccacacttcttgtttccaacagcatggccatcacttccagcaccaccaccatcaccaccatactccccatcctgctgtgcccgttagcccaagtttttcagatccagcatgtccagttgagaggcctcctcaagtgcaggctccgtgcggcgcaaacagttccagcggcacatcgtatcacgagcagcaggctttgcctgtggatctcagtaacagcggtattcgcagccacggtagcgggtcctttcatggcgcatccgcattcgacccctgctgtcccgtgagctctagtagggcggctatcttcggacatcaggctgccgctgcagctccgtcccagcctctgtcatccatcgatggatacggatcttctatggtcgcccagccccagccccagcccccacctcaaccgagcctgagcagttgtcggcactacatgccgccaccctatgcttcactgacgaggccactgcatcaccaagccagcgcctgtccgcactcccacggcaacccccctccgcagacacagcctccaccccaggtggactatgtgataccgcatccagtgcatgctttccattcacagatctctagccatgcaacatcgcacccggtggccccaccaccccctacgcacctcgcctccactgcggcacccattccccaacacctaccccctacccaccagcccatcagtcatcacattcccgctaccgcccctcctgctcagaggctccacccacacgaagtgatgcagcggatggaagtgcagcgtcgaagaatgatgcagcatcctacaggcctcttcgtgttctgtgtctcgcgcagagcccatgagcgacctccaccccatccacaccgaatgcaccctaattacggacatggacaccacatccatgtcccacagacgatgtcaagtcacccaagacaggcgcctgaaaggagcgcatgggaactcggaatagaggcaggggtgaccgcggcaacatacacgccaggggcactacatccgcacctggctcactaccatgcccctccacggttgcatcacctgcagttgggcgctttgcctctgatggtgccggacatggctggttatccacacatcaggtatatatcctccggcctggatgggacaagcttccggggaccatttagaggaaatttcgaggagctcatccacttggaagaacgcctgggcaacgtgaataggggagcttcgcaggggactattgaacgctgtacttacccccacaagtataagaaaaggaagttacattgtaagcaggatggagaggagggtactgaagaagacacagaagagaagtgcacgatctgtctttcaatacttgaggagggggaggacgttagacgactcccttgcatgcaccttttccatcaggtctgcgtagaccaatggcttattaccaacaagaaatgcccgatttgtagagtcgacatcgaggctcagctacctagcgaatcctag

SEQ ID NO: 31721 - DNA, 1851 bp, Artificial Sequence
  Description of Artificial Sequence: Synthetic coding sequence
atggcaggcggtaggggcgctcccggtcgaggccgagatgaacctccagaatcttacccacagagacaggatcacgagctgcaggctctcgaagccatctacggcgctgatttccaggacctccggccagatgcgtgtggcccagttaaagagcctcccgagattaatctggtgctgtatccacaagggctgactggagaagaagtctacgtgaaggtggacctccgggttaaatgccctcctacctatcccgacgtggtgcccgagatcgagctgaagaacgccaagggcctgagcaatgaatcggtcaaccttttgaagagtcggctcgaggagttagcgaagaagcattgtggagaggtcatgatttttgagttggcctaccatgttcagagcttcctcagtgagcataacaaaccccctcccaagagctttcatgaagagatgctggaaagacgggctcaagaggaacagcagcggttactggaagctaaacgcaaagaggaacaagagcagcgggaaattctgcatgagatccagcgtcgcaaggaggaaattaaagaggagaagaaaaggaaggaaatggccaagcaggagcgcttagaaatagcatccctttccaaccaagaccatacgagcaaaaaggaccctgggggtcaccgaaccgctgccatactccatgggggaagccctgatttcgtcggcaatggaaagcaccgagccaacagctctggtcggagcagacgagagcgacagtattccgtttgtaactctgaagattctcccggatcctgtgagattctttacttcaatatgggcagtcccgatcagttgatggtgcataaagggaagtgtatcggaagcgatgagcagttaggaaagcttgtttataacgccttggaaaccgcaacgggcggattcgtcctattgtatgagtgggttttacaatggcagaagaagatggggccttttctgacatctcaggaaaaggaaaagatcgataaatgtaagaaacagattcagggcacagaaacagagtttaactcactagtcaaactatcacatccaaatgtggtgaggtaccttgctatgaatctgaaagaacaggacgattcaatcgttgtcgacattttggtggaacacatctctggtgtgtccctcgccgctcacctgagtcatagtggcccaattcctgtccaccagctacggagatatactgcgcaacttctttcagggctcgattatctgcacagcaattctgtggtgcataaagtgctgtccgcgagcaacgtcctcgtagacgcagaaggaacggtgaagatcaccgactactcaatatcgaaacggttggcggatatctgtaaagaggacgttttcgaacagacgcgggttaggttcagtgataacgctcttccctacaaaactggcaaaaagggggacgtatggcgcctaggtcttctcctgctgagcctctctcagggacaggagtgcggtgagtacccggtaacaatcccctcagacctacccgcagacttccaggatttcctcaagaagtgtgtctgtttggacgataaagagagatggtcaccccagcagctgctgaagcatagttttattaacccccagccgaagatgcccctggtcgagcaaagcccagaggattccgaggggcaggattacgtagagactgtgatcccatctaacagactgcctagtgccgctttcttctcagaaacacagaggcagtttagtaggtactttatagagttcgaagagctgcagctcctcgggaagggagcttttggtgctgtgattaaggtgtggtatcgagttataccgtctcccctgtag

SEQ ID NO: 31722 - DNA, 396 bp, Artificial Sequence
  Description of Artificial Sequence: Synthetic coding sequence
atgtcacagtggacccctgaatacaacgagctgtatacccttaaggtcgatatgaagtctgaaattccttctgacgccccaaagacacaagaaagtctgaaaggcattctcctccatcccgagcccataggtgccgctaagtctttccctgccggagtcgagatgatcaactcaaaagttggaaatgagttttctcacctttgtgacgattcccagaagcaggaaaaggaaatgaacggcaaccagcaggagcaggagaaatccttggttgtgagaaagaagagaaaatcacaacaagcgggacccagctacgttcagaattgcgtgaaggagaaccagggcatcctaggtttgcgccagcacttagggacaccatctgacgaagataatgactag

SEQ ID NO: 31723 - DNA, 1863 bp, Artificial Sequence
  Description of Artificial Sequence: Synthetic coding sequence
atggcgccagacagcgacccattccccgagggccctctgctgaaattgctgccactagatgccagagatcgaggcacccaaaggtgccggctcggtccagccgctttacacgcacttggggctcggttgggctctgccgtaaaaatctcactcccagacggagggtcctgcctttgcactgcttggccccgaagagacggggcagacgggttcgtgcaactggaccctctgtgcgcaagtcccggagcggctgtcggtgcctcccgtagtagacgctcgctctccttaaaccgactgctactggtaccctgcccacccctgcgaagggtggcagtgtggccagtgctccgagaaagggccggagcacccggagcccgaaataccgccgctgtgttagaagcagcccaggagctcctgcggaacagaccgatctccttgggccacgtggtagttgcaccacctggagcaccgggactggtggccgctctgcacattgttggcggtacccccagccccgatccagcaggcctggtcacaccccgaacccgcgtgtcactagggggtgagccacctagcgaagctcagccccagccagaggtacctctggggggtctgagtgaagctgcggacagtcttcgggagctgctccggttgcctttgcgctatccgcgagccttgacagcactcggactcgccgtcccaaggggcgtactgttggccggtcccccaggggtgggcaagacccagcttgtgcgggctgtcgcacgcgaggctggggctgaactccttgcggttagtgctcccgcactgcagggatcgcgtcctggcgagactgaggagaacgtgaggagagttttccaacgggctcgcgaactggcatccagaggcccatccttactgtttctggacgaaatggacgctctctgtccccaacgtggatcccgggctccggagtccagggtcgtggcacaggttctgacccttctggacggggcttccggagatagggaggtcgttgtggtgggtgctacaaaccggcctgacgccctcgaccccgctcttagaagacccggtagatttgatcgggaagtggttattggcaccccgacacttaagcaacgcaaggaaatcctccaggtgattactagcaaaatgccaatttcatctcatgttgacttgggacttctcgcagaaatgacggtgggctacgtgggggctgacctgaccgccctttgtcgcgaggccgctatgcacgccttgctgcatagcgaaaagaaccaagacaaccctgttatcgatgaaattgacttcttggaggccttcaaaaatatccagccctcttctttcaggtctgtcatcggcctgatggacataaagcccgtggactgggaggaaatcggtggactggaggacgtgaagctgaagttgaagcaatctattgagtggcctctgaagtttccctgggaattcgtgaggatgggactgacgcagccaaagggagtccttctgtacggaccacccggatgcgccaagacaactctcgtcagagcattggcaacatcatgccattgctccttcgtctccgtgtctggtgccgatctgttcagcccctttgtcggcgatagtgagaaagtactgagccagatatttaggcaagccagagccagcaccccggcaatactgttcttggacgaaattgacagtatcctgggagccaggtcagcaagcaagactggctgcgatgtccaagagcgggtcctgtccgtgctcttgaatgaacttgacggggtgggccttaaaacaatagaacggcgaggaagtaagtcgagccagcagggaaaatacaaagagctgaagaagtag

SEQ ID NO: 31724 - DNA, 4767 bp, Artificial Sequence
  Description of Artificial Sequence: Synthetic coding sequence
atgctaccaccgaagcatttgtcagcgaccaagcccaagaagtcctgggcccctaatctgtacgagctcgattcggatttaacaaaggagccagacgtcatcattggcgaaggacccacagactccgaattttttcaccaacgattccgaaatttaatctacgtagaatttgtcgggcctcgcaagactttgataaagctccgcaacttgtgccttgattggttacagcccgaaacacgtacaaaggaggaaattattgaactcttggtcctggaacagtacctgacgataattccagagaagctcaaaccatgggtgcgggcaaagaagcccgagaattgcgaaaagctcgtcacactgctggaaaactacaaggaaatgtaccagccggaggacgataacaacagcgatgtcacgtccgacgatgacatgacaaggaaccgacgggagtcttccccgccacactcagttcacagcttctcagacagggactgggacaggcgcggtcgctcccgtgatatggagcctcgtgatcgatggtctcacacaagaaaccccagatccaggatgccccctcgcgatctgtcgctgcctgtggtagctaaaacttctttcgaaatggacagagaagacgaccgcgactccagggcatacgaatctaggtcacaagacgccgaatcatatcagaacgtcgtggacttagctgaggatcgcaagcctcataacaccattcaggacaacatggagaactatagaaagttactcagcctggtccagctggcagaggacgacggccacagtcacatgacccagggccatagttcacgctcaaagaggtcggcctatcctagcaccagcagaggccttaagaccatgcccgaggcgaaaaagtctacccatcgaagagggatctgcgaggacgaaagtagtcacggggtcattatggaaaagtttatcaaggatgtgagtcgtagttctaaatcgggtcgagccagggagtctagcgacagatcacagaggttccctagaatgagcgatgataactggaaagatattagcttaaataagcgtgagtcggtaatacaacaaagggtatatgaaggcaatgcttttagaggtggatttcgattcaactccacgttggtgagccgtaagcgggtgctcgaaagaaaaagaaggtatcactttgacacagatggaaaaggctccatccatgatcagaagggatgccctcgaaagaaaccttttgagtgtggctcagagatgcgaaaagctatgagtgtcagttccctctctagcctgagtagcccaagctttacagagtcacagcccattgacttcggggctatgccttatgtttgcgatgaatgcgggcgatccttctcggtgattagcgaatttgtcgaacaccagattatgcacacacgcgagaatctgtatgaatatggtgaaagcttcattcactctgtagccgtgtctgaggtgcagaagtcccaggtgggtggcaagcgtttcgaatgcaaggattgcggagaaacgttcaataagagcgcagcacttgctgaacatcgcaagatacatgccagaggctacctcgtagaatgtaagaatcaagagtgcgaggaggcttttatgccctcacccactttcagcgaacttcagaagatctacggaaaggacaagttctacgaatgtcgggtttgtaaggagacatttttgcactcaagcgccctaatcgagcatcagaagatccattttggagatgacaaggataacgaacgtgaacatgagagagaaagagagagagaaaggggagaaacctttcgtcccagccctgctctcaatgagttccaaaaaatgtacggtaaggagaagatgtacgagtgcaaagtttgcggggagaccttcttacattcttccagcctgaaggagcatcagaagatccacacaaggggtaatccatttgagaataagggtaaagtgtgcgaggaaacatttatccctggtcagtctttaaagaggcgccagaaaacttataataaagagaagttgtgtgactttaccgacggtagagacgctttcatgcaaagtagtgaactgtccgagcatcagaaaatccacagccgaaaaaatctgttcgaaggacgcggatacgagaaaagtgttattcactccggaccctttacagagagccaaaaaagccatacaattacacggcctctggagagcgacgaagacgaaaaagccttcactatctcatctaacccgtatgaaaaccagaagattccgaccaaggaaaacgtgtacgaggcaaagagttacgaaaggtccgtaatccacagccttgcctccgtcgaagcccagaaatcccattccgtggctggtccctctaagcccaaggtgatggccgagagcactattcagtctttcgacgccatcaatcatcagcgtgtaagagccggaggcaataccagcgagggtagagagtactcaaggtccgtaattcactcacttgttgctagcaaacctccacgctcacacaatgggaacgaactcgtggaatcaaacgaaaaaggtgagtcctcaatctacattagtgatctaaatgacaagaggcagaaaatccccgctagagaaaacccttgtgaagggggaagcaagaatcgcaactatgaggactcagtgatccagagcgtctttcgtgcaaagccacagaagtcggtacctggggaggggagtggggaatttaaaaaagatggagaattctcagtgccttcttccaacgtgagggagtaccaaaaggcacgcgcaaaaaaaaagtacattgaacatcgcagtaatgagacgtcggtgatccacagcctgccattcggcgaacagacattccgaccaaggggcatgctgtatgagtgccaggagtgtggagagtgttttgcacattcttcggatctgaccgagcatcagaagatccatgatagggagaaaccctccggtagccgcaactacgagtggagcgtaatcagatcactggctccgacagaccctcaaacatcatacgcccaggaacagtacgcaaaggagcaggctagaaataaatgtaaggacttcagacagttctttgccacatctgaggatctgaataccaatcagaagatctacgatcaggaaaaatcccacggagaagagtctcaaggggaaaatacagacggcgaggaaacccactcggaggaaactcatggccaagagaccattgaggatccagtgatccagggatctgacatggaagatccacagaaggatgaccccgacgacaagatctacgaatgcgaggactgcggactcggcttcgtggatctcaccgacctgactgaccatcaaaaggtacattcccgcaagtgcttggtggactcgcgggagtatacccactcggttatacatacacattctattagcgagtatcaaagagactataccggggagcaactgtatgagtgtccaaagtgcggagagtcctttattcacagcagttttctgtttgagcaccagcgtattcacgaacaagaccagctctattctatgaaaggatgtgatgatggattcatcgctctgctgcccatgaaacccaggaggaacagagcagccgaaagaaaccccgctctggcagggtcagccatcaggtgccttctatgtggacaagggtttatacattcaagcgccttgaatgaacacatgaggctacaccgggaagacgatcttttagaacagtctcagatggctgaagaggccattattccaggcctggccttaaccgagttccagagaagccaaactgaggagcgcctcttcgaatgcgctgtttgtggggaatccttcgtcaatcccgctgagctcgctgaccatgtgactgtgcacaagaacgagccctatgaatatggcagctcatatacacacacctcattccttactgaaccccttaagggagcaataccattttacgaatgtaaggactgtggcaagagctttattcatagtacagtgctgactaaacacaaagagctgcatcttgaggaagaggaagaggacgaggctgccgctgccgcagccgctgcagcccaggaggtggaggccaacgtacacgtcccccaggtggtgctgcggatacagggcctaaacgtggaggccgctgaaccagaggtcgaggccgctgagcccgaagtggaagccgctgagcccgaagttgaggccgctgaacctaatggcgaggccgaaggccctgacggagaagccgctgagcctattggagaagccggacagccgaacggcgaagccgagcagccaaatggcgatgcagatgaaccagacggagcaggaatcgaggacccggaggagcgggcagaggaacctgaagggaaggccgaggagccagagggagatgccgatgagcctgacggtgtgggcatcgaggacccagaggaaggcgaggaccaggagattcaggttgaggagccgtactacgattgccacgaatgcactgagacttttacctccagcaccgccttctccgagcacctgaaaacacacgctagtatgatcatcttcgagcccgctaatgctttcggagagtgcagcggctacatcgagcgagctagcacatccacaggaggcgctaaccaggccgacgagaagtacttcaaatgcgacgtttgcggccagctttttaatgaccgcctgtcactggcgaggcaccaaaatacacataccggctag

SEQ ID NO: 31725 - DNA, 63 bp, Artificial Sequence
  Description of Artificial Sequence: Synthetic coding sequence
atggctacaatgattccaccagtgaaattaaaatggctcgagcacctaaatagttcttggtag

SEQ ID NO: 31726 - DNA, 4389 bp, Artificial Sequence
  Description of Artificial Sequence: Synthetic coding sequence
atgtaccagcccgaggacgacaacaactccgacgtcacttctgatgatgatatgacccggaatagacgcgagtcaagtccgcctcattccgtgcacagctttagtgacagagattgggataggagaggaaggagtcgcgatatggagcccagggaccggtggagccatacaagaaatccacggtcacgaatgcctcccagggacctatcactgcccgtcgttgctaagacatcttttgaaatggaccgtgaagacgaccgcgactcacgtgcctacgaatctcggtctcaggacgctgagtcctaccagaatgtcgttgaccttgccgaagacagaaaaccgcataatacgattcaagacaatatggaaaattatagaaagctcctaagtctcgtccaacttgcagaggacgacgggcacagccacatgactcaggggcactcaagccgctccaagaggagcgcatacccttccaccagccggggactgaaaacgatgccggaggccaagaagtctactcacaggcgcggaatctgtgaggatgagtccagtcacggtgtgataatggagaagttcataaaagatgtttcacgaagcagtaagtctggccgtgccagagagagtagtgataggtctcagcgctttcctagaatgagtgacgataactggaaggacattagcctgaataaacgggagagcgtcattcagcagcgtgtttacgaaggaaacgcattcagagggggatttcgattcaattcaacccttgtgagccgaaagagagtgctcgagcggaaacgaaggtaccattttgataccgatgggaagggttctatccatgaccagaagggctgcccaaggaagaaacctttcgagtgcgggagtgaaatgaggaaggctatgtccgtgtctagtttatctagtctttcttcaccatccttcaccgaatctcagcctattgacttcggcgcaatgccatatgtgtgcgatgagtgcggcaggagttttagcgtgataagtgagttcgtggaacatcagatcatgcacacaagggagaacctgtatgagtatggagaatcctttatccactccgtcgccgttagcgaagttcagaagagccaggtgggcggtaagagatttgagtgtaaagactgcggggagaccttcaataagtccgccgcactggcagagcatcggaagatacatgcaagaggatacctggtggaatgcaaaaaccaagagtgtgaagaagccttcatgccctcccccacgttctctgagctgcagaagatttacggaaaggacaaattttatgaatgccgtgtctgtaaagaaacattcctccattcctctgccttaatcgagcatcagaagatacacttcggggacgacaaggacaatgaaagggagcacgagcgggagcgagagcgggagaggggtgagaccttccggcctagtcctgcactgaacgagtttcagaagatgtacggaaaagagaagatgtacgagtgcaaagtttgcggcgagacattcctccacagctcttcccttaaggaacaccaaaaaatacacacgagggggaacccattcgagaataaggggaaagtatgcgaagagaccttcatcccgggtcagtcgttaaagagacgccaaaagacctacaataaagaaaaactgtgtgatttcacagacggacgtgatgcttttatgcagtcaagtgagttaagtgagcatcaaaagattcattcccgcaagaacctctttgaaggaaggggatatgagaagagcgtcatccacagtggaccatttaccgaaagtcagaagtcacacaccattactcggcctctggagagcgacgaagatgaaaaagcctttaccatctcatccaatccttacgaaaatcagaaaatacctactaaggagaacgtttatgaggctaagagctacgagcgctccgtcattcattcactagcctcagttgaggcgcagaaaagtcatagcgtggcaggcccttcaaaaccgaaagtcatggccgaatccacaattcaatccttcgacgccatcaaccaccagcgcgtgcgcgctggcggtaacaccagcgagggcagagaatacagcagaagcgtgattcatagcttggtagccagcaaaccccctcggtcccacaatggtaatgagctagtggagagtaacgagaaaggagaaagcagtatttacatctctgatttgaatgataagaggcagaaaatccccgcacgggagaacccatgcgagggagggagcaaaaacagaaactacgaagattcagtgatccagtcggtgttcagagccaagccccagaagtcagtacccggtgagggctctggagagtttaagaaagatggcgagttctccgtgcccagttctaacgtgagggaataccagaaagctagagccaagaagaagtatatcgagcacaggtctaacgagaccagcgtcatacacagtttgccatttggcgagcaaacattccggcctcggggaatgctatacgaatgccaggagtgtggcgagtgcttcgctcattcctccgatctgacagaacatcagaaaatccacgacagggaaaagccttccggaagcagaaactatgagtggagcgtaatcaggtctttggcgccaacagatccccagacatcttatgcacaggaacagtatgctaaggagcaagctagaaataagtgcaaggatttccgacaatttttcgctacttctgaagacctgaacaccaatcagaagatttatgatcaggaaaagagccacggcgaagagtcgcaaggggagaacacagacggcgaagagacacactcagaggaaacacatgggcaggagactattgaggacccagtgattcagggttctgacatggaggatcctcagaaagatgacccagatgacaaaatctatgaatgcgaggactgtgggctaggctttgttgacctcacagacctgaccgatcatcagaaggtgcatagccgtaagtgcctggtggactcaagggagtacactcacagtgtgattcatacacactctatttccgaataccagcgcgactacacaggcgagcagctttacgagtgcccgaaatgcggtgagtcattcatacacagcagcttcttgttcgagcaccagcgaattcatgagcaggaccagctttactctatgaaaggatgtgatgacggcttcattgccctgttaccgatgaagcctcggagaaatagagccgctgagcgcaacccggcactggccggtagcgccatcagatgccttctctgtggtcagggctttattcattcctccgcactcaatgagcatatgcgactgcatcgcgaggacgatctactcgagcagagccagatggcagaagaggctatcattcctggccttgctttgacagaattccagaggtcacagacagaggagcggttatttgaatgtgccgtgtgtggcgaatcattcgttaaccccgctgagctcgctgaccacgtaacggtgcacaagaatgagccatatgaatacgggtcttcctacacacatactagcttcttaactgaaccgctgaagggcgctattccgttctacgaatgtaaggactgcggtaaatctttcatacattctactgtcctgaccaagcacaaggagctccatcttgaagaggaggaagaagatgaggccgcagcggcagctgctgccgctgcccaggaggttgaggcaaatgtacacgttcctcaggtggtattgaggatccagggactgaatgtcgaggctgctgagcccgaggtggaggccgctgaacccgaagtggaggctgcggaacccgaggtcgaggcggcagagccgaacggcgaggccgaaggccctgatggcgaagccgcagagccgatcggagaagctggacaaccaaatggtgaagctgagcagcctaatggcgatgctgatgagcccgatggggcagggatcgaagaccccgaagaacgggcagaggaacctgagggcaaggcggaggagcctgaaggcgacgctgatgagccagatggtgtgggtattgaggatcctgaggaaggtgaggatcaggagatccaggttgaagaaccctactatgactgccatgaatgcacagaaaccttcaccagcagcactgccttcagcgaacatctcaagactcatgccagcatgatcatcttcgagcctgccaacgcgttcggtgagtgctctgggtacatagagcgagccagcacctccactggcggagccaaccaggcggacgagaagtatttcaagtgtgatgtgtgcggacagctgttcaatgaccgactgtctttggccaggcatcagaacacccacacaggttag

SEQ ID NO: 31727 - DNA, 438 bp, Artificial Sequence
  Description of Artificial Sequence: Synthetic coding sequence
atggcaactatgatccccccagtgaagctgaagtggctggagcatctgaatagttcttggatcactgaggatagcgagtcaattgcaacgcgtgagggtgtagccgttctctattctaaactggttagtaacaaagaggtcgttcctctcccacagcaggttctatgtttaaaggggccacagctacctgatttcgagcgagaaagcttatcttccgacgagcaggaccattatttggatgctctgctgtcaagtcaactggccttggctaaaatggtgtgctcggattcacccttcgccggtgcgctgcgcaagcgcttgctggtgctgcaacgagtcttctatgcactgtctaacaaatatcatgacaagggtaaagtgaaacaacagcaacacagccccgagagttcctcaggctctgctgatgtgcacagctag

SEQ ID NO: 31728 - DNA, 4284 bp, Artificial Sequence
  Description of Artificial Sequence: Synthetic coding sequence
tgagcaaagcaagaacggctggaaatcgccagtctgtccaaccaggatcacacttctaagaaggaccccggtggccaccggacggctgcaattttacacgggggatctccagactttgttggcaatggcaaacacagagcaaactcctctggtcggagccggagagagcgacagtattcagtgtgcaattctgaggacagccccggatcttgcgagatactctattttaatatggggtcgccagatcagttaatggtccacaagggcaagtgtatcggctcagatgagcaattaggcaaattggtctacaacgcactagaaactgccacaggaggatttgttctgctctacgagtgggtgctgcagtggcagaaaaaaatggggcctttcctgacaagccaggaaaaggaaaaaatcgataagtgtaaaaaacagatacagggcaccgagactgagttcaatagtctggtaaaactgtcgcatcctaacgtagtccgttacctggccatgaacctgaaagagcaggatgactccattgtggtggatatcctggttgaacacatctctggcgttagtctagctgcccaccttagccattcaggtcctatccccgtgcaccagttaagacgctataccgctcagttattgagcggtctggactatttgcactcaaactctgtggtacacaaggtgctgtccgccagcaatgtcctagttgacgccgagggcaccgtgaaaattactgactattcgatcagtaagaggctggccgatatttgcaaagaggacgtattcgagcaaaccagggtccgatttagtgataatgctctaccctataagactggcaaaaagggtgacgtatggaggctgggattgcttcttctgagcctgtcacaaggccaggagtgcggagagtatcctgtgaccataccatctgacctcccagcggacttccaggacttcctgaaaaaatgcgtgtgtctggatgataaggagcggtggtctccacagcagctgttgaaacacagctttattaatcctcagcctaaaatgccgctagtggagcagtctcctgaagactcggaggggcaagactatgttgagaccgtcatcccgtcaaacagactcccaagcgccgctttcttcagcgagacccaacgacagttttctaggtactttattgaattcgaagaactacaactcctagggaagggcgcttttggcgcagtgatcaaagtgcagaataaacttgacgggtgttgttacgcagttaagcgaatacctatcaaccccgcttcccgccagtttcgccgaattaagggggaagtgactctcctgtctcgcctgcatcacgagaacattgttcggtactataacgcctggattgagaggcacgaaaggcccgcaggcccaggcaccccgcctccagatagtgggccactggccaaggatgaccgagctgccagaggccagcctgcttccgatacggacggcctggactctgtggaggcagctgcccctccacccatcctgagctcttctgtggaatggtcaactagcggcgaaaggtctgccagcgctcgattcccagctacggggcctgggtcaagtgatgacgaagacgacgatgaggatgaacatggaggggttttttcccaaagctttctgcccgctagcgatagtgaatccgatatcatctttgataacgaggatgaaaacagcaagtcccagaatcaaatggagtactgcgaaaagagtaccctcagggatactattgatcaaggactgtatagggacaccgtcagactgtggaggcttttccgtgagatcctggacggcctagcctatatacacgagaaaggcatgattcatcgagacctcaaaccagtcaacatttttctggactccgatgatcacgtgaagatcggagactttggattggcaacagaccacttagccttttctgccgactcgaagcaagatgatcaaaccggggacctgattaaatccgatccaagcgggcatttgaccggcatggtcggtacagccctgtacgtgagtcctgaggtccagggcagcaccaagagcgcttataaccagaaggtcgatctcttctctttgggtatcatcttcttcgaaatgagctaccaccccatggtcaccgcttccgaacggatattcgtgctgaatcagttgcgtgatcctaccagtcccaagtttcccgaggacttcgacgatggagaacatgccaaacaaaaaagtgttattagctggctgctgaatcatgacccagctaaacgcccaacagccactgaactactaaaatctgaactgctgccacctccacagatggaggagagcgagttacacgaagttctgcaccatactctgacaaatgtggacggcaaggcctacagaacaatgatggcccagatcttttctcagcgtatcagccccgctatcgactacacatatgattccgatatcctgaagggcaacttcagcattcgaactgcgaagatgcagcaacatgtgtgtgagaccatcattagaatctttaaaagacacggggctgtacagctctgtacacccctgctgctccctcgtaacaggcagatttacgaacacaacgaggcagccctcttcatggaccattctggcatgctggtgatgctcccatttgaccttcgtatccctttcgccaggtacgtcgcccgtaacaatatcctgaacctcaaacgatactgcatcgagagggtttttcggccaagaaagttggacagatttcacccaaaagagctgctggaatgcgcgtttgacatcgtaacaagcacaacaaattctttcctcccaacagccgaaattatctacaccatctacgagataatccaggagttccctgctcttcaagaacggaactatagcatttatctgaaccatacaatgctacttaaggctattttgctgcactgcgggatccctgaagataaactgagccaggtctatataatactctacgatgccgtgaccgaaaagttgacccgacgtgaggtggaggccaagttttgcaacctgtccctgagcagcaattccctatgcagattgtacaaattcattgaacaaaaaggggatttgcaggacctaatgccaactatcaacagtctcatcaagcaaaagactggcatcgctcagctggtaaaatatggcctgaaggacctggaagaagtcgtggggctgttgaaaaaactcggtatcaaattacaggtgttgatcaacctcggtttagtgtataaagtacagcaacacaacgggataattttccaatttgtggccttcatcaagaggcggcagagagccgtccccgaaatcctggcagctggaggaagatacgacctgttgattcctcagttccggggaccgcaggctctgggtcccgtgcccacggccattggcgtgagcattgcaattgataaaattagcgccgcagtgctgaatatggaggagtccgtgactattagtagctgtgacctgctcgttgtctcagtgggccagatgagcatgtccagagccattaacctgacacagaagctgtggacggcaggtataaccgcagagatcatgtacgattggagtcagtctcaggaagagctgcaggaatactgccgccaccatgaaataacttacgttgccctggtatcagacaaagagggatcccacgtgaaggttaaatcgttcgagaaagagagacagacagagaagcgcgtcctggagactgagctggtggaccatgtgctgcaaaaacttaggacaaaagtgacagacgagagaaacggaagagaagccagtgataacttagctgtgcaaaatctcaagggaagtttctccaacgcatccggcctgttcgaaatccacggggctacagtggtccctattgtgtcagttctggctccagaaaagctctcagcgagtacccgtagaaggtacgagacacaagtgcagactaggctccagactagtttggccaacctgcatcaaaaatcttctgagattgagatcctggcagtggacctgcctaaggagactattctacagtttctatccttagagtgggacgcagatgagcaagcttttaataccacagtgaagcaattactgtcgagactgccaaagcagagatatctcaaattggtttgcgatgagatctataatattaaagtggagaaaaaagtgagcgtgctattcctctacagctaccgtgatgattactacaggatcctcttttag

SEQ ID NO: 31729 - DNA, 4767 bp, Artificial Sequence
  Description of Artificial Sequence: Synthetic coding sequence
atgctgccgcctaaacacttgtctgccactaaacctaaaaaaagttgggccccaaatctttacgaacttgacagtgatctgaccaaggaaccggatgtgatcatcggcgaaggtcccactgactccgaattctttcatcaacggtttcgaaacttgatatacgtcgaattcgtgggcccacgcaaaaccctgattaaactgcgcaatctctgtctcgactggctgcagccagagactagaaccaaagaagaaataattgaactgctggtgctggagcagtatctcaccattatacccgaaaagctgaagccctgggtcagagccaaaaagcctgagaattgtgaaaagctggttactctgctggagaattataaagaaatgtaccagcctgaagacgataataacagtgatgtgacctcggatgatgatatgacccggaatcgcagagagtcctcccctccgcactctgtgcacagttttagcgaccgggattgggatagaagaggacggtccagagatatggagccacgtgacagatggagtcacacgaggaatcccaggagcaggatgcctccccgagacctgtctctgcctgtcgtggcaaagacctcatttgagatggacagggaggatgatcgggattcgcgagcatatgagtcgagatctcaagatgctgagtcctaccaaaacgttgtcgatctggcagaggataggaaaccccacaacaccatacaggacaatatggagaactaccggaagctcttgagtctggtgcagctggcggaagacgatgggcacagtcatatgacacagggacacagcagcaggagtaagcggagcgcctatccctcgacatcccggggactcaaaacaatgccagaggccaaaaagtccactcacaggcgcggtatatgcgaggatgaatccagccacggcgtgatcatggagaagttcataaaagacgtgtcacgctccagcaaaagcggacgagcaagggagtcctccgatcgcagtcagagatttcccagaatgagtgatgacaactggaaagacataagcctcaataaaagagagagtgtgatccagcagagggtctacgaaggcaatgcattccgtggtggctttaggttcaactctaccctggtgtctcgtaagagagtcctcgagcgcaagcggcgatatcactttgatacagacggcaaaggctccatccacgatcagaaaggttgccctagaaagaaaccatttgagtgtgggtcagaaatgagaaaggctatgtccgtttcaagcctctcgtccttatcaagccccagctttaccgagtctcagccaatcgacttcggcgcaatgccttatgtctgcgatgagtgtggtcgctccttctctgtcatctccgagttcgtcgaacatcagatcatgcacacaagggagaatctttatgaatacggagagtctttcattcacagtgtcgctgtgtctgaagtgcagaaatcccaggtgggcggtaagcggtttgaatgtaaggattgtggcgagaccttcaacaagagtgcagcattggctgagcacaggaagatccacgctcggggatatctagtcgaatgtaagaatcaggaatgtgaagaggcttttatgcccagcccaacattcagcgagttgcagaaaatctatgggaaggacaaattctatgagtgcagagtgtgtaaggaaacattcttgcacagtagtgctctgattgagcaccaaaagatccacttcggggatgacaaggacaacgaaagagagcacgagcgagagagagaaagagaaagaggggaaacctttcggccatctccagccctaaatgagttccagaaaatgtacgggaaagagaaaatgtacgaatgtaaggtgtgcggcgagacctttctccactcatcttcactcaaggagcaccagaaaatacatacacggggaaatcctttcgagaacaaagggaaggtctgcgaggagacattcatccctggccagagcctcaaacggcgtcagaagacgtacaataaagagaagctctgtgacttcacagacggacgcgatgcattcatgcagagttccgagcttagcgagcatcaaaaaatccacagccgcaagaatctttttgaaggccgtggttatgaaaagagtgtgatccattctggaccctttaccgaaagtcagaagtctcataccattaccaggcccttggagtctgacgaagacgaaaaagcgttcacaataagtagtaatccttatgagaaccaaaaaattccgaccaaggaaaatgtttacgaggccaagtcttatgagcgttccgtgatacattcactggcaagcgtggaggcacagaagtcccacagcgtggcaggaccaagcaagccaaaggtgatggccgaaagcacaattcagtcctttgatgccattaaccaccaacgagtgcgagcaggagggaacacgtctgaaggtcgcgagtactcccgctctgtgatccacagtctggtggccagcaagccccctagaagccacaatggaaatgagttggttgagagcaacgaaaagggagaatccagtatttatataagcgatttaaacgacaaaagacagaagatacctgctcgcgagaacccttgcgagggaggctccaagaatcgcaactatgaagacagtgtgatccagagcgtttttagggccaaacctcagaaatccgtccctggcgaaggtagcggtgagtttaagaaggacggcgaattcagcgttccaagcagcaatgtcagggaataccagaaggcacgggctaagaaaaagtacattgaacaccgcagcaacgagacctcagttattcacagcctcccgtttggcgagcagacgttccgcccacgaggcatgctgtacgagtgtcaggaatgcggcgaatgttttgctcattctagtgacctaaccgaacatcaaaaaattcatgatcgtgagaaaccatccggatcacggaactatgaatggtcagtgatccgctctctcgccccaacggacccgcagacatcttatgcacaggaacagtatgccaaagaacaagccagaaataaatgcaaagacttccgccagttctttgctacatccgaggacctgaacaccaatcaaaagatctacgaccaggagaagtcgcacggagaagagtctcagggagaaaatacagatggtgaagaaacacacagcgaagaaacacatggtcaagagactatcgaggatcctgttatacagggaagcgatatggaggatccccagaaggacgacccggatgacaagatatatgagtgcgaggactgtggcctcggattcgtggatctgaccgatctcacagaccatcagaaggtacatagccggaaatgcctggtcgattcgcgtgaatatactcactcggtgattcatacacatagtataagcgagtaccagagggactatacgggcgagcagctgtacgaatgccccaaatgtggcgaatcctttatccattcctccttcttgttcgagcaccagaggatccatgagcaagatcaattgtattctatgaagggatgtgacgatggctttatcgctttgttgccaatgaagcccaggcgtaatagagcagcggaacgaaatccggctcttgctgggtctgccatccgctgcttgctgtgtggccaagggtttatccacagctccgccctgaacgagcacatgcgtctacatcgcgaggatgacctgctggaacaatctcagatggcagaagaggctattattccgggtcttgccctgacagagttccagcgttctcaaaccgaggaacggctgttcgagtgtgcggtgtgtggagaatcattcgtcaatcccgctgagcttgcagatcacgttactgtccacaaaaatgaaccttatgaatatggcagcagctatacccacacttcatttctaaccgagcccttgaagggagctataccattctatgaatgcaaagactgtggtaagtccttcattcacagcactgtgcttacaaaacacaaggagctgcacctggaagaggaagaggaggatgaggcggctgccgctgcggcagccgctgcccaggaggtggaagctaacgttcatgtgccacaagtagtcctgcgtatacagggattgaatgtggaagcagccgaacctgaagttgaggccgctgagcctgaggtggaggctgcagagcccgaggtagaagctgcagagccaaatggtgaagcggaaggaccagatggagaggctgcagagccaatcggcgaggctggacaaccaaatggcgaggctgagcaacccaacggcgacgctgacgagccagatggtgccggaatagaagaccctgaggagcgcgcagaggagcccgaggggaaggccgaagaacccgaaggcgacgccgacgagccggacggggtgggcatagaggatcccgaggaaggggaagatcaggagatacaggtagaagaaccctattatgactgccacgaatgtactgaaaccttcacctcctcaactgctttctctgagcacctgaagacacacgcctcaatgattatctttgagcccgcaaatgccttcggcgagtgttccggatacattgagcgagcatcaaccagcactggaggcgcaaaccaagccgacgagaagtatttcaaatgtgatgtatgcgggcagttgtttaatgatagactttctcttgctcggcaccagaacactcacacaggctag

SEQ ID NO: 31730 - DNA, 3012 bp, Artificial Sequence
  Description of Artificial Sequence: Synthetic coding sequence
atgtcacagtggacccccgagtataatgagctttatactctgaaggtcgatatgaaatccgaaatccccagcgacgcgcctaagacccaagagtctctgaaaggcattctgctgcaccccgagccgattggcgctgccaaatctttcccagccggagtcgaaatgattaactccaaagtaggcaatgagttttcgcacctgtgtgacgacagccaaaaacaggagaaggagatgaacgggaaccaacaggagcaggagaaaagcctggtagtgcgtaagaaacgcaaatcccagcaggccggaccgtcctatgtccagaactgcgtaaaggaaaaccagggcatcctcggccttcggcagcatctaggcactccttccgacgaggacaatgattctagcttctccgactgcctctcttcgcctagctcttcacttcattttggagattcagacacagtgacaagtgacgaggacaaggaagtgtctgtgcgacattcccagactatcctgaacgccaaatcccgatcacactctgccaggtcccacaaatggccaaggactgaaacagagagtgtttcaggcctcctgatgaaacgaccatgcctgcacggaagcagtctgcggagactgccttgcaggaagcggttcgtgaaaaacaatagctcacaacgcacccagaaacagaaagagagaattcttatgcagcgtaagaaaagagaagttcttgcgcgaagaaaatatgcacttctacctagctccagtagctctagtgagaacgatctatctagcgagtcttccagttctagctctactgagggggaggaagacctgttcgtgtccgcaagcgaaaatcaccagaacaaccctgccgtgccttccggctccatcgatgaagacgttgttgtcattgaggcttccagcactccgcaggtgaccgccaatgaggagatcaacgtgacaagcaccgactctgaagtcgagattgtcacagttggggagtcctaccggtctcggtcgactttaggacatagtaggagccactggtcacagggctcaagcagtcacgccagccgtcctcaggagccccgtaatcgatctaggatctcaacagtcattcagcctctcaggcagaacgccgctgaggtcgtggatcttaccgtcgacgaagacgaacccacagtcgtgcccacgaccagcgcgagaatggagtcgcaggcaaccagcgcaagcatcaacaattcaaacccctcaacgagcgaacaggccagcgacacagcgtccgcagtgacgtcttcacaaccaagtaccgtcagcgaaacgagcgccaccttaacctcaaacagcaccacggggacctctatcggcgacgatagccgccgaactacatcgtctgccgtgaccgagaccggcccaccggcaatgccgagactcccaagctgctgtccacagcatagcccctgtggaggctcgagccagaaccatcatgcgttgggacaccctcatacatcatgtttccagcagcatggtcatcatttccagcaccatcatcaccaccatcacacccctcaccccgctgtccctgtgtccccgtctttttctgaccccgcttgccctgtagaaaggcccccacaggtgcaagccccttgtggcgcaaacagctctagtggcacctcttatcatgagcaacaggcgctgccagtcgatcttagtaacagtggcatccgcagccatggctctggctcattccacggtgcatctgcttttgacccatgctgcccagtgtcctcaagtcgcgcagcaatcttcggtcaccaggctgctgccgctgcccctagccagcccctaagcagcatcgatggctatggcagttctatggttgcgcaacctcagccacagcctccccctcagccttcgctgagctcttgcaggcactacatgccaccaccctacgcaagtctcacaagacccctgcaccaccaggcaagcgcatgtcctcattcccatgggaacccgccaccgcagacacagcctccacctcaagtggattacgtcattcctcacccagtccacgcctttcacagtcagatttcaagccatgccacttcgcaccctgtcgcccctccaccccctacacatctggccagcactgcagcaccgatcccccagcatttgccgcctacacaccagcctatcagtcatcatatccctgccacagctcccccagcacagaggctgcatcctcacgaggtaatgcagcgcatggaagtccagaggcgtaggatgatgcagcaccccacaggccttttcgtcttctgcgtctcaaggcgagctcatgaacgtccaccccctcatccgcacagaatgcatccaaactacggacatggccaccatattcacgtcccacaaactatgtcttcccatcctcgccaggccccagaacggagcgcctgggaactgggtattgaggccggagtgaccgcagcgacatacactccaggggctttgcaccctcaccttgctcactaccacgcgccaccccgtctgcaccacctccagctcggggctctccctctcatggtaccggatatggctggctacccacatatcagatatatcagcagcggcctggacggaaccagcttccgcggaccctttcgcggtaacttcgaggagctgattcacttggaagaacgcctcggtaatgtgaatagaggtgccagtcagggcactattgaacgctgtacataccctcacaaatacaagaaagtgacaacggactggtttagtcaacgcaaattgcattgtaagcaggacggcgaagagggaaccgaagaagatacggaagagaagtgcaccatctgtctatcaattttggaggaaggagaggatgtacgtcgcctgccttgtatgcacctgttccatcaagtgtgcgtagaccagtggctcattacaaacaagaagtgtcctatttgtagggtcgacatagaggcccagctcccaagtgagagttag

SEQ ID NO: 31731 - DNA, 150 bp, Artificial Sequence
  Description of Artificial Sequence: Synthetic coding sequence
atggccctccctcacgatagcaatgaaacaagttacctgctcccacccaataacgaggactggggtcgccaaaccattcctgacttcgtctatggccaaaaggacctgatggcagagggcattcaatggcccagaaatgcccctggatag

SEQ ID NO: 31732 - DNA, 375 bp, Artificial Sequence
  Description of Artificial Sequence: Synthetic coding sequence
atgagggcgtcgccctgcatctcacaaccagccgcttcctggcatccccgtccaagtgcactaagaccaaccgcgggttctggccctgatacgcgcacacctggcaccgttgaggatgggtcagccccttgccctgccttcaggagcccagctgtttcaccctgcggggaggagccttgctgtttccagataagtcccgcagaagagacactcgaacttggcaggctggtctccccaggcaactgcgacaccttgagtccacgagctgctggcttctacgcatgccacgtacgatccctgataccttgtaggagcactaaagggcgatggccgctgacagcttctgctgcaggactatcatccttttctggttag

SEQ ID NO: 31733 - DNA, 93 bp, Artificial Sequence
  Description of Artificial Sequence: Synthetic coding sequence
atggctacagactcttgggccctggcagtcgatgagcaggaggcagcagccgaatctcgaaccgaactgccaagcccttatagcacgtcgtag

SEQ ID NO: 31734 - DNA, 804 bp, Artificial Sequence
  Description of Artificial Sequence: Synthetic coding sequence
atgtgggaccagaggctggtcaaactggccttgctccaacacctccgggctttttatggtataaaggtgaagggcgtccgcggtcagtgcgacaggcgtcgccacgagaccgccgctaccgaaatcgggggaaaaattttcggagtgccctttaacgccttgcctcactccgccgtgcctgagtatgggcatattccctcattcctagtcgatgcatgcaccagcctagaggagcatatccacacagaggggctgttcagaaaaagcgggagtgtgatcaggctcaaggccctgaaaaataaggttgatcatggtgaggggtgcctgtcatccgcaccaccctgtgacattgctggattgctgaaacagtttttccgcgagctgcctgagcctatattacctgcggacctgcatgaggctctgctgaaagcgcagcaactgggcactgaggagaaaaacaaagcaattttgttgctcagttgcctcctagctgatcacaccgtgcatgtgctgcggtacttcttcaacttccttcggaatgtgtctttaagatcctccgagaacaagatggactcttcaaaccttgccgttatctttgcccctaatcttctgcagaccagcgaagggcacgagaagatgtcctctaatgccgagaagaagggagtttaccagaccctgtcctggaaacggtaccagccttgttgggtactcatggtttctgttctgcttcaccactggaaggccttgaagaaggtcaacatgaagttactggtgaatattcgagagcgcgaggacaacgtctag

SEQ ID NO: 31735 - DNA, 1113 bp, Artificial Sequence
  Description of Artificial Sequence: Synthetic coding sequence
atgggatttaatcgcccttctaaaatacaagaaaatgcccttcccctcatgctggccgaacctccccagaacctaatagcacagtctcagagcggaaccggcaaaacggctgctttcgtgctggcaatgctcagtcaggtggagccagccaacaaatacccacagtgtctttgtcttagcccaacctacgagttggctctgcagacaggcaaggtgatagagcagatgggcaagttttaccccgaacttaagcttgcatacgcagtgagaggtaataagttggagagagggcagaaaattagtgagcagatcgtgatcggtacccccggaacagtgctggactggtgctctaaactcaaatttattgacccaaaaaaaatcaaggtgttcgtgttggacgaagcagacgtgatgattgccactcaggggcaccaggatcaatctattcgtatccagaggatgttgccacgtaactgtcaaatgctgctgttctctgctacgttcgaggactccgtctggaagtttgcacagaaagttgtcccagatccgaatgtgatcaagcttaagcgggaagaggagaccctggatacaatcaagcagtattacgtgctgtgcagtagtagggacgaaaagtttcaggctctttgtaacctttacggggcaattactatcgctcaggcgatgatcttctgccatacgaggaaaactgcatcctggctggctgccgaactgtcaaaggaggggcaccaggtggctttactgtccggagagatgatggtggagcagcgtgccgcagtgatcgagcgcttccgggagggcaaagaaaaagtgttagttactaccaatgtgtgtgctcgcggaatagatgtggaacaggtttcagttgtgattaattttgacctgcccgtggataaggatggtaaccctgataatgagacatatctccatcgcattggtcggacaggcagatttggaaagcggggtctggctgtgaatatggtcgatagcaagcattctatgaacattctaaatagaattcaagaacatttcaataagaaaatcgaacgtttggatacagatgatctcgatgagattgagaagatcgcaaactag

SEQ ID NO: 31736 - DNA, 2712 bp, Artificial Sequence
  Description of Artificial Sequence: Synthetic coding sequence
atggccacgagcgccgattcaccaagtagtcctctgggagcggaagacttactgtccgactctagtgaacccccagggctgaatcaggtctccagcgaggtgacgtcacagctgtacgctagtctaagactgtccagacaagcggaggccaccgcaagagcccagctctatctaccttccacttcgccaccacacgagggactagatggattcgcacaggaactgtcacgtagtctgtccgttggcttagagaagaatctcaagaagaaggacggctccaagcacatttttgaaatggagtccgtgcgtggccaactccagactatgctccaaacatctcgtgacacagcttatagagatccgctgatccccggtgcagggtcagaaaggcgtgaggaggactcctttgatagcgacagcacagctaccctgctcaatacgagaccactgcaggacctgtctccaagttccagcgcacaggcattggaggagctctttccaagatatacgtctctacgccctggcccacccctgaaccctcctgattttcaaggccttcgtgacgcgctggattcagagcatacccgtaggaagcattgtgagcgccacatacaatccctgcagactcgcgtgctggagctccagcaacagctcgctgtggccgttgctgctgaccgcaagaaagatacgatgatcgaacagctcgacaaaacgctggccagagttgtggagggttggaaccgacatgaggccgagagaacagaggttcttcggggtttgcaggaggagcatcaagccgcagagcttacacgctctaagcagcaagagactgtgaccaggctggagcaatccctgagcgaggcaatggaggcactgaatcgggagcaggagtctgcgcgactgcaacagcgcgagcgtgaaaccctggaggaggagcgtcaggcactcacactgcggttggaagcagagcagcagaggtgttgcgttctgcaggaggaacgagacgctgccagggcagggcagctgtcagagcatagagagctggagacattacgagccgcactggaggaagagagacaaacatgggcccagcaggagcaccagctgaaggagcactatcaggctctgcaagaggagagccaggcccagcttgaacgtgagaaggaaaagagtcagcgggaagcccaggccgcatgggagacccagcatcagttggccttagttcagagtgaagttcgcagactggagggtgagttagatacagctcgcagggagagggatgctttgcaactggaaatgtcgcttgtgcaagcacggtacgaaagccagcgtatacaactggagtctgagctcgctgttcagctcgaacagcgggttacagagcggctggctcaggctcaagagtcctctctaagacaggccgctagcctgagggagcaccacaggaaacagctacaagacttgagtggccaacatcagcaggagttggcgagccaactggcacaatttaaagtggagatggcggagagggaagagagacagcagcaggtggcagaagactatgaactccgccttgccagagaacaagctagggtgtgtgagcttcagagcggaaaccagcagctcgaagagcagcgggttgagctcgtggaaaggctgcaggcaatgcttcaggcccattgggatgaggcaaaccagctgcttagtaccaccctgccaccgcctaaccctccagcccctccagccggaccttccagccctggccctcaggagcccgaaaaggaagagcgcagagtgtggacaatgccaccaatggcggtggcacttaagcccgtcctacagcagtcacgtgaagcgagagacgaattaccaggcgcacccccagtcttgtgttcctctagctctgacttaagcctgttacttggcccaagttttcagagtcagcactccttccaaccactggagccgaagcccgatctgacatcttctactgcaggtgctttttcagccctgggggcattccaccctgaccatcgggcagagaggccttttccagaggaagaccctggaccggacggcgaagggttgcttaaacaagggctcccccctgctcagctggagggactcaaaaacttcctccaccaattgctggaaacagtgccacagaataacgagaacccatccgtggacctattgcctcccaagtctgggcctctgacagtcccatcctgggaagaggccccacaggtgccgagaatccctccgcctgttcacaaaactaaggtcccactggccatggcatcttcattattccgagtccctgagcccccaagctcccactcccaaggatctggaccttcttcaggctcccctgagcgcggaggcgatggactcacattccctcggcagcttatggaagtgtcacaattgctaaggctttaccaagcccgtggctggggagctcttcccgcagaagacctgctgctgtacctcaaacgactggaacattctggtaccgatgggagaggcgacaacgtcccccgaagaaatactgactctaggctgggagaaattcctcggaaagagatcccctctcaggcagtaccaaggcggctggccaccgcacccaaaaccgagaaaccaccagccagaaagaagtctggacatcctgcaccttcatccatgcgcagcagaggtggggtatggcgctag

SEQ ID NO: 31737 - DNA, 138 bp, Artificial Sequence
  Description of Artificial Sequence: Synthetic coding sequence
atgcccctccttgtggagggaaggcgggtgcgcctcccacagtctgccggtgatctggtgagagcccaccccccactagaagccccatcccccttttgggtgctcatgatgccactgctcgttaccctgtggtcttag

SEQ ID NO: 31738 - DNA, 1083 bp, Artificial Sequence
  Description of Artificial Sequence: Synthetic coding sequence
atggaggagttgagtcaggccctggcctcttcatttagtgtctcccaagacctgaattcaactgctgctccacatcctcgcctgagtcagtataagtccaaatatagctccctggagcagtctgaacgccgaaggcggctgctggaactacaaaagtctaagagattagactacgtgaaccacgcccgacggcttgccgaggatgattggacgggcatggagtcagaagaagagaataagaaagacgacgaggaaatggacattgacaccgtcaaaaagctgcctaagcattacgcaaaccagctgatgctgtcagagtggctaattgacgtgccatcagatttagggcaagaatggatagtggtcgtgtgccctgtagggaagcgtgccctgatcgtggcttctagaggatctacctccgcctacaccaaaagcgggtactgcgttaatcggttttcctccctcctgcctggcggaaatcgtcgtaatagcactgccaaggactacactatattagattgcatctacaacgaagtgaatcaaacctattacgtacttgatgtgatgtgttggagaggacaccctttttacgactgtcagaccgacttccggttttactggatgcactcaaagctccctgaagaggagggtttgggggagaaaacgaaactcaatccttttaagttcgtcggcctcaaaaattttccctgcactccagagtcattgtgcgacgttctctctatggattttccatttgaagtggatggattacttttctaccataaacaaactcactattctccgggatccacccccctggtggggtggctgcgaccctacatggtgtctgatgtgttgggtgtggccgtaccggctggcccactcacgacaaaaccggactacgcaggtcaccagttgcagcagataatggagcacaagaagagtcagaaagagggcatgaaggaaaaactcactcacaaggctagtgaaaacggccattacgaactggagcatttaagtacacccaaattgaagggaagttctcactctcctgatcatcccggttgcctgatggagaactag

SEQ ID NO: 31739 - DNA, 1353 bp, Artificial Sequence
  Description of Artificial Sequence: Synthetic coding sequence
atggtccctctggtggcagtggtctcagggccacgggcacaattatttgcctgcctgctcagattaggcacccagcaagtcggccctctgcagctacataccggcgcttctcacgctgctcggaatcactacgaagtcctcgtcctggggggagggtctgggggaattactatggctgcgcgtatgaagcgaaaggtcggcgcagagaatgtggctatcgttgaacccagtgagaggcacttttatcagcccatttggaccctggtcggtgcgggagccaagcagctctcctcttcggggagacccactgcttccgtaataccaagcggcgtagagtggattaaggctcgggttacggaattgaatccagacaaaaattgtattcacacagacgacgacgagaaaatcagttatcgttacttgatcattgcccttggtattcaactcgattacgagaagatcaaaggactccctgagggcttcgctcatccgaagatagggagtaattactccgtcaagacagttgaaaagacgtggaaggccctgcaggacttcaaagaaggcaatgccattttcacttttcctaataccccagtcaagtgtgccggagctccccaaaaaataatgtatctgtctgaggcgtactttcggaagaccgggaaacgctccaaggcaaatatcatttttaacacctccctgggggcaatctttggcgtcaaaaagtatgcggacgcactgcaagagattattcaagagcgaaatcttaccgtgaactataaaaagaacttgatagaggtacgtgccgacaagcaggaggccgttttcgaaaacttggataaaccgggtgaaacacaggtgatctcatacgagatgttgcatgtgacccctcccatgtctcctcccgacgtgctgaaaacctctcctgtggccgacgcggctggatgggtggacgtcgacaaggagacactgcagcatagacggtacccaaatgttttcggtatcggtgactgcaccaacttgccaaccagcaaaaccgccgctgctgtggcagcccagtccggcattttagatagaacaatctccgtcataatgaaaaaccaaacccccacgaaaaaatacgacgggtatacctcatgtcccctggtaactgggtacaaccgagtaatcctggctgagtttgactataaagccgagccgcttgagacatttccttttgaccagagtaaggagcgcttgtctatgtatttaatgaaagctgacctgatgcctttcctctattggaatatgatgctgagggggtactggggcggacctgcctttttgaggaaactgttccatctcggaatgtcctag

SEQ ID NO: 31740 - DNA, 1113 bp, Artificial Sequence
  Description of Artificial Sequence: Synthetic coding sequence
atgggattcaatcgcccatcgaagatacaggaaaacgcactgcctctcatgctcgcagaacctccacagaatttgattgcgcagtcgcagtccggaacgggcaagactgccgcattcgttctggctatgctgagtcaggttgaacccgctaataagtatcctcaatgcttatgtttgtcccctacctacgaactggctttacagacaggcaaggtgatcgaacaaatggggaagttctaccccgagctgaaactggcatatgccgtgcgcggtaacaaactagagagagggcagaagatatcagagcaaattgttatagggacacccggtactgttctggattggtgttcaaaattgaagttcatcgatcccaagaagataaaggtcttcgttcttgatgaggccgatgtcatgattgctactcagggccatcaggatcagagtatcaggattcagcggatgctacctcggaactgccagatgctgctatttagcgcaacgttcgaagattctgtgtggaaatttgctcagaaagttgtacccgaccctaatgtgataaaattgaaaagagaggaggagactctggatacaatcaaacagtattacgtactctgttcaagcagggacgagaagtttcaggccctctgcaacctttacggggctattaccattgcacaggcaatgattttctgtcacacaaggaaaacagccagctggctcgcagcagagctctccaaggagggccatcaggtggcccttctctctggcgaaatgatggttgaacaacgggctgctgtgatcgagagattccgtgaagggaaggaaaaagttctcgttaccactaacgtatgtgcgagaggtatcgacgtcgagcaagtcagcgtggtgatcaatttcgatttgcctgtggacaaggacgggaaccccgacaacgaaacctacctccaccggatcggcaggacagggagattcggcaagaggggcttggcagtcaacatggtggatagtaagcacagcatgaacatactgaatcggattcaggagcacttcaacaaaaagattgagagactagatacagacgaccttgatgagatcgaaaaaatcgcaaattag

SEQ ID NO: 31741 - DNA, 738 bp, Artificial Sequence
  Description of Artificial Sequence: Synthetic coding sequence
atgggcggaggctacgatcttaacttatttgctagtcccccagatagcaacttcgtttgtagcgtctgccacggcgtcctgaaaaggcctgccagactgccttgctctcacatcttttgtaagaaatgtatactgagatggttggctagacagaaaacatgcccgtgttgtaggaaggaggtgaagcgtaaaaaagtcgtccatatgaacaagttgagaaaaactatcggtcgactggaggttaagtgtaagaatgccgacgcagggtgcattgtcacttgcccgctggcccaccgcaaaggtcaccaggatagttgccctttcgaacttaccgcatgcccaaatgaggggtgtacctcccaggtgccgagggggaccttggctgaacatcggcagcactgccaacagggaagtcagcagaggtgtccactgggatgcggtgccacgctggaccctgctgagagagctcggcacaactgctaccgggagctacacaacgcatggagcgtgaggcaagagcgccgtaggcctctcctgctgtctctgctgaggcgcgtgcggtggcttgatcaagcgaccagcgttgtgcggcgagagctggctgaactctcgaatttcttggaggaagatacagcattattggagggcgctccccaagaggaggccgaagcagcgcctgaggggaatgtgggcgctgaggtggttggagagcctcgcgctaacatcccatgtaagtag

SEQ ID NO: 31742 - DNA, 309 bp, Artificial Sequence
  Description of Artificial Sequence: Synthetic coding sequence
atgagggccagcccatgcataagtcagcccgcagccagttggcaccctaggccgagcgctctgcgtccgaccgcagggagcggaccggacactagaactcccggaactgtggaagatggaagtgctccatgcccagcgtttagaagtcccgctgtatccccatgtggcgaggaaccatgttgcttccagatatctcctgccgaggaaacactcgaacttggtaggttggtgtctcccggttgccataaaagctctgctcctcaagagcgtcggctcgaccccagggcgaggtgcgtcgtacatatctag

SEQ ID NO: 31743 - DNA, 1473 bp, Artificial Sequence
  Description of Artificial Sequence: Synthetic coding sequence
atggaagattcggcctctgccagtctcagcagcgccgcagccaccggaacgtccacaagcacaccagccgcacctacagcacggaagcaactcgataaagagcaggtgcgaaaggctgtcgatgcgctgctgactcattgcaagtctcgcaagaacaattacgggttgctactcaatgaaaacgagagtcttttcctaatggtggttctgtggaaaattccttccaaagaactacgcgtgcggttaactttaccacacagtattagatccgactctgaagatatttgcctctttactaaggacgagccaaattcaaccccagagaagacagagcaattctaccggaagctgttgaataagcacggtattaagaccgtgtcacagataatttcattgcagactctgaagaaggagtacaaaagctatgaagccaagctgaggcttctgtcatctttcgacttctttctcacagatgcacggatcaggcgtctgttaccatccctgattggacgacatttttaccagagaaaaaaggtaccagtctccgtaaacctcttaagtaagaacctctctcgcgagatcaacgactgcattgggggaactgtcctaaatatttccaagtctggtagctgcagcgcaatacgcattggccacgtggggatgcagattgagcatattattgagaatatcgtggccgttactaaggggctgtccgagaaacttcccgagaagtgggagtccgtgaaactgttgtttgttaagactgaaaagtcagccgctctccctatttttagttcatttgtgtccaactgggatgaggccaccaaaagaagcctgctcaacaagaaaaagaaggaggctcgccgaaagcggagggaacgcaacttcgagaaacagaaagaacgcaagaaaaaaaggcaacaggcgcgtaaaaccgcctctgtgctgtcaaaagacgacgtggcccctgagtccggggacactacagtgaaaaagcccgagagcaaaaaggaacagactcctgaacacggtaaaaagaaacgaggcaggggcaaagcacaggtcaaagcaaccaacgagtctgaggacgaaatcccacagctcgtgcccatcggcaagaagactcccgctaatgaaaaggttgagattcagaagcatgcaaccgggaaaaaaagccccgcaaagtccccgaacccctccacaccacgcggaaaaaagcgcaaagcactgcccgctagcgaaaccccaaaagcagctgagtccgaaacccccggtaagagcccggaaaaaaaacccaaaattaaagaagaggccgtcaaggagaagtccccgagtctgggaaaaaaggacgcacgtcagactccaaagaaaccagaggccaaattctttaccacccctagtaaatctgtgcgtaaagcctcacacacgcccaaaaagtggcctaaaaagcctaaagtcccccagtccacttag

SEQ ID NO: 31744 - DNA, 1809 bp, Artificial Sequence
  Description of Artificial Sequence: Synthetic coding sequence
atggccgagttcagggtgagggtttcaactggggaggcattcggtgctggaacttgggacaaggtgtcggtgtctattgtgggtacccggggtgaatctccaccccttcctctggacaatttgggaaaggagttcacggccggtgcagaggaggattttcaggtgaccttaccagaggacgtgggacgcgtcctgcttctgcgcgttcacaaggcgcctccagtgctgccgctgctgggacccctggccccagacgcctggttttgccgctggtttcaactgacacccccacgaggtggccatctgctgtttccatgctaccagtggctcgagggagcaggcacgctcgtgctccaggaaggcacagcaaaagtctcttgggccgaccaccaccctgtgttacagcagcagcgccaggaagaacttcaagctagacaggagatgtatcaatggaaggcctataaccccggttggccccattgcctggacgagaagacagtggaggatctggaattaaacatcaaatactcaacagctaagaatgcaaatttctacctgcaagccggttcagcattcgctgagatgaaaatcaaggggcttctggaccgcaagggactgtggagaagtctgaatgagatgaaaagaatttttaattttagacgcaccccggctgccgaacatgcattcgagcactggcaagaggatgcatttttcgcttcccaattcttgaacggtctcaaccctgttttgatcagaagatgccattaccttcctaagaacttcccggtcacggacgcaatggtagctagcgtactgggtccagggacatcactccaggccgagcttgagaaggggagtctgtttctggttgaccacggtattttatccggtattcagacgaatgtgataaatggcaaaccacagttctctgccgcacctatgacactgttataccagtcccccggatgtgggccactgctgccgctcgcaattcagctatcgcaaactcctgggcctaattctccaattttcctgcctacagacgacaagtgggactggctgctcgctaagacctgggttcggaatgctgagttctcatttcacgaggctctcacccaccttctgcactcgcaccttctgcccgaggtattcactctcgccacacttcgtcaactgccgcactgtcaccccctcttcaaaagcactggtatcggaatagagggtttttctgagttgatccagaggaatatgaagcagctgaactactccttattgtgcctacctgaggatatcagaacacgtggggtggaagacatccccggatactactatcgagatgatggcatgcagatctggggtattccttcaagcttggagacgagggaagcgctggtgcaatacgtcacaatggtgattttcacgtgctctgccaagcacgccgcagtgagtgcaggacagtttgactcatgcgcctggatgccaaacctcccccctagcatgcagcttcctccgccaacgagcaaaggtctggccacctgcgaaggatttatcgcaacgctgccgccagtcaacgccacatgtgatgtgatcctcgccctttggctactgagcaaagagcctggggatcaacgcccactcggtacctacccggatgaacacttcactgaagaagctcctagacggagtatcgctacctttcagagccgcctagcccagatctcaagaggaatacaggagcgtaaccagggactggtgctgccctacacgtatctggatcctcccctgatcgaaaactcagtgtcaatctag

SEQ ID NO: 31745 - DNA, 618 bp, Artificial Sequence
  Description of Artificial Sequence: Synthetic coding sequence
atgtccgtggaccccatgacctacgaagctcagtttttcggctttacacctcagacttgcatgctgcgcatctatatcgcctttcaggactaccttttcgaagtgatgcaggccgtggagcaggttatactcaaaaaattagacgggatccctgactgcgatattagtcctgtccaaattcgcaagtgcacagaaaaatttctctgttttatgaaaggccatttcgataaccttttttctaagatggagcagctatttctccagctcattctgcggattccctctaatatcctcctgcccgaggacaaatgcaaagagaccccatacagcgaggaagacttccagcaccttcagaaggagatcgagcagctccaagagaagtacaagaccgagctctgtaccaagcaggcgttactcgccgaactggaagaacagaagattgtgcaggctaagcttaagcagacgttgacctttttcgacgagctacacaatgtgggccgagaccacggcacttcagactttagagaatctctggtctctctcgttcagaactcccggaaacttcagaatatccgggataacgtggaaaaggagagcaaacgcctgaagatctcctag

SEQ ID NO: 31746 - DNA, 360 bp, Artificial Sequence
  Description of Artificial Sequence: Synthetic coding sequence
atgatattgcaacagcccctgcaacgcggtccacagggcggtgctcagagacttcctcgcgctgcactgggagtgacctggggcttagacgcgcgtgaaccgcttcgaaaacagttcttgtctgaggagaacatggccacacattttagccagctatccctacataatgaccatccatattgtagcccaccgatgaccttctctccggcactgccgcctttaaggagtccttgctctgagctgctactgtggagatatcccggatcactgatccccgaggctctccgcctgctgagattgggtgacacaccatctccaccgtaccctgcgacgcccgctggggatatcatggagctctag

SEQ ID NO: 31747 - DNA, 1473 bp, Artificial Sequence
  Description of Artificial Sequence: Synthetic coding sequence
atgcccatgccaacggagggtacaccacctcctctgagcgggacacctattcccgttccggcttactttaggcatgccgagccaggcttttcattgaagagaccaagggggctgagcaggtcactcccaccacctccccctgccaaggggagtattcccatttctaggctcttcccacccaggacccccggatggcaccaactgcagccccgaagggtgtcctttagaggggaagcttcagaaactctccagtcaccgggatacgatccgtctcgtcccgagtcctttttccagcagtccttccagcgattgagcagacttgggcatggaagttacggggaagtatttaaagtcaggtcaaaggaggatggtcggctctatgccgtcaagaggagcatgagtccgttcagaggacctaaagacagggccagaaagctggcggaggtgggatcccacgaaaaggtgggccagcacccgtgttgtgttagactggagcaggcatgggaagagggtggtatactatacctccagaccgagttatgcggcccttctctgcaacagcactgcgaagcctggggcgctagtctccctgaggcccaagtctggggctatctgagggacactctgctcgctcttgcacatctacattcacagggattggtgcatctggatgtaaaacccgcaaatatcttcctggggcctcggggtagatgcaagctgggagacttcggcctgcttgtggaactcggcactgccggagccggtgaagtgcaggagggagatccaaggtatatggcacctgagctgctccaagggtcatacggcactgctgctgacgtcttcagcctgggcctcactattctggaagtcgcttgtaacatggaattacctcacggaggtgagggctggcagcagcttcgccagggatatttaccacctgaatttactgcaggactatcctcagaattgcgctctgttctggttatgatgctggaacccgatcctaaactcagggcaaccgcagaagccttgcttgcactccctgtcctgcgccagccccgagcctggggcgtcctgtggtgtatggctgcagaagccctctcacgaggctgggccctgtggcaggctctattagctctcctatgctggctctggcatggcttggcccaccctgcaagctggctacagcctctagggccacctgctaccccccctggatctcccccatgctctttattgctggactctagcctcagctccaattgggatgatgactccctgggaccaagtttgtcacctgaagctgtgctagcgcgtacagtggggagtacgtctactcctcgatcacggtgtacccctagggacgccttggaccttagcgatattaattcagaaccccctcgaggtagttttccctcatttgagccaagaaatctactttccttgtttgaagatacactggaccctacttag

SEQ ID NO: 31748 - DNA, 1293 bp, Artificial Sequence
  Description of Artificial Sequence: Synthetic coding sequence
atgcttgaaaggtggcaccagctccaaccaaggcgggtgtcttttcgaggcgaggcctcagagaccctgcagagcccaggctacgacccatctagacctgaatcctttttccaacagtcttttcagaggttatctcgtctcggccacggttcttacggtgaggtcttcaaagttaggtctaaggaagacgggcgattatatgccgtgaaacgtagcatgagtccattccgagggcctaaggacagggcgagaaaactggcagaagtgggcagccatgagaaagtgggacagcacccctgttgcgttagacttgaacaagcatgggaggaaggaggcattctctacctgcagacagaactgtgcggcccatccttgcaacagcactgtgaggcatggggagcttccttgcccgaggcccaggtatgggggtaccttcgagacaccctacttgccctcgcgcaccttcactcccaggggctggtgcacctggacgtcaagcccgctaacatattcttaggcccaagggggaggtgtaagttaggggattttggacttctggttgaacttggcactgccggagccggtgaagtccaggaaggcgatccgcgttacatggcccctgagcttctccagggtagttacgggaccgctgcagatgtgttcagcctagggctcaccattctcgaggtggcctgcaacatggaactgcctcacggaggcgagggatggcagcagctacggcagggatacctgcctccagagtttactgccggactgagctcggagctccggtcagtcctggtaatgatgctggaacccgatcccaagctgcgcgcaactgccgaggcccttttagccttacctgtgctgaggcagccacgggcttggggagtgctctggtgtatggccgctgaggcactgtcgagaggttgggcactttggcaagccctcttggcactcctctgctggctctggcacggattggcccatccagcttcctggctccagccactcgggcctcctgccactccacccggatcaccaccctgctctttgctgctcgattcgtcgctcagctccaattgggacgacgactcacttggtccttcactgagccccgaagccgtgctggctaggactgtggggagcacttctactcctcggtcccggtgcacccctcgcgacgcccttgacctttcagatattaacagtgagccccctcggggttcattcccatcttttgagccacgcaacctgctgtcgctgtttgaggacactctggacccaacttag

SEQ ID NO: 31749 - DNA, 666 bp, Artificial Sequence
  Description of Artificial Sequence: Synthetic coding sequence
atgcaggtgcaggatgatggggtgaaccttataccgttcgccaaatgcagtagagtggtcagccggagcccacctcctagattgccttcacagagtctgcggccaatgccccagcgctacggggacgttttttggaaaaacctgaatcaacgcccaacgcctacttggctggaagaacagcatataccccctatgctcttgcccccacctgagatgctgtggaggagaaagaagaggaggccctgtctggaaggaatgcagcagcagggcttgggtggagtcccggcaagagtgcgtgccgtaacctaccatctcgaagacctgaggcgtcgccaatcgatcataaacgaacttaaaaaagcccagtggggcagcagtggggctgcgagtgaacctgtggtgcttggggaagaaggctgcggctttccgagcactaacgagtatccagacctcgaggaggagagggctacctatccccaggaggaagaccgcttcctcacccccggtcgggcacagctgctgtggtctccttggtcccctctagatcaagaagaggcttgtgcttctcgacagctgcacagcttggcctctttctcaaccgttacggcacggagaaacccattacacaacccttgggggatggagctcgcagccagtgaagaatag

SEQ ID NO: 31750 - DNA, 2232 bp, Artificial Sequence
  Description of Artificial Sequence: Synthetic coding sequence
atggaggccgctgctgtgacagttacacgctccgcgacccggagacgacgtcgccaactgcaaggtctagctgctcccgaggctggaacgcaagaagaacaagaagatcaagaaccgagacctcgaagacggagaccaggccgtagcatcaaggacgaggaggaggagacggtgtttagggaagtggtgagctttagtcccgaccctctccccgtgcgctattacgataaggacactaccaaacctattagtttttatctgagttctttggaggagctgttagcatggaagccacgactggaggacggttttaacgtggctctggaacccttggcctgcaggcaacctccactttccagtcagcgtccacgaacactgttgtgccacgatatgatgggcggatatctcgacgaccgctttatacagggatccgtagtgcagacaccttatgcgttctatcattggcaatgcatcgatgtctttgtttacttttctcaccataccgtgactattccgccagtgggatggactaacactgcacatcggcatggcgtgtgcgtgctgggcactttcattaccgagtggaacgaagggggtaggctctgtgaggcgttcctcgcaggcgatgagagatcctaccaagccgtcgccgacaggctggtgcagattacccaattcttccggtttgacggctggctgattaacatagaaaatagtctctctctcgctgccgtgggaaacatgcctccattccttaggtaccttaccacccagcttcaccgccaggtcccgggaggactagttctgtggtacgattctgttgtccagtcgggtcaactgaagtggcaggacgaactaaaccaacacaatagagtgttttttgacagttgcgatggattttttactaactacaattggagggaggagcatctcgaaagaatgcttgggcaggcaggtgaaaggagagcagatgtatatgtgggcgttgacgtgtttgctagaggcaacgttgtagggggacggttcgacacggacaagtccctggagttaatcagaaagcatggattcagcgtcgctcttttcgcgcctggttgggtatacgaatgcctggaaaaaaaggattttttccaaaaccaggacaagttctggggtagactggaaagatacctgccaacccactccatctgctctctccctttcgtgacctccttttgcctgggaatgggagccaggcgcgtgtgttatgggcaggaggaggctgttgggccatggtatcatctgtcagcccaggagatccagccgctcttcggggaacaccgcctgggaggagacggacggggttgggtcaggacccactgctgtcttgaagacgcatggcatgggggatcaagtctactggtcagaggcgtcatcccaccagaggtcggaaatgtggcagtgcggctgttcagccttcaagccccagtgcctccaaagatctatctgtccatggtctataagctcgaggggcctacagatgtgactgtggccttagaactgactactggggatgctggttcctgccatatcggagggatcagcgtattgaatgccgagacttcttcaaggcattcattgcggcctttgcgggtaccacccactaagctggccaggtgggttggtcgctgcggcagacaactctctggtggctgggtgcagcattgttatgaggttagcctgagaggctgtctcctgctggacctcttggtgtgtttcagtcgccctccaggttcccgagaagaagaaagctttacttgtaggctgggtgagattcaagtggttgatgccgcaagcttgctcgcaccactgccccaagtgcaggccgtcaccatttctcatatcagatggcagccttcagcctccgaacgcgagggacctcccgctctgctccagttgtcatgcacgctgcattggagctttttgttgtcacaagtgcgttgcttccgaatccattgttggggcggaatgtccgacgactcccctggacgagagctgcccaggcccgaaatgccgatgttcttaggcctcgcctttgcaacccagtaccgaatcgtggatctgctggtggaagctgccggacccggtcaggatagaagaatggaattcctcgtcgagcctgtgcccaaggaggggttccgggtcccacaggcggagtggggcagagctgtccttctctacagcgctcctgcttag

SEQ ID NO: 31751 - DNA, 579 bp, Artificial Sequence
  Description of Artificial Sequence: Synthetic coding sequence
atgagtacagcagctgtacccgagcttaagcagatttccagagtggaggccatgagattaggcccaggatggagccatagctgccacgcaatgctgtatgccgcaaaccccggtcaactgttcggccgtattccaatgaggttcagcgttctgatgcaaatgcgcttcgatggtcttttaggctttcctgggggattcgtagatcggagattctggagcctggaggatgggctcaaccgggtgctgggcctgggattgggttgtctcaggctgactgaggccgactacctctccagccacttgaccgaaggaccacaccgagtggtggctcatttgtacgccagacagctcacactggagcagctgcatgctgtcgaaatttcagccgtccattctcgggaccacggccttgaagtgggccctcctccgggacctcgccctccgcctcgcggactggccttagcgccttggaaggctcccatgggcgcagggcctcgggcagggccagcggtgcaccctgaaggccctagtcgtcggttacctcagctgccggagcaaagactgcgagagcacggctag

SEQ ID NO: 31752 - DNA, 2553 bp, Artificial Sequence
  Description of Artificial Sequence: Synthetic coding sequence
atgctggagcgccgagccctcctgtggcagcgtgaggccggaccagggtggggggatagagctcgagcgggtacgggtggagccggtggcggttgtggcggagcaatggccgaacgcggacccgcattttgcggtctttacgacacctcttctctgctgaggtactgcaacgacgacaacctgagcgggacaagcgggatggaagtggacgatcgagtgtcagccctggagcaacgtctgcagctgcaggaggacgaactagcagttctcaaggcagccctcgctgacgcattaagacgtctccgagcttgtgaggagcagggagcagccctacgcgctcgtggaacaccaaagggtcgcgcacctcctaggctcggtactacagcgtctgtctgccagttgttaaagggcctccccaccaggacgccgttgaatggatctggccctcctaggcgtgtgggcggatacgcgacatccccgtcttcccccaagaaggaggctacctctggtcgatctagcgtaaggcggtatctgtccccagagaggctggcctctgtgagaagagaagatcctaggtctcggactacgtctagctcatccaactgctcagctaaaaaggaagggaagactaaggaggttattttctctgtggaggacggttcagttaagatgtttctgagggggaggccagtccctatgatgatccctgacgaactggcaccaacttacagtctggataccaggagcgaacttccctcctgtcgattgaagctggaatgggtgtatggctataggggaagggactgtcgtgcgaacctgtacctgctccctactggggagatagtatactttgttgcttcagtagccgtgttgtactcggtggaagagcagcgtcagcggcattatctcggccacaacgacgacatcaaatgcttggccatccaccccgatatggttacaatcgctactgggcaggtggctggcactacaaaagagggcaagccactccctccacacgtccgcatttgggattccgtgagcttatcaacacttcacgtcctcgggctaggcgtctttgatcgggcagtgtgttgcgtaggttttagcaaaagcaacgggggtaaccttctctgtgctgttgatgagagcaatgatcacatgcttagtgtttgggactgggccaaagagacaaaagtggtggatgtaaaatgcagtaatgaggccgtcctagtcgcaacctttcatcctaccgaccccacagttctcatcacctgtggtaagtcccacatctacttttggactttggaggggggttcactttcgaagaggcaaggactgttcgaaaaacatgaaaaacctaaatacgtgctgtgtgtgacattcttggaaggcggagatgtggtcacgggcgactcgggtgggaatctgtacgtgtgggggaagggaggcaacaggattacccaggctgttctgggcgcacatgatgggggtgtgtttggactctgcgccctcagggacggtacattggttagtggcggaggcagagaccgccgtgttgttttatggggatctgattacagtaagctccaggaggttgaagtaccggaggacttcggtcccgttcggactgtggctgaggggcacggcgatactctgtatgtcggtacaacccgtaattcaattctgcagggttcagtccatactggtttcagcctgctggtgcaagggcacgtggaggagctgtggggcctggccactcatccctcccgggctcaattcgtcacttgcgggcaggacaagctcgtacacctctggtccagtgacagccaccaaccgctctggtcaagaatcattgaggatcccgctcgctctgctggcttccacccttctgggagtgtcctcgcagtggggaccgtgacaggacgttggctgctattggacaccgaaactcacgatttggtggccattcatactgacggtaatgagcagatcagcgtggtatccttttccccagacggcgcatatctcgcagtgggttcacatgacaatctggtttacgtctatacagttgaccagggcggacgtaaggtaagcagactgggaaaatgtagtgggcatagttccttcatcacccatttggactgggctcaagattcctcctgctttgttaccaactccggagactacgagatcctctactgggatccagccacgtgcaagcagataactagtgctgacgctgtgagaaacatggagtgggctaccgctacctgtgtattaggattcggagtgtttggcatctggtcagaaggagcagacggaacagatatcaacgccgtcgcccgaagccatgacggcaagttgttggcttccgcggacgatttcggcaaggtacaccttttcagctacccatgctgccagcctagggctttaagccataagtatggaggccactcaagccacgtaaccaatgtagctttcctgtgggacgacagtatggccctcactacaggaggaaaggacacttctgtgctgcaatggagggtagtgtag

SEQ ID NO: 31753 - DNA, 2502 bp, Artificial Sequence
  Description of Artificial Sequence: Synthetic coding sequence
atggcggtcgaggacagcaccctgcaagtggtggttagggtgagacctcccaccccacgcgagttagactcacaaagaagaccggtggtgcaggtcgtcgacgagcgagtgctggtcttcaaccctgaagaacctgatgggggttttcctggtctgaaatggggcggaacgcacgacgggccaaagaagaaggggaaggacctcacattcgtatttgaccgcgttttcggtgaagctgccacccagcaggacgtctttcagcatacgacacactccgtcttggacagtttcctgcagggttacaactgctccgtatttgcatatggagctactggtgcgggaaagacccacacgatgctgggtcgggagggggatcccggtatcatgtacctgacaaccgtggaactgtatcggcgactcgaagcacgccagcaggagaaacacttcgaagtgctgattagctaccaggaagtgtataacgaacagattcacgatctgctcgagcccaagggaccgttggcaattagagaggatcccgacaagggggtggtggtacagggtttgtctttccatcagcccgcttctgccgagcagctgctggaaatacttacccgaggaaatcgtaatcgcactcagcaccctactgatgccaacgctaccagttcgcgctctcacgctattttccagatctttgtcaagcagcaggatagagtgcccggtttgacacaagctgtgcaggtcgccaagatgtctctgatcgatttggctggctccgagcgcgcaagtagtactcatgcaaagggcgaaaggctgcgcgaaggagcaaacatcaaccggtcactactggctcttattaacgtccttaatgcattggccgatgccaaaggacggaagacccacgtcccctatagggacagtaagctgacgcgactgctcaaggatagcttgggtggcaattgcaggacagttatgatcgcagccatttcgccttcctctctcacctacgaagacacgtataacaccttgaagtatgccgaccgggctaaagaaatccggctctctctgaaatccaatgtgaccagcctcgattgccatatttcccaatatgctaccatatgccagcagttgcaggccgaagtggctgcactgaggaaaaagctgcaagtctatgagggtggcggacagcctccaccacaagacttgcccggttctcccaagtcgggtccacctccagagcacctgccgagcagtccccttcctccccacccgccatcacagccatgcacacctgagctgcctgccggtcctagagccctccaggaagagtcccttggtatggaggcacaagttgaacgggctatggagggaaacagctctgatcaggagcagagtccagaagacgaggacgagggaccagccgaggaggtgccaacccaaatgcctgaacagaatcctacacatgcgcttcccgagtctccaagactcacactccagcccaagccagtggttggacacttttctgccagggagctggacggcgatcgcagtaagcagctcgctctgaaagtgctgtgcgttgcacagaggcagtattctctgttacaagcggctaatctgctgacaccagacatgattacagaattcgagacactgcagcagttagtgcaggaggagaaaatcgaaccaggggcagaagcccttcggacctccggtctggccaggggagcacccttagctcaggaactgtgttctgagtccatacccgtgccaagtcccctgtgtcccgaaccccctggatacactggacccgtaacacgcacaatggcgcgaaggctatccgggccactccataccctgggaattccacccggaccaaattgcacccccgcacaaggctcaaggtggcccatggaaaaaaagaggcggcgaccatcagctctcgaggcagactcccccatggctccaaagaggggcactaaacgccagcgacagagctttctgccgtgtctgcggagaggatctctaccagacacacagccaagccagggtccctcgacgcctaagggtgaacgcgctagctccccgtgccattcaccacgcgtatgcccagccaccgttatcaagtcacgcgtgcccctgggcccatcggccatgcagaactgtagtacgccactggccctcccgacaagagatttgaatgccacctttgacctcagtgaggagcctccatctaagcctagttttcacgagtgcattgggtgggacaagatacctcaagagctctcaaggctggaccagcctttcatcccacgcgcacccgtaccattgttcacaatgaagggtccgaaacctacgagctctctccccggaacttctgcttgtaagaagaaacgagttgccagttcaagcgtatcacatgggagatccagaattgccagacttccatcttcgacactgaagcgcccagcgggtcctctggtgctgcccggagattggcattag

SEQ ID NO: 31754 - DNA, 3351 bp, Artificial Sequence
  Description of Artificial Sequence: Synthetic coding sequence
atgtatggtagtgccagatctgtgggaaaggttgagccatccagccagtcccctggaagatcacctaggctgccacgatccccacgactcggccaccgtcggaccaacagcactggaggttcatccggatcatccgtggggggtggaagcggaaagactctcagcatggaaaacattcagtctctcaatgctgcctatgccacctcaggccctatgtatttgtcggaccatgaaaatgttggcagcgaaaccccaaagtcaacaatgacgcttgggagaagcgggggaagattaccttacggcgtcaggatgacagcgatgggctcttccccaaacatcgcctcatctggcgtcgcatcagataccattgcattcggagagcatcacctgcctcccgtttctatggcctctacagtgccccactcgctgaggcaggccagagacaatacaatcatggacctgcaaacacaactcaaggaagtgctgcgggagaacgatctactgcgaaaggatgtcgaagtgaaagaatccaaactcagcagctcaatgaattccataaaaaccttctggtcaccggaactgaaaaaagagcgcgctctgcgaaaggatgaagccagtaaaatcactatctggaaggaacagtacagagtcgtacaggaagaaaaccagcacatgcaaatgaccattcaggctctccaggacgagctgcgtattcagagggacctgaaccagttattccaacaggactccagctctaggactggagaaccttgcgtcgccgaattgacggaagaaaatttccaaaggctacacgctgaacacgagcgacaggcaaaggaactattcctgcttcggaaaacccttgaggaaatggaactcaggatcgagactcaaaagcaaacactcaacgcacgcgatgagagtataaagaaactgctggagatgctccagtccaaaggtctcagcgcgaaggcaactgaagaagaccacgagaggaccagaagactggccgaagccgaaatgcatgtgcatcatctggaaagtctgttagaacagaaggaaaaggaaaattccatgctgagagaggaaatgcatagaagattcgagaacgcccctgattccgccaaaaccaaagctctccaaacagtgatcgaaatgaaggacagcaagatttcgagtatggaacgcggtctcagagacctggaggaggagatccagatgttaaaatctaacggagccttatcaacagaagagcgcgaagaggaaatgaaacagatggaggtgtaccgaagccacagtaagttcatgaagaataaagtggaacagctgaaggaggagctgtcctccaaggaggcacagtgggaggagttaaagaaaaaggctgcgggtctccaagcggagatcgggcaggtaaaacaggagctgagtcggaaagatacagaattactggccttacaaaccaaactcgagacactgactaatcagtttagtgattctaaacagcatattgaggttctgaaagagtctctgacagccaaggagcaacgagcagctattctccagaccgaagtggacgccctgcgcctgcggctggaagaaaaagagaccatgctgaacaaaaagaccaagcagatacaggatatggccgaggaaaaaggcactcaggccggagagattcatgatttaaaagacatgctcgacgtgaaggagcggaaggtgaatgtcttgcagaaaaaaatcgaaaatctgcaggagcaactcagagataaagaaaaacaaatgagcagcctaaaagagcgtgtgaagtccctgcaggctgacaccaccaacacggacaccgccctgactactctcgaagaagcgttggctgaaaaggaacgtacaatagagaggctgaaggaacaaagggaccgcgatgagagagaaaaacaggaggaaatcgataactataagaaagatctaaaagacctgaaggagaaggtgagtcttctccaaggtgacctgtccgaaaaggaggccagcctccttgatttaaaggagcatgccagcagtctggcttcaagtggcctgaagaaagacagccgtctcaagacgctggagatcgcgctggagcagaagaaggaggagtgtctgaaaatggaatctcagttgaaaaaggcccacgaggctgctttggaagccagagcaagccctgagatgtcagacagaattcagcacctcgaacgtgagatcacaaggtacaaggatgagtctagtaaagcacaggcagaagtcgatcggctactggaaattctcaaggaggtagaaaacgagaagaacgacaaggacaagaaaattgccgagctggaaaggcaggttaaagatcagaataaaaaggtggctaacctcaaacataaggagcaggttgagaagaaaaagtctgcgcaaatgctggaggaagcaagacgcagggaggataatctcaacgatagtagccagcagttgcaggacagtctccggaaaaaagatgatcgaattgaagagctggaagaagccttgcgagaaagtgttcagatcactgccgagcgggagatggtgcttgcccaagaggagagtgccaggaccaatgccgagaaacaagttgaagagctgctcatggcaatggagaaagttaagcaggagctggagagtatgaaggcaaagctgtcctccacgcagcagtccctggcagaaaaggagactcaccttactaatttacgggctgaaagacgtaaacacctcgaggaagttctggagatgaagcaggaagctctcctggcagccatcagtgagaaggacgcaaacatagcacttctcgaactttcgagttccaagaagaagacccaggaggaagtcgctgcacttaagcgggagaaagaccgcctcgtgcagcagcttaagcaacagacccaaaataggatgaaacttatggccgataactacgaggatgatcacttcaagtcctcccacagcaatcagactaaccacaaaccatccccggatcaaatcatccaacccttgttggaactagaccagaatcgatctaaactgaaattgtatatcggccatctgaccacgctctgccatgatagggatcctctaattctcagaggtttaacgccgccagcctcttacaatcttgatgacgaccaggcagcttgggaaaatgaactgcagaagatgacacgaggccaactccaggatgaattggaaaagggagaacgggataatgccgaattacaggagttcgccaacgccattctgcaacaaatcgcagatcattgcccagacattctggagcaggttgtcaacgctttggaggaaagctcttag

SEQ ID NO: 31755 - DNA, 2055 bp, Artificial Sequence
  Description of Artificial Sequence: Synthetic coding sequence
atgatccctccccaggaagcatctgccaggaggcgagaaatagaggataagcttaagcaggaagaggagaccctctcctttataagggactccctggagaagagtgaccagcttactaagaatatggttagcatcttgagttctttcgagtctcgactgatgaagctggaaaatagcattatccccgtgcataaacagactgagaacctgcagagactccaggagaatgtggagaagactctttcctgcctggaccatgtaatcagttattatcacgtagctagcgacactgaaaagatcatacgcgagggacctacaggtcgccttgaggaatacctcggctcgatggctaagatacaaaaggcagttgaatactttcaggacaattctcctgatagtccagagttgaacaaggtgaagttgcttttcgagcggggtaaggaggccctagagagtgagttccggagtcttatgaccaggcacagtaaagtggttagcccagtgctgattttagacctgatcagcggagatgacgacctggaggcacaagaggacgtgacactggaacacctgcccgaatctgtgcttcaagacgtgattagaatcagcagatggctggtcgagtatggccgtaatcaggactttatgaatgtctattatcagatccgctcaagtcaactggataggtccatcaagggcctcaaggagcatttccacaagtcttccagttcgtccggcgtgccttatagccccgcaatcccaaacaagagaaaggatacaccaaccaagaaaccagtgaagcgacctggcactattagaaaggcccagaacctactcaaacagtatagtcaacacggacttgacgggaaaaagggtggatctaacctgattccactagaaggcagggatgacatgcttgatgtcgaaacagacgcctatatccactgtgtcagcgcctttgtgaagctcgctcaatcagaatatcagctgctggccgatattatcccagagcaccatcaaaagaaaacatttgactccctgattcaggatgcccttgacggactgatgctggaaggtgaaaacatcgtttctgcagccagaaaagccatcgtgagacatgatttctccaccgttctgaccgtcttccccatcctgaggcacctcaagcagactaaaccggagttcgatcaagtcctgcaagggaccgcggcaagcacaaagaataaattaccaggcttgattacttccatggagaccataggagccaaagctctcgaggatttcgctgataatattaagaatgatcccgataaagagtacaatatgccaaaggacggtactgttcacgagctgacctccaacgcaatcctgtttctgcaacagttgctcgactttcaggagactgccggtgcgatgctcgctagccaagagaccagctctagtgccacttcttactcatccgagtttagcaagcgtctcctgagcacatatatctgtaaggtgctgggcaacctgcagctgaatctcttatccaaatctaaggtgtatgaggatcccgctttatccgccatctttctgcacaataactataactacatactaaaatctctggaaaagtctgagctgatccagctcgttgccgtgacacagaaaaccgctgagaggtcataccgcgagcatatcgagcaacagattcagacgtaccagagatcatggttgaaagtgactgactatatcgcagaaaaaaacttgccagtgtttcagcccggagtcaagctgcgcgacaaggaaagacagataattaaggagcgcttcaaaggttttaatgacggacttgaggaactgtgtaagatccagaaagcttgggcaatcccagacaccgaacagcgcgatcggatcagacaagcacagaagaccatcgtgaaggagacctatggagcttttctgcaaaaattcgggtcagtgcccttcacaaagaaccccgagaagtacatcaagtatggtgtggaacaagttggcgatatgatcgataggctgtttgatacctccgcctag

SEQ ID NO: 31756 - DNA, 378 bp, Artificial Sequence
  Description of Artificial Sequence: Synthetic coding sequence
atggccgacgaagaactcgaggccctcaggaggcagcgactagctgagctacaagcaaaacacggagaccccggagacgccgctcagcaagaagcgaaacaccgggaagcggaaatgcgcaactccatactagcgcaggtcttagaccaatcagcccgagcgagactgagcaatctggctttagttaaacctgagaaaactaaggcagtagagaactacctaatacagatggcaagatacgggcagcttagcgagaaggtgtcagagcagggactcattgaaatactcaagaaggtcagccagcaaaccgagaagactaccacagtgaagtttaaccgcaggaaggtgatggattcagatgaagacgacgactattag

SEQ ID NO: 31757 - DNA, 3327 bp, Artificial Sequence
  Description of Artificial Sequence: Synthetic coding sequence
atggcactgcgcccaggcgctggctccgggggtggcggagccgcaggagcaggagccggatccgctggagggggtgggtttatgtttcctgtggccggagggatccggcctcctcaagccggactgatgccaatgcagcaacagggctttcctatggtaagcgtgatgcagccaaatatgcaaggcatcatgggcatgaattacagctcacagatgagtcagggccctattgcaatgcaagccggaattcccatgggaccaatgcctgccgcaggaatgccttatcttggacaagccccattccttggaatgaggccccctggacctcaatatactccagacatgcagaagcaattcgctgaagagcagcagaaacgatttgaacagcagcagaagctattggaggaggagcgcaaacggaggcagtttgaggaacagaagcagaagctgcggttgttgtccagcgtgaaacctaagacaggcgagaaatcaagagacgacgcacttgaggccattaaaggaaacttggacggcttctctcgagatgcaaaaatgcatcccaccccagcctctcaccctaaaaagccaggcgtgggagtttttccaagccaggacccagcccagccacgcatgcccccatggatctataacgagtcacttgtccctgatgcctataagaagattttggaaacaacgatgacccccactgggatcgacactgccaagctgtatcctatcttgatgagttctgggctgcctagagaaacactcggacagatttgggctctggctaatcggacaacccctggaaagttaaccaaagaggagctttacacagttctcgctatgatagcagtgacacaagtggtgaagccagaggaggacgattttcaggatttccaggacgcaagcaagagcggatccctcgacgactctttctccgatttccaggaactgcctgcatcttccaaaacatccaatagccagcacggcaactccgccccttccctcctgatgcccctacccggtactaaggcgctgccgtctatggacaagtacgcggtgtttaagggaattgcagcagataagtcatccgaaaatacagttccacccggagacccaggagataagtactcagctttccgcgagcttgaacagaccgcagagaataagccgttaggtgagagtttcgccgaattcaggtccgcaggaacagatgacggctttactgacttcaaaacggccgactctgtctcccccctcgaacccccaaccaaagataaaacatttcccccttcctttccttccggaacgatacagcaaaaacagcagactcaggtgaaaaatcccttaaacctggccgacctcgatatgttctcctcagtgaattgctcctctgaaaagccgctgtccttttcggcagtgttctccacctcaaagtccgtgtctaccccccagtccactggctcagctgccactatgactgccctggcagccacaaagactagctcactggccgacgactttggcgagttcagcttgtttggtgaatacagcggcctggcccctgtgggtgagcaggacgatttcgcagacttcatggccttctccaattcgtccattagtagcgaacagaaacccgatgacaagtatgacgcactcaaggaagaggcaagtccagtgcctcttacttcaaatgtcggctctaccgtaaagggtggtcagaacagcaccgccgcttccacaaagtacgacgtattccggcaattgtcactggaggggtcggggttaggagtggaggatctaaaggataacaccccttccggcaagagcgatgatgattttgctgattttcacagctctaaattctctagcattaactcagataagagtttaggggaaaaagccgttgcttttagacacactaaggaggatagcgcctctgtcaagagcttagatctgccgtccataggcggatccagcgtcgggaaggaagacagcgaagacgccttatccgttcaattcgacatgaagctggctgacgtcggcggagacctaaagcacgtgatgagtgacagtagcctggacctgccaacagtgtcgggccaacaccctccggcagccgctggctccggtagtccctccgccacgtctattctgcagaaaaaagaaaccagctttggtagctccgaaaacattaccatgacctccttgagtaaagtcactacattcgtttccgaggacgccctgcccgagacaacattcccggcactggcctcctttaaagatacaatcccccagacctccgagcagaaggagtatgagaacagggattacaaggactttactaagcaggacctgccaaccgcagaacggtcccaggaggctacctgtcctagcccggcatccagcggggctagccaagagactccaaatgagtgcagcgatgactttggggagttccagtcagaaaaaccaaaaatctcaaagtttgattttttggtggccacctcacagagtaaaatgaagagtagtgaggagatgattaagtccgagctggccacttttgatctgagcgtgcagggctcccacaagagatcgctttccctgggcgataaggaaatttcacggtcttccccctcaccggcactggaacagccgtttagagaccgcagtaacacattgaacgagaagcccgctctccctgtgatacgggacaaatataaggacctcacaggggaggtggaagagaacgaaagatacgcttacgaatggcagaggtgcttaggctctgctctaaatgtgataaagaaggccaacgatacgctcaatggcatttcctcaagcagcgtctgtactgaggtgatccagtcggcccagggaatggaatatctacttggcgtcgtcgaggtgtaccgagtgactaaacgcgttgagctgggcattaaggcaacagctgtatgttccgagaagttacagcagctgctcaaggatatcgacaaggtttggaacaacctgattggttttatgtcactggccaccctaacaccggatgagaattcactggacttctcctcgtgtatgcttcgcccagggattaaaaatgcacaggagttggcatgtggtgtctgcctgctaaacgtggatagccgatcccgtaaagaggaaaaacctgctgaggagcatcccaaaaaagctttcaatagcgaaacagattccttcaaactcgcatatggaggacatcaataccatgcaagctgcgccaacttttggataaattgtgtggaacccaagcctcccggtcttgtgttgcctgatttgctgtag

SEQ ID NO: 31758 - DNA, 594 bp, Artificial Sequence
  Description of Artificial Sequence: Synthetic coding sequence
atggcagccttccgagacattgaagaggtgtcccaggggctactgtcgctgcttggcgctaacagagcagaggcacagcaaagaaggctattgggacgacatgagcaggtcgttgagcgcctactggagactcaggatggtgccgagaaacagctgagagagatcctgactatggaaaaagaggtcgcgcagtcattgcttaatgcaaaagagcaggtgcaccaaggtggggtggaattgcagcagcttgaagccggtttgcaggaagctggtgaggaggataccaggcttaaggcctcactgctccaattgacacgagaactcgaggagctcaaggagattgaagcagacctagaaaggcaagaaaaggaggtggacgaagacaccaccgtcaccattccttccgccgtctatgtggcccagttgtaccatcaggttagcaaaatcgaatgggattatgaatgcgaaccaggcatggtaaaaggcatccatcacggaccgtctgtagcccagccaatccacttggattcaactcagctgtctcggaaattcatcagcgactatctgtggtctttggtagatactgagtggtag

SEQ ID NO: 31759 - DNA, 906 bp, Artificial Sequence
  Description of Artificial Sequence: Synthetic coding sequence
atgacaagacatgggaagaattgcaccgctggggcagtgtatacataccacgaaaaaaaaaaggacacagccgcttctggatatggcacccagaatattaggttgagtcgggacgccgtgaaggatttcgactgttgttgcctctcgctgcagccgtgtcatgatcctgtggtgacacctgatggatatctgtacgaaagggaagccattttggaatacatcttgcatcagaagaaagaaatcgcccgacagatgaaggcatatgaaaagcagcgagggacccgcagggaagagcagaaagagcttcagcgcgctgctagccaggatcatgtgcgcggattccttgaaaaggaatccgctatagtgtcccggccacttaacccgtttacagcaaaggctctttctggaacttctcccgatgatgttcagcccggacccagcgtcggtcctccgtctaaagataaagacaaggtactgccaagtttctggatcccctccttgactcctgaggccaaggcgacaaagttggaaaagccttccagaaccgtaacctgtcccatgagcggaaaaccactaagaatgagcgacttgactcccgtgcacttcacgcctttggactcatctgttgatagggtaggcctcataactcgctcagaacggtatgtgtgtgcagtgacaagagactccttgtctaatgctaccccctgcgccgtcctgagacctagcggagccgtggtgaccttggagtgcgtggaaaaattgatcaggaaggacatggttgatcctgtgacaggagataagttaactgatagggatattatcgtacttcagcgcggaggcacaggttttgcaggttccggcgtcaagttacaggccgaaaagtcaaggcctgtcatgcaagcctag

SEQ ID NO: 31760 - DNA, 990 bp, Artificial Sequence
  Description of Artificial Sequence: Synthetic coding sequence
atggaggtggcggagccatcttcgcctaccgaggaagaggaggaggaggaagagcattctgcggagcccaggcccagaaccaggtctaaccccgaaggtgcagaagatagagccgttggtgcccaggccagtgtaggctctcggagcgagggagagggcgaagccgcatccgccgacgatggctcactgaatacatctggggcagggccaaagagttggcaggtgccgcctccagccccagaagtgcaaatacgcactccgagggttaactgtccagagaaggttattatttgtctcgatctcagcgaagaaatgtccctgcctaagctagaatcatttaatggctctaagacaaatgctctaaatgtatcacagaaaatgattgagatgtttgttcgcaccaagcataagatagataagagccacgagtttgctctcgtcgtggtcaatgacgatacagcttggctaagcggtctgacgtctgaccctagagagctatgttcttgcctgtatgatctagagactgccagctgttccacctttaacctcgagggacttttcagcttaattcaacaaaagactgagttaccagtgacagagaatgtgcagacaatccccccaccctacgtggtccggactattttggtctattcacggcctccatgtcagcctcagttctcactgacggagcctatgaagaagatgtttcagtgcccatatttcttcttcgacgtcgtgtacattcataatgggaccgaagagaaggaagaggagatgtcctggaaggacatgtttgcattcatggggtcactcgacacaaaaggcacttcttataaatatgaagtcgcactcgccggtcccgcattggagttgcataactgcatggcgaagctgttggcccatccgcttcagcgaccatgccagtcccacgcctcttactctctactggaggaggaggatgaggcaatcgaggtggaagccacagtctag

SEQ ID NO: 31761 - DNA, 1263 bp, Artificial Sequence
  Description of Artificial Sequence: Synthetic coding sequence
atgctcagttcatttccagtggtcctcttggagactatgagccactacaccgatgagcctcggtttactatcgagcagatcgacctcttacaacgtctacgtcgtactggcatgacgaaacacgaaatcttgcacgctctcgagacacttgacaggctcgaccaggagcactctgacaagttcggacgcaggtcgagctatgggggttcctcatacggtaatagcacgaataacgtccccgcatcaagttcaactgcgaccgcaagcacccagacccagcacagcgggatgagcccgtcccctagtaattcttacgatacttcccctcagccttgtactacaaaccagaatggtagagagaacaatgaacgcttatccacgagcaacggtaaaatgtctcccactagataccatgccaatagtatgggacagaggtcctattcgtttgaggccagcgaagaggatctggatgtggatgacaaggtggaggaactgatgcgccgagacagtagcgtgattaaagaagagattaaagccttcctagcaaataggcggatctctcaggccgtggttgcacaagttaccgggatttctcaatcacggatatcacactggcttctacagcagggatctgatctctctgaacaaaaaaagagagcattttatagatggtaccagctcgaaaagaccaaccccggagccactctctccatgagacccgcacctattcccatcgaggaccctgagtggaggcaaacaccccctcccgtcagcgcgacgtccgggacattcagattacgcagagggagccgttttacttggcgcaaagagtgtctggcagtgatggagtcctactttaatgagaaccaatacccagatgaggctaagcgggaggagattgccaatgcctgcaacgccgtgatacagaagcccggaaaaaagctgtccgacttagagagggtcacatcccttaaggtttataattggttcgccaaccgcaggaaagaaatcaagagaagagcaaacatcgaagctgccatcctcgagtcccatggaattgatgtccagagccccggaggccattcaaatagtgacgacgtcgacggaaatgactactctgaacaggatgactctacaagccactctgatcaccaggatccgatcagccttgcggtggagatggccgctgtaaatcacaccatcctggccctcgctcgccagggtgccaacgagatcaaaacagaagcattggatgacgactag

SEQ ID NO: 31762 - DNA, 1263 bp, Artificial Sequence
  Description of Artificial Sequence: Synthetic coding sequence
atgctctcaagtttccctgttgtgctcctcgaaacaatgagtcactacacagatgagccacgctttaccattgagcagattgacttgcttcagcgcctgaggcgcaccggtatgactaagcacgagatactgcacgctctcgagacgctggatcggcttgatcaggagcacagcgacaaattcggcagacgctctagttacggaggcagctcttacggtaattctactaacaatgtgcccgcatctagttcgacagctactgcatccacccagactcaacacagcggcatgagtcctagtccctcaaattcatacgatactagccctcagccttgcactacaaatcagaatggcagggaaaataacgaaaggctgtcgacaagtaatggcaagatgtctcccacccggtatcatgctaactctatgggtcagcgtagttacagtttcgaggcgagtgaagaagatttagacgtggacgataaagtcgaggagctgatgcgccgtgactccagcgttattaaagaggaaatcaaagcctttcttgccaatagacgcattagccaagccgttgtggcccaggtgaccgggatatcacagagccgcatttcacactggctgttacagcagggttccgatctgagcgaacagaagaagagagccttttaccgctggtatcagctagagaaaactaatccaggcgcaacattatctatgaggcctgcccctatccccatagaggacccggagtggcgccagaccccaccccctgtgagcgcgaccagcggcacttttcgattgaggcggggttctcgcttcacatggcgtaaagagtgcctggccgttatggaaagctattttaatgagaaccagtacccagatgaggctaagagagaggagatcgcaaatgcgtgtaacgcagttatacaaaagccaggcaaaaagctaagcgatctggaacgcgtcacttccctgaaagtctacaactggtttgcgaaccggaggaaagagattaaaaggcgcgcaaatatcgaggcagccatcctagagtctcacggcattgacgttcagtcacctggtggacacagtaatagcgatgatgttgatggaaacgactacagtgagcaggacgatagtacatcccactccgatcatcaggaccccatctccctcgcagtggaaatggcagccgtcaatcacaccattcttgccctcgcgaggcagggcgctaacgagatcaagaccgaagcgttggatgatgactag

SEQ ID NO: 31763 - DNA, 915 bp, Artificial Sequence
  Description of Artificial Sequence: Synthetic coding sequence
atgctgagctcgttcccagtcgtgcttttggagacaatgagtcattatacggacgagccgaggtttacgattgagcaaatcgatctgcttcagcgtctgcgtcggaccggcatgactaagcacgagattctccatgcgctcgagaccctggaccgcctcgatcaggagcatagtgataagttcgggagaagatcctcgtacggcggatccagctatgggaattctacaaataacgtgcccgcttcatcgagtactgcaaccgcgtctactcaaacccagcattccggtatgagcccaagcccctccaactcctacgatacgtcgcctcagccatgtaccacaaatcagaacggccgagagaataacgaacggctttcaacttcaaacggcaagatgtcaccaacaaggtaccatgccaacagcatgggccagaggagctattcgtttgaggccagcgaagaagacctggatgtcgatgataaagtggaggagctgatgcgacgggattcctccgtcataaaagaagagatcaaagcctttctcgccaacagacgcattagccaggctgtcgtggcccaagtgactggcatttcacagtctcgaatctctcattggcttttgcagcaaggttccgatctgagtgagcagaaaaagagagcattttaccgatggtaccagctagagaagactaacccgggagccactctgagtatgagacctgccccaatcccaatagaagaccccgagtggaggcagaccccacccccagtctcagctacttctgggacatttcggcttaggagagggtctagatttacttggcggaaagagtgcctggccgtgatggaacgcaatacctggtcgcccgagagaagaatggaagaaaacaaatggaaactgctcagcgccggttag

SEQ ID NO: 31764 - DNA, 1332 bp, Artificial Sequence
  Description of Artificial Sequence: Synthetic coding sequence
atgctctcaagtttcccagttgtgcttttggaaactatgtctcactacactgatgaaccacgattcaccatagaacagattgatctgctccagagactgagacgcacaggtatgaccaagcacgaaattttgcacgcattggagacacttgaccgcctcgatcaagagcactctgataaatttggccgtcgctccagctatggtggctctagctatggcaattccacgaacaacgtacccgcatcatcaagtaccgcaactgccagcacccagacacaacattctggaatgagcccctccccctcaaactcttacgacacgagcccccagccatgtactaccaatcagaatggaagagaaaacaatgaacgcctctccaccagtaatggcaagatgtcccccactaggtaccatgcgaactcgatgggacagaggtcatactcattcgaagccagtgaagaagacctggacgtggatgataaggtggaggagttgatgagacgtgacagttcggtgatcaaagaggagattaaagcatttctggccaatcgacgaatttcccaggccgtcgtggcccaggtcaccggtatcagccagtcccgcatctcacactggctcctgcagcaaggaagcgatctcagcgaacagaagaagagggccttctaccgctggtaccaattagaaaagacgaaccctggagccaccctttctatgagacccgcacccatacctatagaagacccagagtggcgacagacaccccctccagtgtccgctacaagtgggacattcagactcagacggggtagccggtttacatggagaaaagaatgtttagcagtgatggagagctacttcaatgagaatcagtaccctgacgaagccaaacgggaagaaatcgctaacgcctgtaacgcagttatacaaaagcccggtaagaaattgtccgacctcgaacgcgttacatccctcaaagtgtataattggtttgcaaataggagaaaggagatcaaaagaagagccaacatagcggcaatcttggaaagccatgggatcgacgtccagtccccgggagggcactcaaattccgacgacgtggatggcaacgactatagcgaacaagatacatggcaggtgcgcaatggagaagaagaggaaggtaggagcagcgagggcggacgagaagccgaaaaagacgatagcacgtctcatagcgatcaccaggatcctataagcctggccgtggagatggctgccgtgaaccatacaattttagccctggcccgtcagggggcaaatgagataaagaccgaggcgttggatgatgattag

SEQ ID NO: 31765 - DNA, 357 bp, Artificial Sequence
  Description of Artificial Sequence: Synthetic coding sequence
atgctaagtagtttccccgttgtgctgctcgagacaatgagccattatacagacgagcccaggtttacgattgagcagatcgacttgttgcagcggctgagacgcactggaatgactaagcacgagatacttcatgcgctggagaccttggaccggctcgatcaggagcactccgacaagtttggccgtcgtagctcctacgggggttcaagttacggtaattctacaaacaacgtgcccgctagcagttcaactgctacggcaagcacacagactcagcacagcggaatgtctccaagtcccagcaattcttacgatacctctcctcagccgtgtacgacaaatcagaatggatag

SEQ ID NO: 31766 - DNA, 1332 bp, Artificial Sequence
  Description of Artificial Sequence: Synthetic coding sequence
atgctctcaagttttcccgtcgtgcttctggagacgatgtctcattacaccgacgaacctcgattcaccatcgagcaaatcgacttactgcagcgcctccgacgcacaggtatgactaagcacgaaatcctccatgctttggaaactctggacagactggatcaggagcactccgacaagttcggaaggcgatcctcatatggcggatccagctacggtaattctacaaacaatgtcccggcaagctcttctaccgcgacggcctctacccagacccagcattcaggaatgtcaccttcaccttccaattcctatgacacttcaccccagccttgtacaacaaaccagaatgggcgtgagaataacgaacgcctctctacctcaaatggtaagatgagccccacccgatatcatgctaattccatgggtcagcgttcctactcatttgaagcctccgaagaagacctggacgtcgacgacaaggtcgaagagctgatgcgaagggatagctctgtcataaaagaagaaattaaggctttccttgcaaacagaagaatatcccaggccgtggtggcccaggtcacaggcatatcccagagccggatatcgcattggctcctccagcaaggctcggatttaagtgaacagaagaagcgcgctttttacaggtggtatcaattggaaaagaccaacccaggcgctaccctatcaatgcggccagcaccgatccctatcgaggatcccgaatggcgccaaaccccacctccagtttctgccacttctgggacttttcgcttacgccgtgggtccagattcacctggcggaaagaatgcttggctgttatggaatcctactttaacgaaaaccagtaccccgatgaagccaaacgggaggaaatcgctaacgcctgtaatgccgtcattcagaaacccggtaaaaaactgagcgacctcgagagggttacgagcctgaaggtctacaactggttcgccaaccgtcgcaaagaaatcaagcggcgtgcgaacattgcagctattctggagagtcacggaattgacgtgcagtctcctggtggccactctaactcggatgatgtggacggaaacgattacagtgaacaggatacctggcaggtgcgaaacggcgaagaagaggaaggccgaagtagtgaagggggacgtgaagctgaaaaggacgactctacctcccacagtgaccatcaggaccctatttcactggcagtggaaatggccgcagtcaaccatactattctggcactcgctagacagggagcaaacgaaatcaagacagaggcgctagatgatgactag

SEQ ID NO: 31767 - DNA, 1218 bp, Artificial Sequence
  Description of Artificial Sequence: Synthetic coding sequence
atgctgagcagctttcctgtggttcttctcgagactatgtcccattatacagacgaacctagatttaccatcgaacaaatagatttgttacaaagactccggagaactggtatgactaagcacgaaatcttgcatgccctggagactcttgacagattggaccaagagcattctgacaaattcggacggaggtcctcctatggaggctcttcatacggcaactctaccaacaatgtgccagcatcgtcatccacagcaacagccagcactcaaacccagcacagcggcatgtcccccagccccagtaatagttacgatacgtccccacagccatgtaccaccaaccagaatgggagagagaacaatgagcgtttgtcaacaagtaatggaaagatgtcccccaccagataccatgcaaacagtatgggacaaaggtcgtacagcttcgaggcatctgaggaagatctggatgtcgacgataaggtcgaagagttaatgcgcagggactcaagtgtgatcaaggaggaaattaaagcttttctcgctaacagacggatcagccaagcagtagtcgcacaagttactggaatcagccaatcgaggattagccattggttgctgcagcaaggtagtgacctctctgaacagaaaaaacgcgctttctaccggtggtaccagcttgagaaaaccaaccccggtgccaccctgagcatgcgtcccgctccgattccaatcgaggatcccgaatggcgtcagacacctccgcctgtttcagccacctcgggtacttttaggctccgcaggggtagtagattcacgtggcgcaaggagtgtctggccgtaatggagtcttacttcaacgaaaatcagtacccagatgaagctaagagagaggaaatcgcaaatgcttgtaatgctgtgatccagaagcccggaaaaaagttgagcgatttggaaagagtcacatcactgaaagtctacaactggtttgcgaacagaagaaaggagatcaagcgacgagctaacattgctgccatcttagaatcacatggcattgacgtacagtcccccggtggtcactctaacagcgatgatgtggatggaaacgactacagcgaacaggacacgtggcaggtcagaaatggcgaggaggaggaagggagaagcagtgagggtgggcgagaggccgaaaaggtagaggaggaaagacggatatag

SEQ ID NO: 31768 - RNA, 1380 nt, Artificial Sequence
  Description of Artificial Sequence: Synthetic coding sequence
augacggcagaggagaugaaggccaccgagucaggugcccagagcgcgccccugcccauggagggaguggauaucagccccaagcaggaugaggggguccuuaaagugaucaagagggaggguaccggaaccgaaaugccuaugauuggagaccggguguucgugcauuauacuggguggcugcucgacgggacuaaauucgauaguucacuggaucgcaaggacaaguuuuccuucgacuuagggaaaggagaagugaucaaggcaugggacaucgcuaucgcuacgaugaaggucggggaagugugucauauuacaugcaagccagaauaugcuuaugggagcgccgguucuccacccaaaauuccccccaacgcaacauugguauucgagguggagcuguuugaguucaaaggagaggaucuuaccgaagaggaggaugguggcaucaucaggcggauacagacccgcggcgagggguacgcaaaaccaaacgaaggcgcgaucguggaaguggcacucgaggguuacuacaaagacaaacuuuuugaucaacgcgagcugagauucgagauaggagagggagaaaaucuagaucugcccuauggccuugaaagggcaauacaacggauggagaagggcgaacacaguauugucuaccuuaaaccauccuaugcuuucggguccguuggcaaggagaaguuucagauaccccccaaugcggaacucaaauacgagcugcacuuaaagucuuuugaaaaggccaaagaguccugggaaaugaacagcgaggaaaaacuugaacaaaguaccaucgugaaagagcgcgguacaguuuacuucaaagaaggcaaauauaagcaagcgcugcugcaguacaagaagaucguguccuggcucgaguacgagagcaguuuuucuaacgaagaggcccagaaagcucaggcacugcgacuggcuagucaucucaaccuggccaugugccaccuuaaauugcaagccuuuuccgcugcaaucgagucauguaacaaggcacuagagcuugauuccaacaacgaaaagggacuuuuccggcgcggggaagcgcaccucgcugugaaugauuuugaacucgcaagagcggacuuccaaaaaguacuacagcucuauccgaacaacaaggcugcaaaaacacaacuagcaguuugucagcaacguauuagacgucagcuggcccgggaaaaaaaacuguaugcaaauauguuugagagacucgcagaagaagagaauaaagcgaaggcagaggccucaaguggcgaccacccuacagacacagaaaugaaagaggaacaaaaaagcaacacagcaggaucacagucacaaguagaaacugaggccuag

SEQ ID NO: 31769 - RNA, 477 nt, Artificial Sequence
  Description of Artificial Sequence: Synthetic coding sequence
auggaaccaccugagggcgcaggaacuggggaaauuguaaaagaggcagagguaccucaggccgcguuaggagugccggcucagggcacuggcgauaaugggcacacuccaguugaagaagaaguuggcggaaucccugucccagccccugguuugcuucaggucacggaaagacggcagccacucuccagcgucucuucccuggaagugcacuucgaucuccuggaccuuaccgaauugacugacaugagcgaucaggagcuugccgaaguguucgccgacucugacgacgagaaccuuaacacagagucuccugcuggccuucauccccucccgagagccgguuaucugcggucucccagcuggaccaggacaagggcugaacaaagccacgaaaaacagccacugggugaccccgagagacaagcuaccgugcuugauacuuuucuuacagucgagcgaccacaggaagauuag

SEQ ID NO: 31770 - RNA, 954 nt, Artificial Sequence
  Description of Artificial Sequence: Synthetic coding sequence
auggcgucugugauccccgccuccaauagaucuaugcgcagcgauagaaacacauaugucggcaagcgguuugugcaugugaaaaaccccuauuuggaucuuauggaugaagacauucuguaccacuuagaccucgguaccaagacacauaaucugccugccauguuuggggaugugaaguuuguguguguggguggcuccccaaacagaaugaaagcauuugcucuauucaugcacaaggaauuaggguucgaggaggcagaagaggacauuaaggacauaugcgcaggaaccgauagauacugcauguauaagaccgggcccguacucgcgaucucccacgggaugggaaucccuucaauaucaaucaugcugcacgaauugauuaaacuccugcaccacgccagguguugcgauguuacaauaaucagaaucggcacuagcggugguaucggcaucgcuccaggcacugucgucauuacugauaucgcgguggacucuuuuuucaagcccagguuugagcaaguuauccuggauaacaucgucacgagaucaaccgagcuggauaaggaacucucagaagaacuuuuuaauuguagcaaggagauccccaacuuuccuacuuuaguaggacauacaauguguacauaugauuucuaugagggucagggccgcuuagacggugcacuuugcucguuuucccgcgagaaaaaauuagacuaucugaagcgugcguucaaggccgggguccggaacaucgagauggaaagcacagucuuugcugcgauguguggcuuguguggacucaaggccgcagucguaugcguuacucuacuggaccguuuggacugcgaucaaauuaauuugccccacgaugugcugguggaauaccagcagagaccccagcucuuaaucucuaacuuuaucagacgcaggcuggggcuaugugacuag

SEQ ID NO: 31771 - RNA, 1095 nt, Artificial Sequence
  Description of Artificial Sequence: Synthetic coding sequence
augucggagguagaggccgccgcuggagccacagccgugccagccgccacagucccugccacggccgcuggaguaguagcaguggugguuccgguccccgcuggagagccccagaaggguggaggugcaggcggcggcggcggagcagcuagugguccagcugccggaacuccuagugcacccggcucaagaacuccagguaacccagcaaccgcagugucaggcaccccugcaccucccgcucggagccaggcugacaagcccguguuggcgauacagguacuugggacaguuaagugguucaacgugagaaacggcuauggcuucauuaaucguaaugauaccaaagaagacguguuuguccaccaaacugcgaucaaacgaaacaauccucguaaguucuuaaggagugugggcgauggugagacuguugaguuugacgugguggagggggagaagggugccgaggcaaccaacgucacagggccagggggugucccgguaaaaggaucacguuacgcaccuaaucgcagaaagaguaggagauucaucccccggccaccgucuguggcaccucccccuaugguggccgagaucccaagcgccggcacagggcccgguaguaagggagagcgcgcagaagauucgggccagagaccgaggagauggugcccaccuccauucuucuacagaagaagguucguucgggggccuagaccaccaaaccagcagcagccaauugaaggaacagaucguguggagccuaaagagacagcaccccuagagggacaccagcaacagggcgacgagcgggugccaccaccuagauuuaggccgagauaccgaagaccauucagacccagaccuaggcagcagccgacuacagagggaggugacggcgagaccaagcccucucagggccccgcugaugguucccggccugaaccgcagagaccucgcaaccgaccguauuuucagcggaggagacaacaggcucccgguccccagcaggccccuggcccacggcagccagccgcaccugaaaccagugcccccgucaacucaggcgacccaacgacaaccaucuuagaguag

SEQ ID NO: 31772 - RNA, 5706 nt, Artificial Sequence
  Description of Artificial Sequence: Synthetic coding sequence
auggccaccuuuaggaauaaucauaugaagaccaaagcuucugugagaaagucauuuucagaggacgucuuccagagugugaagucucucuugcaaagccagaaggagcucuguagugugacugcugaagacugucugcagcaggacgagcaugcuaaccucaccgaagugacauuccugggauucaaugaggagacugaugcagcccacauacaggaucuggcagccguuagccuggagcucccggacauccuuaauucccugcacuucugcucccucaacgaaaacgagaucauaugcaugaaaaacaucaacaagccguuagacaucucaagcgacccauuaaaucagucacauccgagugggauguuguguguuaugagggugagcccaaccucccccagacucagaauugauuucaucuuuagccuccuauccaaauacgccaccggaauccgcuacacccucgacacguuuuugcaccaaaaacaccaacuugaaacgacagacgaggaugacgacgacacuaaucagagcgucucaucaauagaagaugacuucgugaccgccuuugagcaccuggaggaggaggaaacgaguaaaccauauaacgaugggaugaacaucacaguccuucggucacagugcgacgcugcaucccagacagucacaggucaccaucuggagacccaugaucugaagauucugaucagcucaggccaacaaaagucacuggccaaaccgagcacuucuaguguaaacgugcuaggccauaaggagcugcccucaguuaagacaagcgugacuaccucaaucuccgagccauggacccagcgcucuuucuaccggaguucgaacgcaagcgacaaggacagcgaucuacagaagacauucuucucgucuagcccugcuuacucauccgaaucggaauguucuucacccagccccguuaucuuucucgacgaagaggguuaccagaaaagccugaaagcuaagcuugaacugccuaaaauuccagugaugaaagacgauaucgaggacucagacucagaggucuccgaguuuuuugauucuuuugaucaguuugacgaacuggagcagacauuagagaccugccucuuuaauaaggacccagucauagggaagucgucucagagaaaaggucauaaacacggaaagucaugcaugaauccacaaaaguucaaguucgaucggccggcgcucccugcuaacguuaggaaaccuacaccacgaaagccggagucuccuuacggaaauuugugugaugcgcccgauagcccaaggccagugaaagcuucacgugaagacagcgggcuguuuagucccauuagaagcagcgcuuucagcccucucggggguugcacaccugcugaauguuucugccagacugacaucgggggcgaucggauucacgaaaaccaugacucaguuuacuacaccuacgaagacuaugccaagucaaucucaugcgagguacuggggagcgucuugcggacccaccacacgaacacgcuaucuaauaucaacucaauuaaacauggcgagaacaaaacggugaccuuuaaacacggaaaccuggaccagaagaauaaaaguaagaacaaaagccuuaugauuaaggauuccauucagaaguucgcggccgaucuggucgagaagagcuuuggcuccgcauucaaagaucugcagaagggagugagcucuugcacuaaugcucuguaccacuuggcgaucaagcugaccucaagcguucugcagauggcuuuugacgaguuaagacgccaacgggccuucucucucaaggagagggcuauaagcggccuggcuaauuuucuugucuccgaggcccugucaaacgcacuuaaagaccugcaguacgucaaaaagcagauuuucacgaacacaguugcccgguucgccgcugauuuggcugaagaacuuguauuugaagggaucauggagguaugucaguuuuccuacccccagacuccagcuucaccccagugcggcaguuuugauuuugaggacaagguuguuaagcuuuacgcaaaggaccuuuccgaaaguguuauccaggaagccuuuauugagcugucacagguggauguuacuuuuaccacaaaggcugcggucuccguuagcacugauaauaucaaauacguaagcgcagagucgguagucccaucaacccaagccguuacuuuuucacccagcuuucacaaccaagccaucauggugacgaaaccaguccaggaauauaagaaagaguacacugugcagcaggcauuguucugcacaucugguaucgucacgucuauaccgguaccuuuggccggcuccgcccuucuacccuaucacauuuccuccaccgcaugucaggcgaaagcucaucucaguagcgacgauaguaauagcaacggugacuccgcacaaguccacaucgcuacaaagaacagggaagagaaagcugcuugccugcggaauauaugccucccaagcgaacacaauccagggaaccagaacgacuucaagccaacaaacgaugacaucgaaaugcagucuaguucuaaauuaccaaacgaucccgcgaucaucucaaauuucucugcggcgguugugcauacaauugugaacgagacccucgagucaaugacaucacuugagguaacuaaaaugguggaugagagaaccgauuaccucacuaaaagucuaaaggaaaagacucccccauucucacauugugaucaggcagugcuccagugcucagaagcauccuccaacaaagacauguucgcugauaggcuaagcaaguccaucaucaaacacucuaucgacaaaucaaagucagugauccccaauauugauaagaacgcugucuacaaagaaagccuacccgucaguggagaggagucucagcugacacccgaaaagagcccuaaauuccccgacagccaaaaccagcucacccauuguucccuuuccgccgcuaaagauugcgugcccgaguguaaggugucuaugguccacgguuccaguuuagagacccucccaagcugccccgcugugaccgggcagaaguccgaucucaaggaaucugcuaaagaccagccucugaaaaaacauaauuugaacagcacgucucucgaggcauugucauuugggcaagagaauccauucccucacucacacacauuuuccagcacagcccuuaccugcgucgacggacuccauguagaagauaagcaaaaagugcgggaccguaaugugauucccgauacaccacccuccacuccccuggugcccucucgcgcaucgucugagugggauaucaaaaaauugacuaagaaacuuaaaggcgaacuggcaaaggaguuugcccccgccacaccucccuccaccccgcauaauucaagcgugggaucccugucagagaacgagcagaacacaauugagaaagaagaauuuaugcuaaagcucaugcgaagccuuuccgaagagguugagagcuccgaaagcggagagcugccagaaguugauguuaaaagcgagcacuccggcaaaaaagugcaguuugccgaggcauuggcgacccacaucuugucccuggcaacggaaauggcugccucgcaccuggauaauaaaaucauucaggagcccaaggugaaaaacccuugccugaacgugcagagccaaaggucagucucccccacauuccuaaaucccagcgaugaaaaccugaaaacucucuguaacuucgccggggaccuugcugcagaagugauuaccgaggcagaaaaaauugccaaaguucgcaacugcaugcuguuuaagcagaaaaaaaacuccuguuaugcagacggagaugaagacuacaagguggaggagaaauuagacauugaggcgguuguucacccuagggaaguggauccguuuaucuuaagucucccaccuucuaguuguaugucagggcugauguacaaguaccccucaugugagagcgucacagaugaguaugccgggcauuuaauucagauccugaagcaggaggggggcaacuccgagcucauaauggaccaguaugcuaacaggcuagccuacagaucgguuaaaagcggccuccaggaggccgcgaagaccacuaagguccaaugcaacucaagaauguucccagucccaucuucacaggucaaaacaaauaaggaacuucugauguuuagcaacaaagagcaccaccaggaggcugacaagaaaaggcaguccaagcguaaugagggauauuuuuguaaaaaccagaccugcgagaggacccuggauccauauaggaaugagguaucacagcucuacuccuucagcacuucacuuguucacagcaucacaaaagacgcaaaagaagaauuaacggcaucccuugugggucugccuaaaucuuugaccgacucuugucuguuugaaaaguccggauacgaagaagacaacgagugucacgugacaccggagcugcccaaaucccuccagccaucuagccagaaccauagauucuaucacucuaccggaagucugaacggauacggauguggcgacaacgucguucaagccguggagcaguacgccaaaaaagugguggacgacacccucgagcugacccuagggagcacgguuuuucgcgucagugaaaccaccaagucagcugaccgcgugacauaugccgagaaguugagcccacuuaccggccaagcuugcagguauugugacuugaaggaauuacacaauuguacgggaaacucuagucagcacuucuuccggcaaggaucucuggccucauccaaaccugccucaaacccgaaguuuaguagucgguaccagaagucuagaauuuuucaucuuucugugccucagauccacgugaaucuggauaaaaaggccguccuggcugagaaaaucguggcagaggccaucgaaaaagccgaaagggaguugagcagcaccagccucgcugcugauagcgggaucggacaggaaggcgccuccuucgccgaaucucucgcgacagaaaccaugaccgccgcugugacuaacgucggccaugccgugucaucuucgaaggaaaucgaagauuuccaaucuacugaaucuguauccucccagcagaugaaucuguccauaggagaugacagcacagggagcuggucaaaucugagcuucgaggaugagcaucaagacgaaucauccucuuuucaccaucuuuccgagagcaauggaaauagcagcagcuggucuucucuaggacuagaaggggaucuuuacgaagacaaccuguccuuccccacaucagauagugauggaccugaugacaaggacgaagagcacgaagaugaggucgagggccuaggccaagacgggaagacauuacugauuacgaacauugacauggaacccugcaccgucgacccccagcugcgcaucauccuccaguggcugaucgcuuccgaggccgaaguggccgagcuguacuuucacgauuccgcaaacaaggaguucauguugcuaucaaaacagcuccaggagaaaggguggaaaguuggcgaccugcugcaagcagugcuucaguacuaugaaguuauggagaaagcgucaucagaggagcguugcaaaagccuguucgauuggcugcucgagaaugcuuag

SEQ ID NO: 31773 - RNA, 417 nt, Artificial Sequence
  Description of Artificial Sequence: Synthetic coding sequence
auggcggaacugcagcaacugaggguccaggaggccguggaauccaugguuaagaguuuagaacgcgagaauaucagaaagaugcaggggcucauguuccggugcagcgcuaguuguugugaggacagccaagccagcaugaagcaggugcaccaguguauugagcgaugccacgugccacuugcccaggcccaggcccuagugacuucagagcucgaaaaauuucaagaucgauuggcuagaugcacuaugcacugcaaugacaaagcuaaggacaguaucgacgcagguucuaaagagcuccaagugaagcagcagcuggacucuugugucacuaagugugucgaugaccauaugcaucuuaucccaacaaugacaaagaaaaugaaggaggcccuuuuguccaucggaaaauag

SEQ ID NO: 31774 - RNA, 1110 nt, Artificial Sequence
  Description of Artificial Sequence: Synthetic coding sequence
augaccuuggaagcaauccgauacagucgcggaagccuucaaauccucgaucaguuauuacuaccuaagcaaucaagauaugaagcaguggggagugugcaucaggccugggaggccauuagggcaaugaaggugaggggagcaccugccauagcacucgucggaugucuuucacucgccguggagcugcaggccggggcaggcggaccggggcuggcugcgcuuguagcuuucgugagagauaagcucucuuuccuagugacagcccgaccuacagcuguaaauauggcgagagcugcucgggaccuggcugauguagccgccagagaagcggagagggagggggccaccgaggaggcuguuagggagcgggugauaugcugcacggaagacauguuggaaaaggacuugagggacaaucggaguaucggagacuugggcgcuaggcaucugcuagaacgaguggcaccauccggcgggaaagugacagugcugacacacuguaacacaggggcacuggccaccgcgggauaugggacggcacugggagugaucaggagccuccauucccugggacggcucgagcacgcuuuuugcaccgaaacucguccauauaaucagggagcaagacuaacugccuucgaacuuguauaugagcaaaucccagcuacccugaucacggauuccauggucgcagcugcuauggcacaucggggggugucagcuguuguggugggagcggacagagugguggcuaacggugacaccgccaacaaagucggcacuuaucagcuggccaucguagccaaacaccacggcauuccauuuuacguggccgccccuuccagcucuugugaccugcgccuagaaacuggcaaggagaucauaaucgaagaacggcccgggcaggaguuaacagacgugaacggugugcgcaucgccgcccccggaaucggagucuggaacccagccuuugacgugacuccucaugaucuuaucacuggcgggaucaucacugagcugggcgucuuugcuccagaggaacuucgcaccgcacugacaaccacuaucucuaguagagacgggacucucgacgguccucaaauguag

SEQ ID NO: 31775 - RNA, 3660 nt, Artificial Sequence
  Description of Artificial Sequence: Synthetic coding sequence
augaugagucuaagcguuaggccccagcgccggcucuugucagcacgagucaaucguagccaaucuuucgcuggagucuuaggcucucaugagcgggguccaagaagcuuucccgucuucagccccccugggccuccaagaaagccaccugcccuuucccgggugucaaggauguucuccguggcccauccugcugcgaaagugccacagccagaaagguuggaucucgucuauacggcccugaagcggggacucaccgcauacuuagaaguccaccaacaggagcaggagaagcuccagggccagauccgcgagaguaagagaaacagccgacugggguuccuguaugaucuggauaagcaggucaagagcauagaacgguuccuccgccgucuggaauuccaugcgagcaaaauugacgaacucuacgaagcuuacugcgugcagaggaggcuucgggacggggccuauaacauggugagagccuauacaaccggcucuccggguucuagggaagccagagacagucuggcugaagccacuagagggcaucgcgaauauacggaaaguaugugucuucuugagucggagcuugaagcacagcugggcgaauuucacuuaagaaugaagggucuggcuggcuuugcacgucucugugugggagaccaauacgaaauauguaugaaauacgguaggcagcgguggaaacuacgggguaggaucgaaggcagcggcaaacaagugugggacucugaagaaacuaucuuccuaccccuacuuacggaauuucucucuauuaaggugaccgaacugaaaggccuggcaaaccacguugugguaggcagugugagcugugagaccaaggacuuauucgcugcccugccacaggucguagcuguugauaucaaugaucucgggacaaucaaacucagccuggaaguaacauggucaccauucgauaaggacgaucagccaagugcugcaagcucuguaaacaaggccuccacugugacaaaaagguucucaaccuacucccagucuccuccugacacccccagccugagggaacaggcauuuuauaacaugcucaggcggcaagaggaacuagagaauggcaccgcuuggucauuguccagcgaaucaucugaugauuccuccucaccccagcugucuggaacagcacgucacucaccagccccccggccacugguucagcagcccgagccucugccuauacagguggccuuucgccgcccggagacuccauccaguggcccacuagacgaagaaggagcuguugcucccgugcuggccaauggacacgcucccuacucacggacgcugucccacaucucagaagccucagucgaugccgcauuggcagaagcgucaguugaagccgucggcccugagucacuugcauggggccccucaccucccacacacccugccccgacacauggagaacaucccagcccugugccaccagcccuugauccuggucauuccgcaacaucuucuacucugggaaccaccggcagcgugccaacuagcacugacccugccccgagcgcucaccucgacucuguacacaagaguaccgauucugguccaagcgaauuacccgggccuacucauaccacuacgggcagcacuuauuccgcaauaacaacuacacacagugcuccgucaccucugacucauacuacaacaggaaguacucacaagccaauaauaagcacccugacaacgaccggacccacuuugaacauuauugguccagugcagacaacuaccucaccuacgcauaccaugccuaguccaacacacaccaccgcauccccgacacauacaaguaccagcccaacucacaccccgaccucaccuacacauaaaaccagcaugagcccuccgaccacaacuuccccuacgccaucaggcaugggucucgugcaaacugcuaccuccccaacacauccaaccacaaguccaacucacccaacuacaucuccuauccucauaaacgugucacccuccacuagcuuggagcucgccaccuugagcucaccuaguaagcauuccgacccaacacugcccgggacagauucacugcccuguuccccuccagucucaaacagcuauacacaggcugauccuauggcaccuaggacuccacacccaucgcccgcccacucgagccguaagccccucacgagcccugccccugaccccuccgaguccacuguccagucccuuucccccacuccuaguccgccaacgccugccccccagcacagcgauuuaugcuuggccauggcuguucagacaccaguuccaacagcugccggcgguaguggcgacaggucucuugaggaagcccugggagccuuaauggcagcccuggaugauuaccgcgggcaguuuccugaguugcaaggccuugaacaagaggugacaagacuggaaucacugcugaugcagagacagggucucacccguucccgggcguccucacugaguaucaccguagagcaugcauuggagucauuuaguuuuuugaaugaggacgaagacgaagacaaugacgugccuggggauagaccccccuccagccccgaggccggcgccgaagacucaauugauagcccauccgcucgacccuuaaguacagggugcccagcgcuggaugcugcccuugugaggcacuuguaucacuguucuagacugcuucuaaagcuugggaccuucgggccccuuagaugccaggaagccugggccuuggagcgacuccuccgagaagcacgcgugcuggaagcagucugcgaauuuucaaggagaugggaaauacccgccuccucagcccaggaggucguucaauuuagcgccagucgaccuggguuccucaccuuuugggaucaauguaccgagcggcucucuugcuuccuguguccagucgaacgcgugcuccugaccuuuugcaaccaauauggagcgcgucugucacucagacagcccggccuggcagaagccguuugugucaaguuccuggaggaugcccucggccagaaguuaccccgccggccccagccuggcccuggagaacagcugacaguguuccaguucuggagcuucgucgaaacucuugauucaccuaccauggaggcauacgugacagaaacugccgaggaaguccugcuggugcgcaaccucaauucagacgaccaggcuguugugcucaaggcccuaagguuagcgccugagggaagacugaggagagauggacugcgcgcgcugagcagccuucucguacacggaaauaauaaagugauggcugcggucaguacacaguuacgaucacugucccucggccccacguuucgagaacgcgcucugcuuugcuuccuggaccaacucgaggacgaagacgugcagacccgcgucgcgggauguuuggcccucggcuguaucaaagcaccagaaggaauugagccacucguguaccuuugucagacggacacagaggcuguaagggaagccgcuaggcaaucacuacagcaguguggcgaggagggccagagcgcccaucggcggcuggaggaguccuuagaugcccucccucgcaucuuuggucccggguccauggcauccacagcauuuuag

SEQ ID NO: 31776 - RNA, 1326 nt, Artificial Sequence
  Description of Artificial Sequence: Synthetic coding sequence
auggcaagcgucgcggccgcccgcgcagucccagucggaaguggcuugagagggcuccagcgaacccugccuuuaguggucauucugggagcuaccggaacaggaaaguccacucuggcucugcaguugggccaacgacugggaggagaaauuguaagugccgauucgaugcaaguguaugagggacuagacaucauaacaaacaagguaagcgcccaggagcaaaggauuugucggcaucacaugauuaguuucguggacccauuagugacuaacuacacugugguagauuuuagaaauagggcuaccgcccucauagaagacauuuuugccagagacaaaaucccgaucgucguagggggaaccaacuacuacauugaaagccuccuguggaaagugcuuguuaacacaaaaccccaggaaauggguaccgagaaagugaucgaccggaagguagagcucgaaaaagaagacggcuuagugcugcacaaaagguugucacaaguagacccugaaauggccgccaagcuacauccucacgacaagagaaagguugcaagaucacugcagguguuugaagagaccgggauaagucacucagaauuccuccauagacaacacacugaggagggugggggcccucuuggaggaccucugaaguucagcaauccaugcaucuuauggcuccacgcugaccaagccguccucgacgagcgacuggauaaacggguugacgauaugcuggcugccggacugcuggaagaauuacgggacuuccauagacgguacaaucagaagaacgucagugaaaauagccaggauuaccaacauggaauauuucagucaauuggauuuaaagaguuccaugaguaucugaucacugaagggaagugcaccuuggagaccuccaaucagcugcucaagaaaggcccugggcccauuguuccucccguguauggccucgaaguaucagacguaagcaaaugggaagagucuguccucgaaccagcccuggaaauuguucaaucuuucauccagggccauaagcccacagccacccccauuaaaaugcccuauaaugaggcugagaacaagcgcagcuaccaucuuugugauuugugugaucgcauuaucaucggcgaucgcgaaugggcugcacacaucaaaagcaagucucaccucaaccaacugaagaagcggcgaagacuugacucugacgccgugaauacaauugaaucgcagagcguaagucccgaucauaauaaggaaccaaaggagaaggguagccccggccaaaaugaucaggaguugaaauguuccguguag

SEQ ID NO: 31777 - RNA, 618 nt, Artificial Sequence
  Description of Artificial Sequence: Synthetic coding sequence
auggccgagccacuucagccggaucccggugcugcggaggacgcagccgcccaggccgucgagacaccuggcuggaaagccccggaagaugcaggaccucaaccaggcucauacgagauucgccacuacggcccagccaaauggguaagcacaucagucgagucaauggacugggauagcgcaauucaaaccggauuuacaaaguuaaacucauacauacaggggaaaaaugaaaaagagaugaaaauaaagaugacagcucccgugacaucuuacguagagcccggcagcgggcccuuuagcgaguccacuauuacaaucagccuuuauauucccagcgagcagcaauucgacccgccuaggccucuagagagcgacguguuuauugaagacagggcagagaugacagucuuugugagaaguuuugacgguuucaguagcgcacaaaaaaaccaggaacaauuacucacacuugcaucuauccugagagaggauggcaaggucuuugaugagaagguauauuauacggccggauauaauucgccagugaaauuacugaacagaaauaacgaggucugguuaauacaaaagaaugagccaaccaaagaaaacgaguag

SEQ ID NO: 31778 - RNA, 624 nt, Artificial Sequence
  Description of Artificial Sequence: Synthetic coding sequence
augucuuguaccauugaaaaaauccugaccgacgccaagacccugcuggaaaggcugagagaacaugacgcagcugccgagaguuugguugaucagucagcagcacugcaccgcagaguggcggcgaugagagaagccggaacugccuuaccugaucaguaucaggaagacgcaagcgauaugaaagacauguccaaguauaagccacacauauuauugagccaggaaaacacccaaauccgagaccuccagcaagaaaaucgggaacuuuggauuucucucgaagagcaucaggaugcccucgaauugauuaugucuaaauaccggaaacagauguugcaacugauggucgcuaaaaaagccguagacgcugaacccguucuaaaggcacaccaaucccacagcgcagagauagaaucccaaauagaccgaaucugugaaaugggcgagguaaugagaaaggccgugcaaguggacgaugaucaauuuugcaagauccaagagaaauuagcgcagcuggagcuggaaaauaaggaacugagagaguuguugaguauuagcuccgaaagccugcaagcuaggaaagaaaacucuauggacacugcaagucaggcgaucaaauag

SEQ ID NO: 31779 - RNA, 1032 nt, Artificial Sequence
  Description of Artificial Sequence: Synthetic coding sequence
augaauauacaccguagcaccccaaucacuaucgcucgguacggucgaagucggaacaagacccaggauuucgaagaacuaucaaguaucagaagcgcugaaccuagccagucauuuuccccgaaccucggaucaccuucacccccagagacaccgaaccugagccauugugugaguugcauugguaaauaccugcuguuagaaccucuggagggagaucacguguuucgugcagugcaucugcacagcggggaggagcuuguauguaaggucuucgacaucucgugcuaccaggaaagucuagcccccugcuucugucugagcgcccauucuaauaucaaccagauuacagagauaauucuuggugaaacuaaagcauaugucuuuuucgaacguuccuacggggacaugcacucauuuguccgcacauguaaaaaacuccgggaggaagaagcugcgcgacucuuuuaucaaauugcuuccgccguagcgcacugccacgacggugggcuuguucuacgugaucugaagcugagaaaguucaucuuuaaagacgaggagagaacacgagugaagcuagagucacuugaggaugcuuauauuuugagaggagacgacgacuccuugucugauaaacacgguugcccugcauauguuucaccggagauucugaacaccucgggcagcuauuccggcaaagcugcggacguauggucucuuggaguuaugcuuuauaccaugcugguaggccgguacccuuuucaugacauugagcccuccucgcuguuuuccaaaauccgacgagggcaguucaacaucccagagacacuuucuccuaaagcuaaaugucugauuaggucuauccugaggcgcgagccuuccgagagguuaacaucacaggagauucuggaucauccuugguucagcacggauuucaguguauccaacucagccuauggcgcaaaagaaguguccgaccaguuggugcccgacguuaauauggaagagaauuuagacccauuuuucaauuag

SEQ ID NO: 31780 - RNA, 3048 nt, Artificial Sequence
  Description of Artificial Sequence: Synthetic coding sequence
augcgacgcuuuuuaaggccgggccacgauccggugcgggagcgcuugaagagagacuuguuucaauuuaacaagacaguagaacacgguuucccucaucagcccagcgcucuaggcuauagccccucgcugcggauccucgccaucgggacccgcaguggagcaauuaaguuauauggagcaccaggcguggaguuuaugggauuacaucaggaaaacaaugccgucacucaaauccaccuccuccccgggcagugucagcucgucacccugcuggacgacaauagcuugcaucucuggucucuaaaggugaagggaggcgcuagcgagcugcaagaggacgagucuuucaccuugaggggaccucccggcgcagcuccaucugcgacacaaauaaccguuguguugccgcauaguuccugugaacugcuguaucucgggaccgagagcggcaacguuuuugugguccaacuuccagcauuucgcgcccuugaggauagaacgauuucauccgaugcugugcugcaacgccugccugaggaagcaaggcaucguagaguuuuugaaaugguugaagcucuccaggaacauccucgcgaucccaaucaaaucuugauaggguacucaaggggacucguggucauuugggacuugcaggggucuaggguccuguaucacuuucucucuucucagcagcuggagaauaucugguggcagcgcgaugggcggcuccuggugagcugucacucagauggcucuuauugucaguggcccgugucuucagaggcucagcagccagagccucuucggucauugguuccuuacggcccauucccuugcaaagcgauuacaagaauccuuuggcucaccacacgccagggucugcccuuuacaauuuuucaggguggcaugcccagagccaguuacggcgacaggcauuguaucagcgugauccaugacggccagcaaacagcuuucgacuuuaccagccgcguaaucggcuucacaguguuaacugaagcugaccccgcugcaaccuuugacgaccccuaugcacucguaguucuggccgaagaggagcugguggucauugaccuccagaccgcuggcuggccuccagugcaacugccauaccucgccagccugcacugcagugccauuaccugcucacaccaugucuccaacaucccucuuaagcucugggaacgaaucaucgccgccggcucaaggcaaaaugcccauuucuccaccauggaauggcccauugacgggggaaccucgcuuacuccugcuccaccgcagcgcgaucuucuccuuacuggacacgaggaugggacaguccgauuuugggaugccucaggcgucugccuccgcuuguuguauaagcugucaacugugagaguguucuugacugauaccgauccuaaugaaaacuucagcgcucagggcgaagacgaguggccgccauugaggaaggucggaucuuucgaccccuacucagaugauccuagacucgggauccagaagaucuucuuguguaaauacucugguuaucucgcaguggcagggaccgcaggccaggugcuugugcuugagcugaaugacgaagcugcugaacaggcuguggaacagguagaggcugaccuucugcaggaucaagaaggguacagauggaaggggcacgaaagacuggcagcccgcucugggccagugcgauuugagccaggauuccaaccuuuugugcucgugcagugccagccccccgccguaguuaccagcuuagcuuuacauuccgaauggcgacugguugccuucgguaccucccauggauuuggacuguucgaccaccaacaacgacgccagguuuucgugaaaugcacccuccacccuucagaucaguuagcucuugaagguccacugagcagagucaaaucccugaaaaaaagcuugagacaaucguuccgacggaugcgcagaagcaggguaucaagccguaagagacauccugccgggccgccaggugaagcccaggaggguagcgccaaagcagagcggccugggcuccagaacauggaacuugccccagugcagagaaaaaucgaggccagaagcgcagaagauagcuucaccggauucgugcggacccuguauuucgccgauaccuaucuuaaagauucaagucgacauugucccucucuuugggcuggcacuaacggcgggaccauauacgcauucucccugaggguuccucccgcagaacggagaauggaugaaccugugcgggcagagcaagccaaggaaauccagcucaugcaucgggcgcccguugucggcauccugguccucgacgggcacucggucccccuuccagagccccuggaaguggcgcacgaccuuuccaagucccccgacaugcaagggagucaccagcugcucguugucucggaggagcaguuuaaaguuuucacuuugcccaagguaagugccaaacuuaagcugaagcucaccgcccuggaaggcagucgcguccgaagaguguccgucgcccacuucgggucuaggcgcgcagaagauuacggggagcaucaucuugccgugcugaccaaccugggcgacauucagguggugagccugccacuucucaaaccacaaguucgcuacucauguauacgcagggaagacgugucaggcaucgcguccuguguguuuacuaaauacgggcagggauucuaucuuauuaguccaucugaguuugagagauuuagccuuagcacaaaaugguugguugaaccccgaugccucgucgauucagcugaaacgaagaaccacagacccggaaacggugcaggccccaagaaggcccccucacgggcucggaacagcggcacccagucugacggcgaggagaaacagcccggacucguuauggagagggcauugcucagcgaugagcgcgccgcuaccggcgugcauaucgaaccaccguggggugcggccagcgccauggccgagcagucggaguggcugucaguucaggcugcccgcuag

SEQ ID NO: 31781 - RNA, 582 nt, Artificial Sequence
  Description of Artificial Sequence: Synthetic coding sequence
augcucggagugcuugagcuauugcuccucggugcagccuggcuggcaggcccagcaaggggacagaacgaaacugaaccaauaguccuggagggaaagugccuaguggugugcgauuccaauccaaccucagacccaacgggcacugcucuuggaaucucagugaggucagggucugcaaagguugcauuuucagcgauccggucaaccaaccaugagcccucagaaaugucaaaccggacaaugaucauauacuuugaccagguucuggugaauauugggaacaauuucgacagcgaaagauccacguuuauugcuccaagaaaagguauuuacagcuucaauuuccacguuguuaagguguacaauaggcaaacuauucaaguaagccugaugcugaauggauggcccgugauuuccgcguuugccggugaucaggacgugacgagagaggcugccagcaacggcguacucauacaaauggaaaaaggggaccgggcuuaccugaaauuggaacgcggcaaccugauggggggguggaaauacucaacguucagcggauuccugguauucccacuguag

SEQ ID NO: 31782 - RNA, 1530 nt, Artificial Sequence
  Description of Artificial Sequence: Synthetic coding sequence
auggggguucuaaaguucaagcacaucuucuuucgcaguuuuguuaagagcucuggggucucccagaucgucuucaccuuccuacucaucccuugcugccugacuuugaacuucagagcaccaccagucaucccaaaugugccauuccugugggcuuggaacgccccaucugaauucugucugggaaaguucgacgaaccgcuggauaugagccuguucuccuucaucggauccccccgaaucaaugcuacgggucagggcguuaccaucuuuuacguagaccggcuuggguacuacccauauauugacucuauuacaggcguaacugucaacgguggaauuccucagaaaaucucccugcaggaccaucuggacaaggcgaaaaaggacaucacauucuacaugccaguggacaaccuggguauggcaguaauugauugggaggaguggcgacccacuugggcgcggaauuggaagccaaaggauguauauaagaaccgaaguauugagcuaguacagcagcagaaugugcaguugagucugacagaagccacggagaaagcaaaacaggaguucgaaaaggcuggcaaggauuuucuuguagagacgaucaaacugggcaagcuccucaggccuaaccacuuaugggguuauuaccucuucccugacugcuacaaccaucacuauaagaagcccggguacaacggaucuugcuuuaacguggaaauuaagcgaaacgacgauuuaagcuggcuauggaacgagagcaccgccuuauacccuaguauauaucuaaauacacaacagucccccguugccgccacacuguacguuaggaauaggguuagggaagcuauucggguuucaaaaauaccagacgcuaaaucaccucugccgguuuucgcuuacacccggaucgucuuuacugaucagguguugaaguuccucagccaggacgaacugguguauacauucggagagacaguggcccucggggcaucaggcaucgugaucuggggcacccuguccauuaugcgaucaaugaaguccugccugcuucucgauaauuacauggagaccauucuuaauccauacaucauaaaugugacccuggcugcuaaaaugugcagucaagugcuaugucaagagcagggcguuugcauccguaaaaacuggaacucguccgauuaccugcaucucaauccugauaacuuugccauucagcuggaaaaaggcggaaaauuuacugucagggguaagcccacucuggaggauuuagagcaguuuucugagaaguucuacuguagcuguuacagcacucuuaguugcaaggaaaaggcugauguuaaagacacagaugccgucgacgucugcaucgcagacggagugugcauugacgccuuccugaagccaccuauggaaacugaagaaccacagaucuuuuauaaugccagcccuagcacucugucagcuacaauguuuaucgugaguauucucuuuuugauuaucucuucaguagcaucccucuag

SEQ ID NO: 31783 - RNA, 1437 nt, Artificial Sequence
  Description of Artificial Sequence: Synthetic coding sequence
auggcucauguccccgcgagaaccucuccagguccugggccccaacugcuccugcugcuacucccucuguuucugcugcucuugagagacguugccggaagccacagagcucccgccuggucggcccugcccgcagccgccgauggccuucagggcgauagagaccugcagcgccaccccggagaugcagcggcaacccugggacccucagcccaagauaugguugcagugcacaugcacagauuauacgagaaguauucacgucagggcgcccgcccagggggugggaacaccguaagaaguuuucgcgcgcgauuggaggucguugaccagaaggccgucuacuuuuucaaccucaccucgaugcaggacucagagaugauauugacagcuacuuuucauuuuuacucggaaccaccuagguggccacgcgcgcucgaagucuugugcaagccacgugccaaaaacgccagcgggagaccccugccacuuggaccaccuacuaggcagcaucugcuguucagaucccucucacagaacaccgcaacacagggcuuguugcgcggcgccauggcacuggcaccgcccccaagaggccucuggcaggcaaaggacauuagucccauaguaaaggcagcaaggcgggacggcgaacuccugcugagcgcccaacuggacucagaagagcgagacccgggagucccuaggcccagcccauacgcaccguauauuuuaguuuacgccaaugaccuggcuauuuccgaaccaaacucaguugcagucacgcuucagagguaugaucccuucccggcgggugacccagaaccuagagcggccccuaacaauucagcagacccgcgggugcggcgugcggcucaggcaacagguccgcugcaggacaacgaacuacccggucucgacgaaagaccaccucgggcccacgcucagcacuuucacaagcaccaguuauggccuucaccuuuucgcgcucuuaagccucgaccugggcggaaggacagaaggaaaaagggacaggaaguguuuauggccgccagucagguccuggacuucgacgaaaagacuaugcagaaggcaaggaggaaacagugggaugaaccgcgcguaugcucucggagguaccuuaagguugacuuugccgauauaggcuggaacgaauggaucauuucuccaaaaucuuucgacgccuauuauugugcuggggcuugcgaguucccgaugccaaaaauugugagaccaucgaaucaugcaacaauucagucuauagugagagcggucggcauuaucccuggcaucccugagcccugcugugugccugacaagaugaacucacugggcgugcuguuucuggaugagaauagaaauguuguucugaaaguguacccgaacaugagcgucgacacuugugcaugccgguag

SEQ ID NO: 31784 - RNA, 1941 nt, Artificial Sequence
  Description of Artificial Sequence: Synthetic coding sequence
augucaaagggcccagcagugggcauugauuuaggaaccacauauagcugcgucgggguuuuucagcacgggaagguggagauuauugcaaacgaucagggcaaucggaccacgcccagcuauguggccuuuacugacacagaaagacuaauaggagacgccgccaaaaaucaaguggccaugaacccaacgaacacaguguuugacgccaagagacugauaggccggagguucgacgaugcaguugugcagagcgacaugaagcauuggcccuucauggugguaaaugaugccggacgcccgaagguucaggucgaguacaaaggcgaaacuaagucuuuuuacccggaggagguaagcucuauggugcugacgaaaaugaaggaaauagcagaggcguaccuagggaagacagugacaaaugccgugguaaccgugccagcuuacuucaacgauucacaacgacaagccacgaaggacgccggaaccauugcuggccuuaacgucuuacgcauuaucaacgagcccacagccgcagcuauugcguacggguuagacaaaaaagucggagcagagcggaauguguuaauuuucgaccuuggcggagggacuuucgaugugaguauuuugacaauagaggauggaaucuucgaagugaagagcacagccggcgacacucaucugggcggagaggauuuugauaaucgcauggugaaucacuuuauagccgaguuuaagaggaagcauaagaaagacaucagugaaaacaagcgggccguccggcgccuucgaacagcaugcgaacgcgcaaagcggacacugagcaguucuacccaggcuagcauugagaucgauucccuguaugaggguauagauuuuuacacuuccauaacccgggcgagguucgaagaacucaacgccgauuuguuucguggcacuuuggacccaguagaaaaagcucuccgcgacgcgaagcuggauaaaagucagauccaugauauugugcucgugggcggcuccacucgcauccccaagauucagaagcuccuccaggacuucuucaauggaaaagagcugaacaaaucuaucaaucccgacgaagccguggccuauggagcagccgugcaagccgcuauccugucaggcgauaagagcgaaaauguccaggaucugcugcuccuggaugucacaccccugagccugggcauagagacugccggcggagugaugaccgugcugaucaaaaggaacacgacuauucccaccaagcagacccagaccuucacuacguauagcgauaaucagccuggagugcuuauucaggucuacgagggugagagagcgaugacaaaagacaauaaccuguugggcaaauucgaguuaacaggcauaccuccggcgccaagaggggugccucagauagaggucacuuuugauauagacgccaaugggauauuaaaugugagugcgguggauaagucaaccggcaaagagaauaaaauuacgauaacaaacgacaaaggccgucugaguaaggaggacauugagcgaauggugcaagaagccgagaaauacaaagcugaagacgagaagcagagagacaaaguuagcagcaaaaauucacucgagagcuacgcauucaacaugaaagcgaccguggaggacgaaaagcugcagggcaaaauaaaugaugaggauaaacagaaaauauuggacaaauguaacgaaaucauuaacugguuagauaagaaccaaaccgcagagaaggaagaguucgagcaccagcaaaaggagcuggaaaaaguuuguaauccuauuauuacuaagcuguaccaaucugccggcgguaugccgggcggcaugccaggaggguuuccaggaggaggggccccuccuuccggaggcgccaguucuggaccuacuauagaggagguggauuag

SEQ ID NO: 31785 - RNA, 1632 nt, Artificial Sequence
  Description of Artificial Sequence: Synthetic coding sequence
augagaaaaccugccgccggcuuucugccuagucugcucaagguucuguuacugccuuuagcaccagccgcugcacaagacucuacacaggcguccacacccggaagcccccuguccccaaccgaauaugaaagauucuucgcauugcugacaccaaccuggaaagcggaaaccaccugccgauugcgagccacucaugggugccgcaacccaacacugguucagcuggaccaguacgaaaaucauggacuagugccugacggggcagucugcaguaaccucccuuacgccucuugguuugaguccuucugccaguuuacucauuaucgcuguaguaaccacguguauuacgcaaagcgggucuuguguagccagccugugucuauacuauccccuaauacccucaaagagaucgaggcuucugccgaagugucacccacuacaaugacaucaccuauuaguccgcauuuuaccguuaccgagcgccagacauuccagcccuggccagaacggcugaguaacaauguggaggaauugcugcaguccucacucucguuaggcgggcaagagcaggccccugaacacaaacaggagcaaggaguggaacacagacaggagccaacucaggagcacaaacaagaggaggggcagaaacaagaggaacaggaggaggaacaagaggaggaagguaagcaagaggagggucaaggaacaaaagagggccgggaagcuguaagucagcugcaaaccgacagcgagccuaaguuccauagcgagucacugucuaguaauccaucaucuuuugccccaagagugcgcgagguggaguccacaccaaugaucauggagaacauacaggaacugauucguagcgcccaggaaaucgaugaaaugaacgaaauauaugacgagaacucuuacuggaggaaucagaacccaggaucacugcuccaacucccgcacaccgaggcucuguuagugcuuugcuacucuaucgucgagaauaccugcaucaucacaccaacugcuaaggcauggaaguacauggaagaagagauacuugguuuugggaaauccgugugcgauucacuuggcaggcggcacauguccacaugcgcccucugugauuuuuguucucuuaaauuagagcagugccauucagaggccucccugcagcggcaacagugugacaccucucauaagacacccuucguuuccccgcugcuggcgucccagagccugagcauuggcaaucagguuggcuccccugaaucagguagauuuuauggcuuggaucucuacggcggacugcauauggauuuuuggugcgccagacuggcuaccaaaggcugcgaagacgugagagugucuggcuggcuccagaccgaauuucucucuuuccaggacggugauuuccccacgaagauaugugacacggauuauauccaguacccuaacuauuguagcuucaaaagucagcagugucugaugcggaaucgcaauaggaaggugagcaggaugcggugccuucagaacgagacuuauucugcccugucucccggcaaaucagaggacgucgucuuacgguggagccaggaauucaguacccugacccuggggcaguuugguuag

SEQ ID NO: 31786 - RNA, 2349 nt, Artificial Sequence
  Description of Artificial Sequence: Synthetic coding sequence
auggccccauccgcuugggcuaucugcugguugcuggggggacugcuccuucacgguggaagcucaggacccucccccggcccaagcgucccacgacucagacuguccuaccgggaucuccuguccgccaaccggagugcuauauuccugggaccacagggcagccuaaacuuacaggcuauguacuuggacgaguaccgcgauagauuauuccucgggggauuggacgcauuguauucccucaggcuggaccaggcuuggccugaucccagagagguucuuuggccuccucagccugggcaacgcgaagagugcguucgcaaagggcgugauccccugacagagugcgcaaauuuuguuagagugcuucagccucauaauagaacccauuugcucgcaugugggacuggagccuuccagccaaccugugcucugaucacagugggccaccgaggagaacacgugcugcaucucgaacccgggagcguggaguccggcagaggucgauguccucacgagccuaguagaccauuugccaguacuuuuaucgacggcgaauuguacaccgggcucacagcugauuuccugggacgggaagccaugauauuccgcuccggggggccucgcccagccuuacgauccgauagcgaucagucccuucuucaugacccucguuucguuauggcugcccggauuccugaaaauuccgaccaggauaaugauaaaguguauuucuuuuucuccgagacagugccuuccccggauggcggaucuaaucacguuaccgugucacgggucggcagagugugugugaacgaugcaggagggcaacgcguucuuguaaacaaauggucaacauuccugaaagcaaggcuggucuguucagugccgggaccuggaggugcagagacucacuuugaccaguuggaagacguuuuccucuuguggccaaaggccggcaagucacuggagguguacgcccucuuuucaaccguaagcgcuguguuucagggcuucgccgugugcguuuaccacauggcagacaucugggaaguguuuaauggaccguucgcucacagggacgggccccagcaucagugggggccauaugggggcaaagucccauuuccucggccgggcguaugccccucuaaaaugacagcccaacccggccggccguuuggcucuacaaaggauuacccagaugaaguucugcaauuugcaagggcacauccgcucauguuuuggccagugaggccucgccacggacggccaguccuuguaaagacccaucucgcccaacaacugcaccagauugucguugauagagucgaggccgaggauggcaccuaugacguaauauuucuaggaacagauagcggcaguguuuuaaaagucaucgcgcugcaggcuggcgggagcgccgaaccugaagaggugguccuggaagaacuccagguuuuuaaaguccccacacccaucacagaaauggagauuuccgugaaacggcagaugcuuuacgucggaagccgucuggguguggcccagcuuaggcugcaccagugcgaaaccuacggcaccgcgugcgccgagugcugccuugcccgcgacccuuauugcgcaugggauggagccaguugcacccauuauagaccuucucucggcaaaagacgcuuuagaaggcaggauauucgucacggaaaccccgcucugcagugucugggucaaagccaggaggaagaggcggucggauuggucgcugcaacaaugguguacggcaccgagcauaauucaacuuucuuagagugccuaccaaagucaccacaagccgcagugagauggcuccugcagagaccuggcgaugagggaccagaccaggugaaaaccgacgagcgcguccugcauacagagcggggacuacuguucagacgccugaguagguuugaugccggaacauacaccuguaccacucucgagcacggguucagccagaccguagugaggcuggcccucgugguaaucguagcgucccaauuggauaacuuguuuccuccagaacccaaaccugaggaaccaccagcucgcggcggccucgcaaguacucccccaaaggccugguacaaggacauucugcagcucauagguuuugccaaccugcccagaguagaugaauauugugaaaggguauggugcagaggaaccaccgagugcucaggaugcuuccgaucgcgaagccggggcaagcaggccagagggaagagcugggcugggcuggagcucgguaaaaaaaugaagucccgugugcacgcugagcauaaucggacuccaagggaaguugaagcgacauag

SEQ ID NO: 31787 - RNA, 1380 nt, Artificial Sequence
  Description of Artificial Sequence: Synthetic coding sequence
augaccgcagaagaaaugaaggcaaccgagaguggugcgcaaagugccccuuugccuauggagggggucgacauuaguccuaaacaagacgagggaguacugaaagucauuaagcgcgaaggaaccgggacugaaaugccuaugaucggcgaucgcguauuugugcauuacacagguuggcugcuggauggaacgaaguuugacuccagucuugacaggaaagauaaauuuagcuucgacuuagguaaaggcgaggugauaaaagcuugggauauugcuauugcuacaaugaaagucggcgaagugugucauauuacaugcaagccagaauaugcuuaugggagcgccgguucuccacccaaaauuccccccaacgcaacauugguauucgagguggagcuguuugaguucaaaggagaggaucuuaccgaagaggaggaugguggcaucaucaggcggauacagacccgcggcgagggguacgcaaaaccaaacgaaggcgcgaucguggaaguggcacucgaggguuacuacaaagacaaacuuuuugaucaacgcgagcugagauucgagauaggagagggagaaaaucuagaucugccuuacggacuggagagggccauacagaggauggaaaaaggcgagcauagcaucgucuauuuaaagccgaguuaugcauuuggaagcgugggcaaagaaaaguuccaaauccccccgaacgcagagcucaaguaugaacuucauuugaaaaguuuugagaaagcaaaagagaguugggaaaugaauucugaagaaaagcuggaacagagcacaauugugaaagagagaggaaccgucuauuuuaaagaaggcaaguacaagcaagcacuucugcaguauaaaaagaucgugagcuggcucgaguacgagucuagcuuuuccaacgaggaagcacagaaggcucaagcauuacgucuggccucccaccucaaccuggcuaugugccacuugaagcuccaggcauuuucagccgccaucgaaagcugcaacaaggcauuagaacucgacagcaacaacgaaaaaggauuguuccgccgaggcgaagcucaucuggcagucaacgauuucgagcuggcccgagccgacuuccagaaaguguuacaguuguauccgaauaacaaagcagccaagacccaguuagcaguaugccagcagcgaauuagacgucagcuggcccgggaaaaaaaacuguaugcaaauauguuugagagacucgcagaagaagagaauaaagcgaaggcagaggccucaaguggcgaccacccuacagacacagaaaugaaagaggaacaaaaaagcaacacagcaggaucacagucacaaguagaaacugaggccuag

SEQ ID NO: 31788 - RNA, 477 nt, Artificial Sequence
  Description of Artificial Sequence: Synthetic coding sequence
auggaaccaccugagggcgcaggaacuggggaaauuguaaaagaggcagagguaccucaggccgcguuaggagugccggcucagggcacuggcgauaaugggcacacuccaguugaagaagaaguuggcggaaucccugucccagccccugguuugcuucaggucacggaaagacggcagccacucuccagcgucucuucccuggaagugcacuucgaucuccuggaccuuaccgaauugacugacaugagcgaucaggagcuugccgaaguguucgccgacucugacgacgagaaccuuaacaccgaauccccagcugggcuucauccacucccccgcgccggcuaccugcguucucccucauggacccgcacccgagcagaacaaucucacgaaaagcagccacucggcgacccagagcggcaggccaccguguuggauacuuucuugacuguugagcgaccccaggaggacuag

SEQ ID NO: 31789 - RNA, 954 nt, Artificial Sequence
  Description of Artificial Sequence: Synthetic coding sequence
auggccucaguuauuccugcaucaaacagaucuaugaggagugaucgaaacacauaugucggcaaaagguucguccaugugaagaaccccuaccuggaccugauggaugaggacaucuuguaccacuuggaccugggcaccaagacccacaauuuaccugcuauguucggggacgugaaguucguguguguuggcgggucccccaauagaaugaaagccuucgcccuguucaugcauaaagaauuaggauuugaggaagccgaggaggauauuaaagauaucugcgcuggaacugacagguauuguauguauaaaacugggcccgugcucgcaauuucccauggaaugggcauccccuccauaaguauuauguuacaugaacuaauuaagcugcuacaucaugcaagguguugcgaugugacaaucauucggauaggcacaucugggggcauaggcaucgccccugguaccguggugauuacugauauugccguugauagcuucuucaaaccaagauucgagcaggugauacuggacaauaucgugacuagaagcacagaacuagacaaggaacugucagaagagcucuuuaacuguucuaaagaaaucccaaauuuuccaacucucgucggucauacuauguguacuuacgauuuuuacgagggccagggaagacuggacggggcacuuuguuccuuuagccgcgagaaaaaacuggacuaucugaaaagagcuuuuaaagcuggcguccguaauaucgaaauggagaguaccguguucgcagccaugugcgguuuguguggccugaaggcagcuguagugugugucacccugcuggaccggcucgauugcgaucagauuaacuugccacacgacguccugguggaauaucagcaaagaccccagcugcucaucucaaacuucaucagacgccgacuaggacuuugcgacuag

SEQ ID NO: 31790 - RNA, 1095 nt, Artificial Sequence
  Description of Artificial Sequence: Synthetic coding sequence
auguccgaagucgaagccgcagcgggggccacagcaguuccugccgcaaccgugcccgcaaccgccgccgggguaguggcaguggugguuccuguuccagcaggugagccacagaagggaggaggcgcaggcggaggggggggggccgcguccgggcccgccgcggggacacccucagcaccaggaaguaggacucccggcaauccugccacggcugucucuggaacaccggcaccacccgccagaucacaggccgacaagccaguacuagcuauucagguguuagggaccguaaaaugguucaacguaaggaauggguacggauuuauaaaccgcaaugacaccaaagaagacguguucgugcaccagacagccauaaagcguaauaauccucgcaaauuccugagaagcguuggggacggagaaacaguggaauucgaugucguggagggggagaagggagcugaagccaccaauguaacaggcccuggaggggugccagucaaaggaucucgauacgcgccuaaucgaagaaaaagccgacgcuucaucccccgcccacccuccguggcgcccccgccuaugguugccgagauaccuucugcgggaaccggacccggcucgaagggggaacgagcggaagauucaggacagagaccacggagauggugcccgcccccuuuuuucuacagacgcagauucguaagaggcccacggccaccuaaccagcaacagccuauugagggcacagaccgcguggaacccaaagaaaccgccccucuagagggccaccagcaacagggagacgagcggguaccuccaccuagauucagaccccgguaccgucgcccuuuucggccacguccuaggcaacagcccacuacugaaggaggggauggcgaaaccaaaccaagccagggcccagcagacgguucgagaccagaaccucagagaccccgaaaccgucccuauuuucagagaagacgccaacaagcuccgggcccacaacaggcucccgguccucgccagcccgccgcuccagagacaucagccccgguuaauuccggcgacccuaccaccacaauucuggaguag

SEQ ID NO: 31791 - RNA, 5706 nt, Artificial Sequence
  Description of Artificial Sequence: Synthetic coding sequence
auggccaccuuucgaaauaaccauaugaagacuaaagcgagcgugcgcaagagcuuuuccgaagauguauuccagagcgucaaaagccuccuccagucgcagaaggaauuguguucaguaacagccgaagacugccuccaacaggaugaacacgcuaacuugaccgaggugacauuccucggguuuaacgaagagaccgaugcugcacauauccaagaucucgccgcugugucacucgaacugcccgacauucugaauagucugcacuuuugcucuuugaaugagaacgaaauuauauguaugaaaaauauaaauaaaccauuagauaucuccagcgauccacugaaucaaucacacccaucuggcaugcucugcgugaugagaguuucgcccacuuccccaagguugcggaucgauuuuauauucucccuuuugagcaaauaugcuacgggcauucguuacacuuuagauaccuuuuuacaccagaaacaccaacuggagacuacagacgaagacgacgacgacacaaaccagagcgugagcucaauugaagacgauuucgucacagcuuuugagcaccuugaagaggaagaaacaagcaagccuuauaacgauggaaugaacaucaccguucugaggagucagugcgaugccgcuucccaaacgguuaccggacaccaucuggaaacccacgaucugaaaauucucauauccucuggccaacagaagagucuagcaaagccuucaaccaguucugucaauguucucggccacaaggaacuuccuaguguaaagaccagcgucacaaccucaaucuccgaacccuggacccagcgcuccuuuuaccguucuagcaaugcaucugauaaagauuccgaucuacagaaaaccuucuucagcucuagcccugcuuacucauccgaaucggaauguucuucacccagccccguuaucuuucucgacgaagaggguuaccagaaaagccugaaagcuaagcuugaacugccuaaaauuccagugaugaaagacgauaucgaggacucagacucagaggucuccgaguuuuuugauucuuuugaucaguuugacgaacuggagcagacauuagagaccugccucuuuaauaaggacccagucauagggaagucgucucagagaaaaggucauaaacacggaaagucaugcaugaauccacaaaaguuuaaauuugaucguccagcccugccugccaacgugcguaaacccacuccaagaaagcccgaaagcccguaugguaaccuaugugacgcuccagacagcccaaggccaguuaaggcuagccgggaggacucaggccucuuuucgccaauuagaaguucagccuucucgccccugggaggcuguaccccagcagaauguuuuugucagacugauaucggaggagauagaauucaugaaaaucacgauucaguauacuauacuuacgaagacuaugcuaagucaauaagcugcgaagugcuugggagcguacuccgaacucaucacacuaacacuuuauccaauauuaacagcauaaagcauggugaaaauaagacggugacauucaaacauggcaaucuagaccagaagaauaagucaaagaacaagucccucaugauuaaagacucaauccaaaaguuugccgcggaccugguugaaaaauccuuuggaagcgccuuuaaagaucuccagaaaggagucucaagcuguaccaaugcacuguaccauuuggccaucaaguugaccucuagcgugcuacagauggccuucgacgagcucaggcgccagagagcuuuuucucuuaaagagcgcgccaucaguggucuggcuaauuuucuagucucugaagcauuaucaaaugcacugaaggaccugcaguacguuaagaagcagaucuucacuaacaccgucgcccgcuucgcagcugaucucgccgaagagcuugucuuugaggggauuauggagguuugccaguucucauauccucagacgccagccaguccccaaugcgguaguuucgacuucgaagauaaaguggucaaacuguacgccaaagaucugucagagucugucauucaggaagccuucaucgaacugucucagguggaugucaccuuuacuaccaaagccgcuguauccgugucaacugacaacaucaaauaugugagugcugagucugugguaccaucaacacaggccgucacuuucagcccgucuuuucacaaucaggccaucaugguaacaaagcccguucaggaauauaaaaaagaauacaccgugcaacaagcuuuauuuuguaccucagggaucgugaccucuauaccagugccuuuagccggaagugcccuuuugcccuaucacauuucuagcacagcgugccaggcaaaagcucaccuaucaagugaugacagcaacucuaacggcgacucugcacagguacauaucgcuacaaaaaaccgcgaggagaaagcagccuguuuaagaaacaucugccugccuuccgaacacaacccugggaaucaaaacgauuucaagccuacaaaugaugauauugagaugcagucuaguagcaaacucccaaacgaccccgcgauaauuucuaauuucucugccgcaguagugcauaccauaguuaaugaaacccuugagucaaugacgucccuggaaguuacuaaaauggucgaugagcguacugauuaucugacaaagucccugaaggaaaagaccccccccuuuucacauugugaucaagccgugcuccagugcuccgaggccuccagcaacaaggacauguuugccgaccgacuaucgaaaaguauaaucaaacacuccauagacaaguccaaauccgugauuccaaacauagauaagaaugccgucuacaaagaaaguuugcccgugucaggcgaggaaucccaacuuacaccagagaagucaccuaaauucccugacagucaaaaucagcuaacucacugcucacucagugccgcgaaggacugcguuccugaaugcaaagucucaauggugcacggcaguucucuugaaacccuccccucuuguccagcugugacaggacaaaaaucugaccugaaagaaucugcaaaagaccaaccccuaaagaaacauaaccucaauucuaccagucuggaagcccugucuuuugggcaagaaaauccguuuccccacucccauacauuuagcagcacagcucugacaugcguagauggccugcacguugaggacaaacagaagguccgcgaucgaaauguuauaccugauacccccccauccaccccuuuagucccgagccgggccaguagcgagugggacauuaaaaaacuuacuaaaaagcugaaaggugaauuggcuaaggaguucgcccccgcaaccccaccgucaacaccgcauaacagcagcguggggucucugucugaaaacgaacagaauaccaucgagaaagaggaguucaugcuaaaacugaugcguagccuuuccgaagagguugaaaguucugagagcggcgagcugccagaagucgaugugaaguccgaacauuccggcaagaaggugcaauuugcugaggcucuggccacacauauucugucccucgcuaccgagauggcugccucacaccuugacaauaaaauuauacaggaaccaaaggucaagaaucccugccucaauguccagucacaaaggagcguuuccccgacuuuccuuaacccauccgaugagaaucugaaaacucugugcaacuuugcuggugaccuggcugcugaggugauaaccgaagccgagaagauagcaaaaguccggaauugcauguuauucaaacagaagaagaacagcuguuacgccgauggcgacgaagacuauaaaguggaggagaaacucgauauagaggcagucguucacccccgcgaaguagacccauucauccugagccuaccccccucuaguuguaugaguggacugauguacaaauaucccucaugcgaaucugugacagacgaguacgccggacaucugauacaaauccuuaaacaagagggaggcaacagcgagcugauuauggaucaauaugcaaaucgccuggccuauagaucuguuaaaucaggacuccaggaagcagccaagacaacaaaaguccagugcaacagucgcauguuccccgucccuagcagccaggugaagacuaauaaggaguugcugauguuuucaaacaaggaacaucaucaggaggccgauaagaaaagacagaguaagcgcaaugaaggcuauuuuuguaagaaucagaccugcgagcggacuuuagauccuuauagaaaugaaguuucacaacuuuauuccuucuccacaagcuuaguacauagcauuaccaaggaugccaaagaagagcucaccgccagccugguuggacugcccaaaucacucacugacagcugucucuucgaaaaaaguggauacgaggaagauaacgaaugucacgucacaccagagcucccuaagagccuucagccaucaucacaaaaucaucgcuucuaucacuccacuggaucgcucaaugguuacggaugcggggacaacgugguucaagccguggaacaauacgccaagaaaguggucgacgauacgcucgaauugaccuugggaucuacuguuuuucgcgugagugagaccaccaaaagugcagaccgagucacauaugccgagaaacuguccccccuaaccggccaggcauguagguauugcgaccucaaggaguugcacaacugcaccgggaacaguagccagcauuuuuuuaggcagggcagucucgccucaaguaagccugcaucuaauccaaaauucagcucucgauaucaaaaaucucgcaucuuucaucuuuccguuccucagauccacgucaaucucgacaaaaaggcggucuuagcagagaagauuguugcugaggcgaucgagaaagcagaacgggaacucuccucaacuagucuugcggccgacucugggauagggcaagaaggcgcaaguuucgccgaaucacuggccacagagaccaugacagcggcagugaccaacguuggucacgccgucaguagcaguaaagaaauugaagacuuucagaguacugaaaguguguccucccaacaaaugaaucuaagcauaggagacgacagcaccggaagcuggagcaaccuuucuuuugaggacgagcaccaagacgaaagcagcucuuuucaccaucuuucugaaucuaauggaaacaguucaucauggaguagccucggccuggaaggugaucucuacgaagauaaucucagcuuucccacuucagacagcgauggcccggaugauaaggaugaagagcaugaggaugagguagagggccugggucaggacgggaaaacacuacugauuacuaacauagauauggagccauguacaguggauccacagcugcggauaauucuucaaugguugauugcuagcgaggcagaaguggcugaauuauacuuucacgacagcgccaacaaggaauuuaugcugcuauccaagcaauugcaagaaaagggauggaaggugggcgaucugcuucaggccguguuacaguauuaugaagugauggagaaagcuucuagugaggaacgaugcaagucccucuucgacugguuguuagaaaacgccuag

SEQ ID NO: 31792 - RNA, 417 nt, Artificial Sequence
  Description of Artificial Sequence: Synthetic coding sequence
auggcggaacugcagcaacugaggguccaggaggccguggaauccaugguuaagaguuuagaacgcgagaauaucagaaagaugcaggggcucauguuccggugcagcgcuaguuguugugaggacagccaagccagcaugaagcaggugcaccaguguauugagcgaugccacgugccacuugcccaggcccaggcccuagugacuucagagcucgaaaaauuucaagaucgauuggcuagaugcacuaugcacugcaaugacaaagcuaaggacaguaucgacgcagguucuaaagagcuccaggugaaacaacagcucgauucuugugugacuaaguguguagaugaucacaugcaucugauuccaaccaugacuaaaaaaaugaaagaggcacuccuaucuauuggaaaguag

SEQ ID NO: 31793 - RNA, 1110 nt, Artificial Sequence
  Description of Artificial Sequence: Synthetic coding sequence
augacgcuggaggcaauaagauacucacggggcagucuucagauuuuagaccaacugcuccuacccaagcaaagccgguacgaagcagucgggagcguccaccaggccugggaggcaaucagagcuaugaaagugcguggugcaccugccauugccuuggucggaugucugucuuuagcggucgaguuacaagccggcgcaggaggaccuggccuagccgcccuaguagccuucgugcgugacaaacugagcuuccucguaacugcccgccccacggcagugaauauggcaagggcugccagggaccucgccgacguggcggccagagaggcagaaagagaaggugcaacugaagaggcuguaagggaaagggucaucugcuguacagaggacaugcuggaaaaggauuuacgggauaacagaagcauuggugaccugggugcacgucacuuguuggaacgcgucgcaccauccggagguaaggugaccgugcugacacauugcaacacaggcgcguuggcuacggccggauacggaacagcucucggcgugauaaggagccugcacucgcugggcagauuggagcacgccuucugcacagagacuagacccuacaaccaaggagcaagacuuacagcauucgagcuuguguacgaacaaauaccagcgacacugauaacagauuccaugguggccgcagccauggcucacaggggaguuuccgcgguggugguuggagcagacagaguuguggcgaacggggacaccgcuaacaaagucgguacuuaccagcuggcaaucguugcaaaacaucacggcauuccuuuuuacgucgcggcaccaucaagcagcugugaucuucggcucgagacaggcaaggagaucaucauugaggagaggccaggccaggaauuaaccgacguuaacgguguccgcaucgccgcuccagggauugggguguggaauccagcuuuugauguuacuccucaugauuuaauuaccggagguauuauaacagagcuuggggucuucgcccccgaggaacuuagaacagcgcucaccacaacgauauccagucgcgauggaacucucgaugguccccagauguag

SEQ ID NO: 31794 - RNA, 3660 nt, Artificial Sequence
  Description of Artificial Sequence: Synthetic coding sequence
augauguccuuguccguccgaccgcaaagaagauuacuuuccgcaagggucaaucgaagccagucauucgcaggcgugcuggggucgcaugaaaggggcccucggagcuucccugucuucucuccuccugggccaccacggaaaccuccugcccuuucacgagugucucgcauguucucagucgcacauccugccgccaaaguuccccagccugagcgccuggaccuugucuacacugcccugaaaagaggccuuacugcauacuuagaaguucaccagcaggaacaggaaaaacugcagggacagauaagggagagcaagagaaauucccgacuuggcuuucuauacgaccuugauaaacagguaaaauccauugagcgguuccugcggcgccuugaguuucaugccagcaagaucgacgagcuuuacgaggcauacuguguucagcgacgauugcgagacggcgcauacaacauggugagggccuacacaacuggauccccuggcucaagagaggcuagggauaguuuagcugaggcuacucgaggccauagggaguacacagaauccauguguuuacuagagucugagcuggaagcucagcuaggagaguuucaccugaggaugaagggccucgcaggguucgcgaggcucugcguuggagaccaguacgaaauuuguaugaaauacggaagacaacguuggaaacuccgagggaggaucgaaggcucaggcaaacaagugugggauucugaggagacaaucuuucugccuuugcugaccgaauuucugaguauaaaagugacugaacugaaaggacuggcuaaccauguggucguaggaagugugucaugcgaaacuaaggaccuuuuugccgcccuuccgcagguuguggccgucgauaucaaugaucugggaaccaucaaacugagccuugaggucacauggagccccuucgauaaggaugaucaaccuucagcggccuccaguguuaacaaggcuuccaccgugacaaagagauuuagcaccuacucgcaaaguccucccgauacccccucucuacgugagcaggccuuuuauaacaugcuuagaagacaggaagaacuugagaauggaaccgccuggagccucucaucggaaucuuccgacgauaguagcagcccccaauugagcggaacagccagacauucuccugcgccccguccccucgugcaacaacccgaaccccugccuauucaagucgcauucagacgaccugagacccccucaaguggcccucuggaugaagaaggggccgucgccccaguacucgccaauggacaugcacccuacagccgcacuuuaagccacaucagcgaagcuagcguugacgccgcccuugccgaagcuucuguggaagcugugggccccgagagucuugccuggggccccaguccaccuacgcacccagccccgacucauggugaacaucccuccccaguuccacccgcucucgauccgggccauagcgcgacgucaucuacguuagguaccaccggcagcguccccacaucaacagauccugcuccaagugcccaucuggacagcgugcauaaguccaccgacucuggucccuccgaacuuccaggaccaacacauacgaccacaggcuccacauauucugcuaucaccaccacucauuccgcucccuccccccuaacucauacuacaacaggaucuacccacaagcccauuauaucaacucuuacuacgacuggccccacucugaauaucauaggccccguucagacaaccaccagcccuacacacacuaugccaucucccacccauaccacggccucuccaacacacaccucaaccucccccacucacacccccaccucacccacucacaagacuucuaugucaccucccacaacuacgagccccaccccaucuggaaugggauuagugcagaccgcaaccucgccaacacauccuacaacuucuccuacacauccaaccaccuccccaauccucauuaacgucucucccaguaccucacuugaacuugcgacacugucaucucccucuaaacacagcgaucccacacugcccggaaccgauucacugccaugcucgccaccugucuccaauucguacacccaggcagauccuauggccccucgcaccccccacccaagcccugcucacucuucucgaaaaccacugaccagcccagcaccugaucccagcgaaucgacugugcagucucugucucccacaccauccccgcccacccccgcaccacaacacucagacuugugucucgcuauggccgugcagaccccggugccgacagcugccggcggaucuggcgauaggucauuggaagaggcccugggcgcccugauggcugcucuugaugauuauaggggacaauuuccugagcugcagggacuggaacaggagguuacaagacuggagucccucuugaugcaaaggcagggguugacacgaagucgcgcuucuucgcuaucaaucacaguagaacacgcuuuggagaguuuuucguuucugaaugaggaugaagaugaagacaacgaugugccuggggaccgaccgccuucaaguccagaggcuggugcagaagacagcauugauucaccaucggcgagaccccugaguacaggcugucccgcccuggaugcugcgcuggugcgucaccuguaccacugcagccgucuauuguugaaacucggaacauuuggcccccuccggugccaggaagcuugggcgcuagaaaggcugcugcgggaagcccgaguucuugaagccgugugcgaauucagccgcaggugggagauucccgcguccuccgcgcaagaaguaguccaguuuuccgccuccaggcccggcuuucugacauuuugggaccagugcacagaacgucucucaugcuuccuuugcccuguugagcguguuuugcugacuuucugcaaucaguauggugcucggcucucgcuuagacagcccgggcuagccgaagcugugugcguaaaauuucuugaagaugcccugggacagaaauugccuagacgaccgcagccuggaccuggggaacagcugaccguguuucaguuuuggagcuuugucgaaaccuuggauuccccgaccauggaagcauacgugaccgaaacggcggaagagguucugcuagugagaaaccuuaacagcgaugaucaggcaguggugcucaaggcccucagacuggcaccagaaggccgacuaagacgggaugggcugcgcgcccuguccagucuccuggugcauggaaauaacaaggugauggcugcaguuucaacucaguugagaucccugucucuuggcccaacguuccgcgaacgagcucugcucugcuuucuugaucaacucgaggaugaagacguacagacacgaguugccggaugccuggcccugggauguaucaaagcgccagaggggauugaaccacucguguaccucugucagacagauacugaagcuguucgagaagcugccaggcagaguuugcagcagugcggugaggaaggacaaucagcacaucggaggcuggaagaaagucuugacgcacuuccucgcaucuuugggcccggcuccauggcuagcacugcauucuag

SEQ ID NO: 31795 - RNA, 1326 nt, Artificial Sequence
  Description of Artificial Sequence: Synthetic coding sequence
auggcaucaguggccgcugcccgcgccguaccggugggaucuggucuacggggccuccaaaggaccuuaccgcuagugguuauacucggggcaacaggcacuggaaaaaguacucuggcgcuucaguuggggcaacgcuugggaggugagaucgugagcgccgacucaaugcaggucuacgagggucuagacauuauuaccaacaaagugagcgcccaagagcagcgcauuuguagacaucacaugauuucguuuguggacccuuuagugacuaacuacacaguuguagacuuucgcaaccgugcaacugcacugaucgaagauaucuuugcacgagacaaaauuccgauugucguuggcgggaccaacuacuacaucgaguccuugcuuuggaaggugcuaguaaauacaaaaccacaagagaugggcacagagaagguuauugacagaaaggucgaguuggaaaaagaagauggucuugugcugcacaaacgacugucacagguggauccugagauggccgcuaaacugcauccccacgauaaacgcaaggucgcccgcucgcuccagguguucgaagagaccggcaucucucacagugaguuuuuacaucgucagcauacggaagaggguggaggaccccuggguggcccucugaaauucucaaacccauguauucuauggcuucacgccgaccaggcaguucuggaugaaagguuagauaagcgcgucgaugacaugcuggccgcaggcuugcuugaagagcuacgggauuuucaccggagguacaaccagaaaaacgugucugaaaacucucaggacuaccaacacggaauuuuucagucaauuggauuuaaagaguuucacgaguauuugauuaccgaagguaaguguacccucgagacgagcaaucagcuucugaagaagggccccgguccgaucguuccacccguauauggccucgaggucucugacguauccaaaugggaagaaaguguucucgagcccgcccucgagauaguccaguccuucauucaaggucacaagccuaccgccaccccaaucaagaugccuuauaaugaggccgaaaacaaacgaucuuaccacuuaugugaccugugugauagaauaauaauuggcgaccgggagugggcagcacauaucaaauccaaaagccaucugaaucagcuaaaaaagcguaggagacucgauucugaugccgugaacacuauugagucacagagugucucccccgaccacaauaaggaacccaaagaaaaaggaucgccaggacagaaugaccaagaacugaagugcagugucuag

SEQ ID NO: 31796 - RNA, 618 nt, Artificial Sequence
  Description of Artificial Sequence: Synthetic coding sequence
auggcagaaccccugcagccugacccaggggccgcugaggacgcugccgcacaggccguagagacucccggauggaaggcuccugaagacgcagguccgcagcccggaucuuacgaaaucagacacuauggaccggcaaaaugggugucaacaagcgucgaauccauggauugggauagcgccauccagacaggcuuuacaaaacugaacuccuauauacaaggaaaaaaugagaaagaaaugaaaauuaagaugacagcucccgugaccagcuaugucgagcccggcucuggcccuuucagcgaguccacuauuacaaucagccuuuauauucccagcgagcagcaauucgacccgccuaggccucuagagagcgacguguuuauugaagacagggcagagaugacagucuuugugagaaguuuugacgguuucaguagcgcacaaaaaaaccaggaacaauuacucacacuugcaucuauccugagagaggauggcaaggucuuugaugagaagguauauuauacggccggauauaauucgccagugaaauuacugaacagaaauaacgaggucugguuaauacaaaagaaugagccaacuaaggaaaaugaguag

SEQ ID NO: 31797 - RNA, 624 nt, Artificial Sequence
  Description of Artificial Sequence: Synthetic coding sequence
augagcuguacaauugaaaagauccucaccgacgcaaaaacccuccucgaacgauuacgcgaacacgaugcggccgcagaaucacuuguggaucagagcgcagcauuacaccggcguguggcagccaugagagaggcagggacggcgcugccugaccaguaucaagaggaugcaagugacaugaaagauaugucuaaguacaaaccccauauacuguuaucucaggaaaacacucagauacgcgaccugcagcaggagaacagagaacuuuggauuucucuugaagaacaccaagacgcauuagagcuuauuaugucuaaauauagaaaacagauguuacagcugaugguagcgaaaaaagcuguggaugcagaaccagucuugaaggcccaucagucucacuccgcugaaauagaaagucaaauugaccgaauaugcgaaaugggggaaguuaugaggaaggcuguacagguggacgacgaccaguuuugcaagauccaggaaaaauuagcgcaacuggagcuagagaauaaggaacugcgugaguuacugagcauuucuagcgagucucuucaagcucguaaagaaaacucuauggauaccgccucacaagcuauuaaauag

SEQ ID NO: 31798 - RNA, 1032 nt, Artificial Sequence
  Description of Artificial Sequence: Synthetic coding sequence
augaauauccaucgcaguacccccauuaccauugccagauacggccgaucuagaaacaagacccaggauuucgaagaacugucaaguauccggagcgccgaaccaucucaguccuuuucaccaaaccuagguaguccaucaccuccugaaacuccuaaccugucccacugcgucucgugcaucggcaaauaucuguugcuugagccacuggagggggaccaugucuuuagggcagugcacuugcauuccggcgaagaacugguauguaaagucuucgauauuagcugcuaucaagagucacuagcccccugcuucugucugagcgcccauucuaauaucaaccagauuacagagauaauucuuggugaaacuaaagcauaugucuuuuucgaacguuccuacggggacaugcacucauuuguccgcacauguaaaaaacuccgggaggaagaagcugcgcgacucuuuuaucaaauugcuuccgccguagcgcacugccacgacggugggcuuguucuacgugaucugaagcugagaaaguucaucuuuaaagacgaggagagaacacgagugaagcuagagucacuugaggaugcuuauauccugaggggugacgaugacucacugagcgauaagcacgguuguccagccuacgucagccccgaaaucuugaauacauccgguuccuacucuggcaaggcugcugauguuuggagucucgguguuaugcuguacacuauguuagugggccguuaccccuuccaugauaucgagccuaguaguuuguucucuaaaauucgacggggccaauuuaacaucccugaaacauugucgccaaaagcuaagugccugauccgcuccauucugagacgagaaccaagugagagacuaacuagccaggaaauucuggaucauccuugguucucuaccgauuuuucuguuaguaauucugcauacggcgcaaaagaagugagcgaucagcuuguccccgacgugaauauggaggaaaaucuggacccuuuuuucaauuag

SEQ ID NO: 31799 - RNA, 3048 nt, Artificial Sequence
  Description of Artificial Sequence: Synthetic coding sequence
augcgccgcuucuugagacccggccacgaucccgugcgugagcggcucaagagagaucuauuucaguuuaacaagacaguggaacauggcuuuccccaccagcccucugcucucggcuauucuccuucucuccggauccuugcgauagguacgcguaguggugcgaucaagcucuacggcgcgccaggcguggaguuuaugggccuucaucaggaaaacaaugcugugacucagauccaccugcuccccggucagugccaauuggugacucuucuggacgauaauuccuugcaucuuuggucauugaaggugaaggggggagcgucagagcuccaagaggaugagucuuucacccuuaggggcccucccggagccgccccuagcgccacccagaucaccguaguucuaccucauuccuccugcgaauugcuguaccugggcacagaauccggaaacgucuucgugguucaacuuccugcauuccgcgcgcuugaagaccgcaccaucaguagugaugcagugcuucagcgccuuccagaagaagcaagacaccggagaguuuucgaaaugguugaggcucuacaggagcauccucgggauccgaaccagauucuaaucggcuacucuaggggacuggucgugaucugggaccuucaggguucacgcgugcuguaccauuuucuuucuucccagcaauuggaaaacauaugguggcagagggauggacgacuucuggugucgugccacagugauggcaguuauugucaguggccaguuaguuccgaggcacagcagccugagccacuccguucccugguacccuauggcccauuuccuugcaaagcuauuacacggauccuauggcuaaccacacgacaaggcuugcccuucacuaucuuccagggaggaaugccccgggcuaguuauggugacagacauugcaucucugugauccacgauggucagcagaccgcguucgauuuuacauccagaguuauuggcuucacaguucuaaccgaagccgauccagcugccacauuugaugacccuuacgcucugguggugcucgccgaggaagaauuaguuguaauugaccugcagacugcuggguggccccccgugcaguugccuuaucuagcaucacugcauugcucagcuauuaccugcucucaccacgucaguaauaucccacugaaauugugggaacgcaucaucgcugccggcucucggcagaacgcucauuucuccacaauggaauggccgauugacggagguaccagucuuacuccugcccccccacagcgcgaccugcugcugaccggacacgaggaugggaccgugagauuuugggacgcuagugggguaugccugcgacucuuguauaagcucucuaccgucagaguuuuucugaccgauaccgaucccaacgaaaacuuuucugcccaaggugaggacgaauggccaccccuucguaagguaggaagcuucgaccccuauucugacgauccacgacugggcauucagaaaauuuuuuuauguaaguauagugguuaucuugcagucgccggaaccgcaggacaggugcugguguuagaguuaaacgaugaggcugccgaacaggcuguggaacaagucgaagccgaccuuuuacaggaucaagagggauaccgauggaagggccacgagcgucuggcugccagaucuggaccagugagauucgaaccaggcuuccaacccuucgucuuaguucagugucagcccccagccguggugaccucccuagccuugcacucugaauggcgacugguugccuucgguaccucccauggauuuggacuguucgaccaccaacaacgacgccagguuuucgugaaaugcacccuccacccuucagaucaguuagcucuugaagguccacugagcagagucaaaucccugaaaaaaagcuugagacaaucguuccgacggaugcgcagaagcaggguaucaagccguaagagacauccugccgggccgccaggugaagcccaggaggguagcgccaaagcagagcggccugggcuccagaacauggaacuugccccagugcagagaaaaaucgaggcucguuccgcagaggauucauucaccgguuuuguccgcacccuguauuucgccgauacuuaucucaaggauuccagcaggcauugucccagucuaugggccggaaccaauggcgguacaaucuacgccuuuagucugagaguucccccagccgagcggagaauggacgagccaguuagggcugaacaggcgaaagaaauccagcugaugcacagagcccccguggucggaauacuugugcuggacggccacagcgugccucuccccgaaccucuggaagucgcgcacgaucugaguaaaaguccugacaugcaggguucccaucaacuauuggucgugagugaggagcaauuuaagguguucacacugccaaaagugucugcaaaacuaaaacuaaaauuaaccgcacuggaaggaagccgcgucagacgagucucagucgcacacuuuggcucccggagggccgaggacuacggugaacaccaccucgcagugcucacuaaucugggcgacauccagguuguuagccuuccguuacugaaaccccagguacgauacucaugcauaagacgggaggaugugagcgguauugcuaguuguguguuuaccaaauacggccagggcuucuaucugaucagucccucagaauucgagagauuuagucucagcaccaagugguugguagagccaagaugucucguggacucagcggagaccaagaaccacaggccagggaacggugccgggcccaaaaaagccccuucaagagccaggaacaguggaacucagucugauggcgaagagaagcagccugguuuaguuauggagagagccuuacuaucugacgaacgagccgcaacgggcgugcacauugaaccuccuuggggagcugcuagugcuauggccgaacagagcgaaugguuaagcguccaagcagcccgguag

SEQ ID NO: 31800 - RNA, 582 nt, Artificial Sequence
  Description of Artificial Sequence: Synthetic coding sequence
augcucggaguguuagaacuacugcuccuuggugcggccuggcuggccggaccugcucgaggccaaaaugagacagaaccaauugugcuggaggggaagugucucguggugugcgacuccaauccuaccagugauccaaccggcacagcacuuggcaucaguguccggucgggcucagcuaaaguggcuuuuagcgccaucagaagcacuaaucaugaaccuucugaaaugucuaacagaacaaugauaaucuauuuugaucaaguacucguaaauauuggcaauaacuucgacucggagcgcaguacauucaucgcuccgcguaaagggauauacuccuuuaacuuucacguggucaagguguauaauaggcaaacaauccaggucucacuaaugcuuaacggauggccgguuauaagcgcuuucgcuggcgaucaggacgugaccagagaagcagcauccaacggcgugcuuauucaaauggaaaaaggggauagggcguaucuuaaguuagagcgggguaaucucaugggaggauggaaguacucuacauuuucuggguuccugguguuuccccuguag

SEQ ID NO: 31801 - RNA, 1530 nt, Artificial Sequence
  Description of Artificial Sequence: Synthetic coding sequence
augggcgucuuaaaauucaagcacauauucuuuagauccuuugucaaauccuccggcguuucccaaauuguuuucacuuuucuacugauccccuguugccuuacacuuaacuuucgggcacccccuguuauuccuaaugugcccuuucugugggcauggaaugcgcccucagaauucugcuuagguaaguuugacgaacccuuggauaugucacuauuuucauuuauuggcaguccucgaaucaacgcuaccggccaggguguaaccauauuuuauguagaucgguuaggguacuacccauacaucgauucuauuacaggggucacagugaaugguggcauuccucagaagauuagcuuacaagaccaucuggauaaagcaaaaaaagauaucacauucuauaugccuguggauaaccugggaauggccguuauugacugggaagaguggagaccgacaugggcccguaauuggaaaccuaaggauguguacaagaaucgguccauugagcugguucaacagcaaaacguacaacugucccuuacagaggccacagaaaaagccaagcaggaauucgaaaaagcagggaaagauuuucugguggaaacaaucaagcucggcaaguuacugcgucccaaucacuugugggguuacuaucuuuuucccgacugcuauaaucaucauuacaagaagccuggauacaaugguagcuguuuuaacgucgaaauuaaacgcaaugacgaccuuucauggcuuuggaacgaguccaccgcuuuguaccccucuaucuauuugaacacucagcaaagucccguugccgcaacccuauauguucgcaacagagugagggaggcgauccgcgucaguaaaaucccagaugccaaaagcccucucccugucuucgcuuauaccagaauuguguucacugaucaggucuuaaaauuucugucucaggacgaauuagucuauacauucggcgaaacugucgcucucggagcuucagggauugugauuuggggaacucucucaaucaugcgcucuaugaaaagcugcuugcucuuagauaacuacauggaaaccauccucaauccuuacauuaucaacgucacccuugccgccaagaugugcucucaggugcugugucaggaacaagggguuugcaucaggaagaacuggaauuccuccgauuaccuacaucuaaauccagacaacuucgccauacaacucgagaaaggcgggaaauuuaccguucggggcaagccaacccucgaggaccuggaacaauuuagcgaaaaauuuuacugcuccuguuauucgacccucuccugcaaggagaaggccgacgugaaagauaccgaugccgucgacgugugcaucgcagauggggucugcaucgacgccuuccuuaagccucccauggaaaccgaggagccacagaucuucuauaaugcaucuccuucuacgcucucagccaccauguucaucgucuccauccucuuucucauuaucuccagcguugcaucccuuuag

SEQ ID NO: 31802 - RNA, 1437 nt, Artificial Sequence
  Description of Artificial Sequence: Synthetic coding sequence
auggcacaugugccagcacgcacaaguccaggacccgguccacagcuccugcuccuuuugcugccacuguucuugcugcuucugagagacguugcuggcagucauagagcccccgcuuggucggcccucccagccgcagcagauggacugcaaggggacagagacuugcagcgacaccccggcgaugcagccgcuacauugggacccucugcacaagacaugguugcuguucauaugcaucgccuauaugagaaguacucacggcaaggcgcaagaccugguggagggaauacuguccgauccuuucgcgccagacuugagguugucgaucaaaaagcaguuuauuucuuuaaucucaccucgaugcaagacucugagaugauccucaccgccacauuucacuuuuacagugaaccaccaagauggccucgagcacucgaaguacuguguaagccgcgggccaagaaugcaucagggcgcccgcucccacuaggccccccaacacgccagcaucuucuauuccguagcuugucucaaaauacagcaacccaaggccuccugcgaggagccauggcuuuggccccuccuccacgcggccuauggcaagccaaagacauuagccccaucgugaaggcagcgcggcgugauggugagcuucuccuuuccgcucagcuggacuccgaggaacgggacccaggagugcccagaccuagcccuuaugcuccguacauacuggucuaugcuaacgaccucgccauuagcgaaccuaauuccgucgcugucacucugcagagauaugauccuuuuccagcuggagacccugaaccucgggccgcacccaauaauagcgcugauccaagaguacgccgggccgcucaagccacuggaccucugcaggacaacgaguugccuggacucgacgagagaccacccagagcgcaugcccagcauuuucauaaacaccagcuguggccuuccccauuccgcgcuuugaaaccaagaccuggaagaaaagacaggcgaaaaaagggacaagaggucuuuauggcagccagucagguccuugacuucgacgaaaaaacaaugcaaaaagcucgcagaaagcagugggacgagccgaggguaugcagccggcgcuaucuuaaaguggacuuugcggauauugguuggaaugaauggaucauuagcccuaagagcuucgacgcuuacuacugugccggagccugugaauucccaaugcccaaaaucgugcggccuagcaaccaugccacuauccaauccaucgugcgcgccguugguauuauccccggaaucccagaaccguguugcgugcccgacaagaugaauagccucgggguccucuuucuggaugagaaucgaaacgucgugcugaagguauauccgaacaugagcguugacacaugugccugccgcuag

SEQ ID NO: 31803 - RNA, 1941 nt, Artificial Sequence
  Description of Artificial Sequence: Synthetic coding sequence
augagcaaaggaccugcuguaggaauugaccugggaacaacuuacucuuguguuggaguguuucagcacggcaagguggaaaucauagccaaugaucaggggaauaggaccaccccuucauacguggccuucacagauacagaaagacucaucggggacgcugcgaagaaccagguugcaaugaauccuaccaacacaguauucgacgccaaacgccucaucgggaggcgauuugaugacgcugucguacaaucagacaugaagcauuggccauucauggugguuaacgaugccggacgaccuaaggugcaagucgaguacaagggagaaacaaagucauuuuaccccgaggagguaaguaguaugguauuaacaaagaugaaagaaaucgccgaggccuacuuggguaagacugugacuaaugccguuguaacagugcccgccuauuuuaacgacagccagagacaggccacgaaggacgcaggaacgauagccggucuaaacguuuuacggaucaucaacgaaccuacagccgcggccauugcguauggucuggacaagaaagugggggcggagagaaaugugcugaucuuugaucuugggggugguacuuucgaugugagcauucuuaccauagaagauggcaucuuugaaguuaaaucaacagcuggugauacacacuuaggcggggaagauuucgacaaucgaauggucaaucacuuuauugcagaguuuaagcgaaaacauaagaaggauauuagcgaaaauaaacgggcaguccggcggcugaggacugcaugcgagcgagccaaacggacacugucaagcagcacacaggcaagcauugagauugacagccucuaugaagguauugacuuuuacaccucuaucacaagggcgagauucgaggaacuuaacgccgaccuguuucgcggaaccuuggacccaguagagaaggcccucagggacgcuaagcuugauaagucucaaauacacgacauugugcucguagguggcucgacccggauuccaaagauucagaagcucuugcaggauuuuuucaacgggaaagagcuuaacaaguccaucaacccagaugaggccguggcauauggcgcugcugugcaggcugcuauacucuccggagauaaaucugagaacgugcaggaucuccuccuucuggaugucacaccucuaucguuggggauugagaccgcgggagguguuaugaccguucugauuaaacgaaacaccacuauuccuacaaagcagacccagacauucacuacuuacucugacaaucagccuggugugcuaauucaggucuacgaaggagagagggcaaugacaaaagauaauaaccuccuggggaaauucgaacucacagggaucccaccagccccacgaggagucccacagauugagguaacauucgauauugacgcaaaugguaucuugaacgugucggccguagacaagucaacaggaaaagaaaauaagauaacaaucaccaacgacaaaggaagguugucgaaggaggacauugaacgaaugguccaggaagcagagaaauauaaagccgaagacgagaaacagagagauaagguuuccagcaaaaauucacucgagagcuacgcauuuaauaugaaagcaacuguggaggaugaaaagcuucaggggaaaauuaacgacgaggauaaacagaagauacuggauaaauguaaugagauuauuaacugguuggauaagaaccaaacagcagaaaaggaggaauucgaacaucaacagaaggagcuagagaaggugugcaauccaaucauuacaaaauuauaccagagugcaggaggaaugcccggaggcaugcccgggggcuucccagguggcggagcaccuccaagcgggggcgcuuccucugggcccacuauagaggagguugauuag

SEQ ID NO: 31804 - RNA, 1632 nt, Artificial Sequence
  Description of Artificial Sequence: Synthetic coding sequence
augcgcaaacccgcagcugguuuucugcccucucuguugaaaguacuguugcugccauuggcccccgccgcugcccaggauucuacccaagccucuacccccgggagcccacugagucccaccgaauacgaaagauuuuuugcccuccucacacccaccuggaaagcugaaaccaccugccgacugcgcgcuacucacggaugcagaaauccuacauuagugcagcuugaccaauacgagaaccacggauuggucccugauggagcaguuuguagcaaccugcccuacgcuagcugguucgaaucuuucugucaguuuacccauuaucgaugcaguaaucauguguacuacgcuaagcggguucuguguagucagccggucucaauucuuucccccaauacgcucaaggagaucgaggccagcgccgaaguuucuccaacuaccaugacaagucccauaagcccccacuucaccguuaccgaaagacagacauuccaaccauggccugaacgacugucuaauaaugucgaagagcugcugcagucuucuuugucccugggugggcaggaacaggcaccugagcauaaacaggaacaagggguagaacacagacaggaaccuacacaggagcauaagcaggaggaaggccagaagcaggaagaacaagaggaggagcaggaagaagagggaaaacaggaagaaggacagggcacaaaggaagggagggaggccgugagucaacuucagacggacagugagccgaaguuccauagcgagucucugucaucaaacccaucuuccuuugcaccccgugugcgggaaguagaguccacgcccaugaucauggaaaauauucaggagcuuauaagaagugcacaggagauugaugaaaugaacgaaauuuacgacgaaaacuccuacuggagaaaucagaacccggggucacuuuuacaacugccccauacugaagcucuacuggugcuuuguuauucaaucgucgaaaacacguguaucauuaccccaaccgccaaagcuuggaaauacauggaagaagagauauugggauuugguaaaagcgucugcgacucccuaggaagacgucacauguccacaugcgccuugugcgauuuuugcucucucaagcucgagcaaugccauuccgaagcuucccuccagaggcagcagugcgauaccucacacaaaacuccauuugucucuccccuacuggcaagucagucucucucuaucgguaaccaaguggguucaccagaaucuggacgcuucuauggccuugaucuuuacgggggacuucauauggacuuuuggugcgcaagacucgcaacaaaaggcugugaggacgucagagugagcggauggcugcagaccgaauuucuuagcuuucaggacggagauuucccgaccaagauuugcgacaccgacuauauccaguacccuaacuacugcucuuucaagucccagcagugccuuaugcgcaacaggaauaggaaaguuucucgaaugagauguuuacaaaaugaaacuuauagugcucugucuccgggcaagucugaagauguuguucuccgcuggagccaggaguuuaguacauugacacucggccaauucggauag

SEQ ID NO: 31805 - RNA, 2349 nt, Artificial Sequence
  Description of Artificial Sequence: Synthetic coding sequence
auggccccgucagcuugggcaaucugcugguuguuaggaggauuacugcugcacgggggcucaucagggccaagccccggaccaaguguuccacgacugcgccucaguuaucgugaccucuugagugccaaucgaucagcgaucuuucucggcccccagggcucccucaaucuucaggccauguaucuugacgaauaucgcgaccgccucuuucucggaggcuuggaugcgcuguacucccuucgccuagaccaagcuuggccggauccuagagagguguuguggccaccucagcccggucagagagaagaaugcguacgaaaggguagagaucccuuaacagaaugcgcaaauuucguucggguguugcagccucauaacagaacccacuuacuugccuguggcacuggcgccuuucagccaacaugcgcucugaucacggucggacaccggggagaacacguccuucaucuggaaccaggcucuguagaauccggucgcggccgcugcccacaugagccuucucgccccuuugcaucaaccuucauugauggggaauuguauacaggccuuacggcagacuuccucggccgugaagccaugauuuucagaucuggaggaccucggccugcucuacguagugacagcgaucaaagucugcuacacgauccccgcuuuguuauggccgccagaauaccggaaaauucugaccaagauaaugacaaaguguauuucuuuuuuagugaaacggugccgagcccugacggaggcucaaaucacguaacuguuuccagaguggguagggugugugucaaugacgcuggcggccaacggguguuggugaacaaaugguccaccuuccugaaagcuagacucguauguagcgucccaggacccgguggcgccgagacucauuuugaucaauuagaagacguguuucuccuguggcccaaggccggaaagagucuugaagucuaugccuuguucucgaccgucagugccgucuuccagggcuucgcagucugcgucuaccacauggcagacauuugggaaguuuuuaaugggccuuucgcucaccgcgaugggccgcagcaucaaugggggcccuauggaggaaaagugcccuuuccuagaccuggcguguguccaagcaagaugacagcccagccuggccgcccauucgguuccacaaaggacuaucccgacgaaguccuucaguuugcuagggcucauccauuaauguucuggccugugcguccgcgucauggaagaccagugcuggucaaaacacauuuggcccaacaauugcaucagauugugguggauagagucgaagcugaagacgguaccuacgacgugauuuuccuuggaaccgacaguggaucugugcucaaagugauugcucuccaggcgggcggcucagccgaacccgaggaaguugugcuagaggagcuccaaguuuucaaaguccccaccccaaucacagaaauggagauuuccgucaaacgacagaugcuguauguuggaucccgccucggagucgcccagcuucgcuuacaucagugcgaaacauauggcaccgcuugugcugaguguugucuggcgagagacccuuacugugcuugggacggagcguccugcacacauuacagaccgagccugggaaaaaggagguucagaagacaggacauucgacaugggaauccagcucuccagugccugggccaaucacaagaggaagaagcugucggccugguugccgccacgaugguuuaugggacagaacauaacucuaccuuccucgagugcuugccgaaaucaccacaggccgcaguaagauggcugcuucagagacccggggacgagggacccgaccagguaaagacagaugagagagugcuccacacugaaagaggccugcuguuucgccgccugagccgcuucgaugcugggaccuauacaugcacaacucucgagcacggauuuucccaaaccgucgugcgccucgcgcuaguuguaaucguggccucacaguuagauaauuuauuuccccccgaacccaagccagaagagccuccugcucgggguggccuggcaagcaccccccccaaagcaugguauaaagacauacuucagcucauuggauucgcuaaccucccuagaguggacgaguacugcgaaaggguguggugcagaggaacaaccgaauguuccggguguuuuagaagucggagccguggcaaacaagcuaggggaaagaguugggcaggacucgagcuggggaaaaagaugaagagccguguucacgcagaacauaauaggaccccucgcgagguugaagcaacauag

SEQ ID NO: 31806 - DNA, 1395 bp, Artificial Sequence
  Description of Artificial Sequence: Synthetic coding sequence
atggaaccttcgtcccttgaactccccgctgacacggtgcagcggatagcagcagagctgaagtgtcaccccacggatgaaagagtggcgctccatcttgacgaggaagataagctccgtcatttccgggaatgtttctacattcctaagatccaagatctgcctccagtcgatctgtctcttgtgaacaaggatgaaaacgcgatctattttcttgggaattcgttgggccttcagcctaagatggtcaagacctacctggaggaggaactggataaatgggccaagattgccgcctacggtcatgaagtgggtaagaggccgtggattactggtgacgaatctattgttgggcttatgaaagacattgtgggtgccaacgaaaaggaaatagcgcttatgaatgcattgactgtgaatctgcatctgcttatgctttcatttttcaagcccactcccaaacgctacaaaatcctgctcgaggccaaggcgtttccgtccgatcactacgcaattgagtcccaactgcagctccatggactgaatatagaagagtcgatgcgcatgattaagccccgtgagggagaagaaactcttcgaattgaggacattcttgaggtcatagaaaaagaaggagattccatcgccgtgatcttgttttccggagtgcatttctacaccggacaacacttcaatattccagcgatcaccaaggcaggtcaggctaagggatgttacgtcggttttgacctggcgcatgcagtggggaatgtggaattgtatctgcacgattggggggtggatttcgcatgttggtgttcctacaaataccttaacgccggagcaggcggaatagcaggagcattcattcatgaaaagcatgcacacaccatcaagccagctcttgtgggatggtttggccatgaactctccaccaggtttaagatggataacaagctgcaactgatacctggcgtgtgtggttttcgaatctccaatcctcctattttgctggtgtgttcacttcatgcgtcgttggagattttcaagcaagccacgatgaaagcactcagaaagaagtctgtcctgctgaccgggtacttggagtacctgattaagcacaactacggaaaagataaagcagcgaccaaaaaaccagtggtgaacattatcactccatctcacgttgaagaaagaggatgccaattgactattacctttagcgtccctaacaaggacgtgttccaggaactggaaaagagaggggtggtctgtgacaaaagaaaccccaacggtatccgcgtggcaccagtaccactttacaacagctttcacgacgtctacaagtttactaatctgttgacttcgattctggatagcgcggaaaccaagaac

SEQ ID NO: 31807 - DNA, 1395 bp, Artificial Sequence
  Description of Artificial Sequence: Synthetic coding sequence
atggagccctcaagccttgaactcccagcggacaccgtgcagcgcatcgccgcagaattgaagtgccacccgactgacgaacgggtggccctccacttggatgaggaagacaaattgcgccacttcagggagtgcttttacatccccaagatccaggacctcccgcctgtggacctctccctggtgaacaaggacgagaacgctatctatttcctgggaaattccctcggactgcagccgaagatggtgaagacctacttggaagaagagctcgataagtgggcaaagattgcggcatacggccacgaagtgggaaagcgcccttggattaccggcgacgagtcgatcgtcggtctgatgaaggacatcgtgggcgctaacgaaaaagagatcgctttgatgaacgctctgactgtgaacttgcatttgcttatgctgtcgtttttcaagccaacgcctaagcgatataagatcctgctcgaggcgaaagcgtttccctcggaccactatgccatcgagtcccaactgcaacttcacggactgaacatcgaggagtccatgcggatgattaagccgcgggaaggggaagaaaccctgagaatcgaggatatcctggaggtgatcgaaaaggaaggagactcaatcgcagttattcttttttcgggagtccacttctacactggacagcacttcaatatccccgccatcaccaaggcgggccaagccaagggatgctacgtgggatttgacctcgcgcatgccgtagggaatgtcgaactgtacctccatgattggggcgtcgatttcgcctgctggtgtagctacaaatacctgaacgccggtgcaggaggaatcgccggtgccttcattcacgaaaagcatgctcatacgatcaagccagccctggtgggttggttcgggcacgaactctccactcggttcaagatggacaacaaactgcagttgatcccgggagtgtgtggattcagaatctcaaaccctccaatactgctcgtttgctcgctccacgccagccttgaaatcttcaagcaggctactatgaaggctctgagaaaaaagtcagtgctgctgactgggtacctggagtatttgattaagcataactacgggaaagataaggcggctaccaaaaaaccagtggtcaatatcatcaccccttcccacgtcgaagagcgcggatgtcagctgacgatcaccttctcggtgcccaacaaggatgtgtttcaagaactggaaaaacgcggagtggtatgcgataagaggaacccgaacggaatcagagtcgcgcctgtgccgctctacaacagtttccatgacgtctacaaattcaccaatctgctgacttccattctggatagcgcggagacgaaaaac

SEQ ID NO: 31808 - DNA, 1395 bp, Artificial Sequence
  Description of Artificial Sequence: Synthetic coding sequence
atggagccatcaagccttgagctcccagcagacaccgtgcagcggatcgccgcggaactcaaatgtcatccgactgacgaacgtgtggccttgcaccttgacgaggaagataaacttcgccatttccgggagtgtttttacatacctaagattcaagatctcccacccgtcgacctgtcactggttaacaaagatgagaacgcaatctactttcttggaaacagccttggcctccaacctaagatggtaaaaacttatctcgaggaagaacttgacaagtgggccaaaattgccgcttacgggcacgaagtgggtaagaggccatggattactggtgatgaatccattgtgggtcttatgaaggacatagtgggggccaatgagaaagaaattgcgctgatgaacgcacttacggtgaaccttcatcttctcatgcttagctttttcaagccaactccaaaaagatataagattctccttgaagcgaaggcctttccttccgatcattacgcgattgaatcgcaacttcagcttcatggactgaatatagaggagtcgatgcggatgattaagcctcgcgaaggagaggaaaccctgcgaattgaggacattctggaagtgattgagaaagaaggtgatagcatagccgtcattcttttttcgggtgtgcatttctacaccggccaacatttcaatataccagctattactaaagcaggacaagcaaaaggatgttacgtgggattcgatttggctcatgcagtcggtaatgtcgaactctatttgcatgattggggggttgattttgcgtgctggtgctcgtataagtaccttaatgcaggcgctggtggaatcgcaggggcattcattcacgagaagcacgcgcataccatcaaacctgcgctcgtcggatggtttgggcatgagctttccaccagattcaagatggataacaagctccagcttatccccggagtctgtggtttcagaatctcaaaccctcctatccttctggtgtgttcacttcatgcatcgctcgagatctttaaacaagcgaccatgaaggcacttcgtaaaaagtccgtgcttcttaccggctacctggaataccttatcaagcataactacggcaaggataaagctgcaactaagaagccagtggtcaacatcattactccttcacatgtcgaagaaagaggatgtcagctcaccatcactttctccgtgccaaacaaggacgtgtttcaggagctcgaaaagaggggagttgtgtgcgacaagaggaatcctaacggaattcgggttgcacctgtgcccttgtacaacagctttcatgatgtgtacaaattcaccaatctcctgacttccattctggatagcgcagaaacgaagaat

SEQ ID NO: 31809 - DNA, 1395 bp, Artificial Sequence
  Description of Artificial Sequence: Synthetic coding sequence
atggagccaagctcactggagctaccagccgacacagtacaacgaatcgctgctgaactgaaatgccaccccacagacgaaagggtggcactgcatctggatgaggaagataagctccgacactttcgtgaatgtttttatataccaaagatacaggatttacccccagttgacttgagtctggttaataaggacgaaaacgcaatctattttttaggcaacagcttagggctgcagccaaagatggtcaaaacctacctggaagaagagctggataaatgggccaagatcgcagcatatggacatgaggtggggaaaaggccttggattacaggcgatgaaagcatagttggtctgatgaaagacatagtgggcgccaatgagaaggagatcgccctgatgaatgctctgaccgtgaatctgcatctactgatgctatcttttttcaaacccacccctaagcgctataagatcctgctggaggcaaaagcattcccctctgatcattatgctatagagagtcagctccagttacatggcctcaacatagaggagtcaatgagaatgataaagccccgagagggcgaagagacactgcggatcgaggatatactggaggtgatcgaaaaggagggcgattccatcgcagtaatcttattcagcggagtgcatttttacaccggacagcactttaacatccccgccatcacaaaagctgggcaggccaagggatgctacgtgggctttgacttggcccacgccgtaggcaatgttgagctgtacctgcatgattggggcgtggatttcgcctgctggtgttcttataagtacctcaacgccggcgctggcgggatagccggcgctttcatccacgaaaaacatgcacataccataaagcccgcccttgtggggtggtttgggcacgaactgagtacccggttcaaaatggacaacaaactacagctgattccgggcgtttgtggttttagaataagcaacccacccatattactggtatgttctctccatgcctctctggaaatattcaagcaagccaccatgaaagctctgcgcaaaaaaagcgtgctattaacaggctaccttgagtatctgatcaaacacaattatgggaaagacaaggccgccaccaagaagccagtcgtgaacatcataactcctagccacgtggaagaaagggggtgccagctcacaatcactttttctgtgccaaataaagatgtgttccaagaactcgaaaaacggggcgttgtgtgtgacaaacggaatcccaatggcattcgtgttgctccagtccccctgtataacagttttcacgacgtgtacaaattcaccaacctactaacctcaatactggacagcgccgagacaaaaaac

SEQ ID NO: 31810 - DNA, 1395 bp, Artificial Sequence
  Description of Artificial Sequence: Synthetic coding sequence
atggaaccgagctccctggagttgcccgccgacacagtgcagcgaatcgctgcggagctgaagtgccatccgaccgatgagcgagtggcactccacctggatgaagaagacaaattgcgtcacttcagggagtgtttttacataccgaagatccaggatctcccgcctgtggatctgtctctggtaaataaggatgaaaatgccatctactttctgggtaacagcctgggattacaaccaaagatggtcaagacttacttggaggaggaactcgataagtgggctaagattgctgcttacggtcacgaggtgggcaagcgaccgtggatcacgggtgacgagagtatcgttggcctgatgaaggacatcgtgggcgccaacgagaaagagatcgccctgatgaatgccctgactgtgaatcttcacttgttgatgctgagcttctttaagccaacgcctaagcgctataagattctattagaagcgaaggcgtttccatcggatcactacgcaatcgagtcccagctacaactgcacggtctgaacatcgaagaatcaatgcgtatgattaagccccgagagggcgaggagacactccgaattgaggatatattggaggtaatagaaaaagaaggcgattccattgccgtgattctgttctcgggcgtgcacttttataccggccaacatttcaatatcccggcaataactaaggcaggacaagccaagggttgctacgtgggtttcgatctggcccatgcagttggaaacgtcgagctgtatctgcacgattggggtgtagatttcgcttgttggtgttcctataaatatttgaacgccggcgcaggtggcatcgccggagccttcattcatgagaagcacgcccacaccatcaagccggccttggtgggctggttcggtcatgagctgagcacccgcttcaagatggataataaactacagctaataccaggagtttgcggctttcgcatatcgaatccgcccattttgctggtgtgcagcctgcatgcttccttagagatctttaagcaggcaaccatgaaggctcttcgtaaaaagtctgtactcttaactggctacctcgaatatttgatcaagcacaattatggcaaggataaggcggcgaccaagaagccagttgtgaacatcatcacccccagtcacgttgaggagagaggatgccagttgacaattaccttcagcgtccccaacaaggacgttttccaggaactggaaaagcgcggagtggtgtgcgataagcgtaaccccaatggtattcgcgtggccccggtaccgctgtacaactcgtttcacgatgtgtataagttcacgaatctgctcacttcgatcctggactccgctgagacaaaaaac

SEQ ID NO: 31811 - DNA, 1395 bp, Artificial Sequence
  Description of Artificial Sequence: Synthetic coding sequence
atggaaccctcgagcctggaactgccagcagacaccgtccaacgcatcgctgctgaactgaagtgccatccgactgacgaacgcgtggcgctccacctcgatgaggaggataaactccggcacttccgcgagtgtttctacatcccgaagattcaggacctgccaccggtcgacctctctctggtgaataaagacgagaacgccatttacttcctgggaaactcgctgggcctccagccgaagatggtcaagacctacctggaggaagagttggacaagtgggctaaaatcgccgcgtacggacatgaggttggcaagcgcccgtggatcaccggagacgagtcaattgtcgggctgatgaaggatatcgtgggagctaatgaaaaagaaatcgccttgatgaacgctctgaccgtgaacctccatctgttgatgctgtcattctttaagccaactcctaagcgctacaagatcttgcttgaagcgaaggccttcccatcagaccattacgctatcgaaagccaactccagctccacggtcttaacatcgaagaatcgatgcggatgatcaaaccgagagaaggagaggaaacccttaggatcgaggacatcctcgaagtgatcgaaaaggaaggagactccatcgccgtgatcctgttttccggggtgcacttctacaccggccagcacttcaacatccctgccattactaaagcgggccaggcaaagggatgctatgtgggcttcgacctcgctcatgcagtcggaaatgtggagctgtacttgcatgattggggagtggactttgcttgctggtgttcgtacaaatacctgaacgccggggctggcgggatcgcaggagcctttatccacgaaaagcacgcgcacaccatcaagcctgcactggtggggtggttcggccacgaactgtccacgcgctttaagatggacaacaaactccaactcattccaggagtctgcggcttcaggatctccaaccctccaatcttgctggtgtgctccctccatgctagcctggaaatctttaagcaggcaactatgaaggctttgaggaagaaatccgtgctgttgacgggctatctggagtacctgatcaagcataactacggaaaagacaaggcggccactaaaaagccggtggtcaacatcatcactccgagccacgtcgaagagcggggttgccaattgacgatcacctttagcgtcccgaacaaggatgtctttcaggaattggaaaagcgcggagtcgtgtgtgacaagaggaatccgaatggaattagagtcgccccagtgccattgtacaactccttccatgatgtgtacaagtttactaatctgttgacttcaattctggactccgcggagacgaagaac

SEQ ID NO: 31812 - DNA, 1395 bp, Artificial Sequence
  Description of Artificial Sequence: Synthetic coding sequence
atggaaccttcgtcacttgagttgccggccgacactgtgcagcggatcgcagcggagctgaaatgccatccgaccgacgagcgtgtggctctgcacctggacgaagaagataagttgagacacttccgcgaatgcttctacatcccaaagatccaggacctgccgccggtagacctttcactcgtgaacaaggatgaaaatgctatctacttcctcggcaattcattgggcctgcagccaaagatggtcaagacttatctggaggaggaactcgacaagtgggccaaaatcgcagcgtacgggcacgaggttggaaaacgcccgtggatcactggagatgaatcgatcgtggggcttatgaaggatatcgtcggtgccaacgaaaaagaaattgccctcatgaatgctctcaccgtcaacctgcacctgctgatgctctccttcttcaagccgacgccaaagcggtataagattctgctcgaggccaaggcttttccctcggaccattacgcaatcgagagccaattgcagctccacggccttaacattgaggagagcatgagaatgatcaagccgagggaaggcgaagaaacgctgcggatcgaggacatcctggaagtcatcgagaaggaaggagactcgattgcggtgattctgttctccggagtgcatttctacactggacaacatttcaacatccccgcaatcactaaagcaggacaggccaagggatgctacgtgggcttcgacctggcacatgccgtcggtaacgtggaactctatctccatgactggggagtggattttgcgtgctggtgctcatacaagtacctgaacgcgggagccggagggatcgcgggtgcttttatccacgaaaaacacgcccacaccatcaagcctgctctggtgggctggttcggacacgaactcagcacccgcttcaagatggacaataagctgcagctcatcccgggcgtctgcggtttccggatctccaatcctccaatccttctcgtgtgcagccttcatgcgtccctggagatcttcaaacaagcgactatgaaggcactccggaagaagagcgtgctgctgactggatacctcgaatacctgatcaaacacaactacggaaaagacaaggccgctaccaagaagccagtggtgaacattatcaccccaagccacgtcgaggagcgcggctgccagctcactattacttttagcgtgccgaataaggacgtgtttcaggagctcgaaaagcgcggggtggtctgcgataagcggaatccgaatggaatccgagtcgctccagtgcctctgtacaactccttccacgacgtgtacaagttcactaacctgctgaccagcatcctggattccgcggaaactaagaac

SEQ ID NO: 31813 - DNA, 1395 bp, Artificial Sequence
  Description of Artificial Sequence: Synthetic coding sequence
atggaaccgtccagcctggagctccctgccgataccgtccagcggattgccgcggaacttaaatgccacccgactgacgagcgggtggcccttcacctcgatgaagaagataagctgcggcactttcgggagtgtttctacatcccgaaaattcaggacctgcccccggttgatctctcactggtgaacaaagacgagaatgccatctatttcttgggcaactccctgggactgcaacctaagatggtgaaaacctacctggaggaagagctggacaagtgggcgaagatcgccgcatacggtcatgaggtgggtaagcgcccgtggattaccggagacgaatcaattgtgggattgatgaaggacattgtgggagccaatgagaaagaaatcgcactcatgaacgcactgaccgtgaacctgcatttgctgatgttgtcgttcttcaagcccacgccaaaacggtacaagatcctcctggaagccaaggcctttccctcggatcactacgccattgaatcccaattgcagctccatggactgaatatcgaggagtctatgcggatgatcaagccacgcgaaggagaggagactctgcggattgaagatatcctcgaagtgatcgaaaaggaaggcgacagcatcgcggtcatcctgttctcaggcgtccatttctacaccgggcagcacttcaacattccagctatcactaaagcggggcaggccaaaggatgctacgtcgggtttgacctggcccacgccgtggggaatgtggagctgtacctccacgattggggagtggacttcgcgtgctggtgctcatacaagtacctgaatgcgggcgccggcggtatcgcgggcgccttcatccacgagaaacatgcccacaccatcaaaccggccctggttggttggttcggacacgaactcagcactagattcaagatggacaacaagctgcagttgatccctggagtctgcgggttccggatttcgaatccaccgatcctccttgtctgtagtctgcacgcctcgcttgaaatctttaagcaggccactatgaaggcgctgcgcaaaaagtcagtcctgctcactggatacttggaatacttgattaagcataactatggaaaggataaggcggcgaccaaaaagccggtcgtgaacatcattaccccatcgcatgtcgaggaacgggggtgtcaactgaccattaccttttccgtgccgaacaaggatgtgtttcaagaactcgagaaacgaggagtcgtttgcgacaagcgcaatccaaacgggatccgcgtagctccggtgcctctctacaactcgttccacgacgtgtacaagtttactaacctcctcaccagcattctggattctgccgaaaccaaaaac

SEQ ID NO: 31814 - DNA, 1395 bp, Artificial Sequence
  Description of Artificial Sequence: Synthetic coding sequence
atggagccctcaagcctcgaactgccggcagacaccgtgcaacgcatcgctgcggaactcaagtgtcatccaaccgacgagagagtggccctgcatctggacgaagaggacaagctgaggcacttccgcgaatgtttttacatccccaagatccaggacttgccgccggtggacctgagtctggtgaacaaggacgaaaacgccatctattttctcggaaactcgcttggcctgcagccgaaaatggtcaagacctacctcgaggaagagctcgacaagtgggcaaagatcgcggcatacgggcacgaagtcggaaaaaggccatggatcactggagacgaaagcattgtgggactgatgaaagatatcgtcggcgcgaatgagaaggaaatcgctctgatgaacgcgctgaccgtcaacctgcatctcctgatgctcagcttcttcaagccgaccccgaaacggtacaagatcctgctggaagccaaggcattcccatcagaccactacgcgattgaaagccaactgcaactgcacgggctgaatattgaggaatccatgcggatgatcaagccacgcgaaggagaagaaactctgcgcatcgaggatatactggaggtgatagaaaaggagggagatagcattgccgtgatcctgttctccggcgtccacttctacactggccagcacttcaacatcccggcaatcaccaaggctggccaagcaaagggatgctacgtcggattcgaccttgcacacgccgtgggtaacgttgagctctaccttcatgactggggagtggattttgcctgttggtgcagctacaaatacctgaacgctggtgccggaggaatcgccggtgcttttatccacgagaaacatgcccacaccatcaagccagccctcgtgggttggtttggccacgaactgtcaactcggtttaagatggataacaaactgcagctgatccctggagtgtgcggcttccggatctccaacccaccgattcttctggtgtgcagcctccatgccagcctcgaaatctttaagcaggcgactatgaaggctctccgcaagaaatctgtgctcctcactggatacctcgaatacctgatcaagcataactatggaaaggacaaggcggccactaagaagccggtggtgaacataatcactcctagccacgtggaggagcggggatgtcagctcacgatcaccttctcggtgccgaacaaggatgtctttcaggaactggaaaagcgaggagtcgtgtgcgacaagagaaacccgaatgggatcagggtggcgccggtgcctctgtacaactcattccacgacgtctacaagtttaccaacctgttgacctccatccttgactccgctgagactaagaac

SEQ ID NO: 31815 - DNA, 1395 bp, Artificial Sequence
  Description of Artificial Sequence: Synthetic coding sequence
atggagccgtcatccctggaacttccggccgacaccgtgcagcgcattgcggccgagcttaagtgtcacccaaccgatgagcgggtggcattgcatctggacgaggaggacaagctgagacactttagggagtgcttctatattccaaaaatccaggatctgccccctgtcgacctgagcctggtgaacaaagacgagaacgccatctacttccttggcaactccttaggattgcagcccaaaatggttaagacatatctagaagaagaactggataaatgggccaagattgccgcatatggacatgaagtggggaaaaggccttggatcaccggtgacgagagtatagtaggtttaatgaaggacatcgtcggtgctaatgaaaaggaaatagccctcatgaacgcattgaccgtgaacctacatctgctcatgctgtcctttttcaagccaacgccgaagcggtacaagattctcttagaggcgaaagctttcccttcagaccattacgcaattgaaagccaactacagttgcacggccttaatatagaggaatcgatgagaatgatcaaacctcgcgaaggcgaggaaactctgcggatagaagatatattagaggtcatagagaaggaaggagactccatcgcggtgatcttgtttagcggcgtccatttttatacaggtcagcattttaatattcccgctattacgaaagccggacaagctaagggttgttacgtggggttcgacttggcccacgcagtgggcaacgtcgagttgtacctgcatgactggggcgtggactttgcctgctggtgctcctacaagtatcttaacgccggggctggcggcatcgctggggcgttcatccacgagaaacacgctcatacgattaagcccgcattggtgggctggttcggccacgagctgtccacgaggttcaaaatggacaataaactccagctcattcccggcgtgtgtgggttccgaatttcaaacccgcctatactcttggtctgctcactacatgcgtcgttggagatcttcaagcaagctaccatgaaggctctgcgtaaaaaaagtgtgctcctgaccgggtacctggaatacctcatcaagcacaactacggcaaagataaggcagctacgaaaaagcccgtcgtaaatattatcaccccctcccacgtcgaagagcggggctgccagctcacaataacattctccgtcccaaacaaagatgtgttccaagaactcgagaagcgaggcgtcgtttgcgacaagaggaatccaaacgggatcagggttgcccctgtcccactatacaacagtttccacgatgtttacaagttcacgaacttactgaccagcattctcgactccgccgagactaaaaat

SEQ ID NO: 31816 - DNA, 1395 bp, Artificial Sequence
  Description of Artificial Sequence: Synthetic coding sequence
atggagccgagttccctggaacttcctgcggatactgttcaacgaatcgcagcggagctgaaatgccacccgacagatgaacgggtggccttgcacctggacgaagaggataaactccgccacttcagagagtgcttctatatccctaaaatccaggatttaccgcccgttgatttgtctctggttaataaagacgaaaatgctatttatttcctaggcaactcgttggggctccagcccaagatggtcaagacctatcttgaggaagagttggacaaatgggccaagatcgcggcctacggtcatgaggtgggcaaacggccatggattacaggggatgagtctatcgtgggtcttatgaaagacatcgttggagcgaacgagaaggaaatcgctcttatgaatgcactcaccgtgaacctccacctgctaatgctaagctttttcaaaccaacccccaaacggtataagattctcctggaggctaaggcatttcccagtgatcactacgcaatcgaaagccagctccagctgcacggtctcaacatagaggagtcaatgcgcatgattaagcctcgcgaaggggaagaaaccctgcgtatcgaggatatattggaagtgattgaaaaagagggggattccattgccgtgatcttgttctccggtgtccacttttatacaggccaacattttaacataccagcaatcaccaaagcagggcaggctaaaggatgctatgtgggatttgatctggcacacgccgtcgggaacgtcgagctgtacctgcacgactggggcgtggacttcgcctgctggtgctcgtataagtaccttaacgctggtgccggtggaattgccggggcctttattcacgagaaacacgctcacaccattaagcccgcactcgtggggtggttcggccacgaactcagtactcgtttcaaaatggataataaactccaattaatcccaggcgtatgtggctttcgcatatccaatccaccaatattgttagtgtgttccttgcacgccagcctggaaatcttcaaacaggccacgatgaaggccctgcggaaaaagtccgtcttgttaactgggtacctcgagtacctcatcaagcataactatggcaaggataaggctgctaccaagaaaccagtggttaacatcattacacctagccatgtcgaggaacggggatgtcagctgacaatcactttttctgtgcctaataaggacgtctttcaggagcttgagaaacgtggagtcgtgtgtgacaaacggaatccaaatggtataagagtggcccctgttcccctgtacaattctttccacgatgtttacaagtttacaaacttactgacttctatcctcgattcagctgagaccaagaat

SEQ ID NO: 31817 - DNA, 1395 bp, Artificial Sequence
  Description of Artificial Sequence: Synthetic coding sequence
atggaaccgtctagcttggagctgccggccgacacagtgcaaaggattgccgcagaactgaagtgccaccctacggatgaacgagttgcgctgcacctcgacgaggaagacaagcttcgccacttccgtgagtgcttttatatcccgaagattcaggatttacctccggtggatctttcgctggtgaacaaagacgagaatgccatttatttcctgggtaatagcctggggttgcagcctaagatggtcaagacgtacttggaagaggagttggataaatgggctaagattgctgcttatggtcacgaagtgggcaaacgaccctggatcaccggagatgaaagcatcgtgggtcttatgaaagacattgttggagcgaacgagaaagagattgcactgatgaacgccctgaccgtgaatctgcacctgctcatgttatcctttttcaaacctacccctaaacgatacaaaatactgctagaggctaaagctttcccgagcgaccattatgccatcgagtcgcaattacagctgcatggccttaacatcgaggagtccatgcgcatgattaaaccgcgagaaggtgaggaaaccctgcggatcgaggacatcctggaggtgatcgagaaagaaggggactccatagcagtcattctcttcagcggggttcacttttatacgggtcagcatttcaacattccagccatcacgaaagcaggccaagctaagggttgctatgtgggttttgatctggcacacgccgtgggcaacgttgagctgtaccttcatgattggggagtggactttgcatgctggtgctcctataaatatctgaatgccggagccgggggcatcgctggtgcctttatccatgaaaagcatgcacacaccatcaagcctgctttagttggctggtttgggcatgaactgtctacccggttcaaaatggataacaagctgcagctgatcccgggtgtgtgcggtttccggatttccaatccgcctattctgctggtttgctccctgcacgcaagcctcgagatcttcaagcaggcaaccatgaaggcgctgcgcaagaagagcgtcctcctgaccggttatctggagtatctgattaagcacaattacggtaaagataaggctgctaccaagaaaccggtcgttaacatcattactccttctcacgtggaagagcgaggttgccagctgacgattacctttagcgtaccgaacaaagacgtgtttcaggagctggagaaacgcggtgtggtttgtgacaagaggaacccaaacggaattcgcgtggcgcctgtgcctctgtataacagcttccacgatgtgtataaattcaccaatctgttgaccagcattctggattctgcggaaaccaaaaac

SEQ ID NO: 31818 - DNA, 1395 bp, Artificial Sequence
  Description of Artificial Sequence: Synthetic coding sequence
atggaaccctcatctcttgagcttccggccgacacggtgcagcggatcgccgcagaacttaagtgccaccctacagatgaaagagttgcccttcacttagatgaagaagataaactgagacacttccgagaatgtttttacataccgaaaatacaagacctaccacccgtagatctgagcctagtcaataaggatgagaacgctatctacttccttggcaattctctggggttgcagcccaagatggtgaaaacatatctcgaagaagagctcgataaatgggcgaagatcgcggcctacggacacgaggtgggcaagaggccatggataaccggagacgagtcaattgttggcctgatgaaggatattgtgggcgcgaatgagaaggaaattgccctaatgaatgcgctaacggttaatctgcacctactcatgctatcgttctttaagcccacacccaaacgttacaaaatccttctcgaggccaaagcatttccgtccgaccactatgccattgagagtcagctgcagctacacggtttaaacatcgaggagagcatgagaatgataaaaccaagagaaggagaggagaccctacggatcgaagacatactggaggtgatagaaaaggaaggcgattcaatcgctgttatcctgttctccggagtgcacttttacactgggcagcatttcaatatccctgcaattaccaaggcaggtcaggctaaaggatgctacgtgggttttgacctcgcccacgcagtcgggaatgtggagctctacctccacgattggggtgtcgattttgcttgctggtgtagctataaatacctcaatgcgggggccggaggcatcgcaggagctttcatccatgaaaagcacgcgcacaccattaagcccgcattagtggggtggtttggacatgaattgtcaaccagattcaagatggataacaagcttcagctcataccaggtgtgtgtggattccgaatctctaatcctccaatattactggtgtgctctctccatgccagtctcgaaatattcaagcaggccacaatgaaagcactgcggaagaaaagtgttcttttgacgggttatctcgaatatctgattaaacacaattacggcaaggataaagcagcgacaaaaaaacccgtggtaaacatcatcacccccagccacgtggaagaaagaggatgccagctcactataacattcagcgtacccaacaaggacgtgttccaggaacttgaaaaaagaggcgtggtatgtgataaaagaaatcccaacggaatcagggttgccccggtcccgctatataactcgtttcatgatgtgtacaagttcacaaatctcctgacgagcattctggattctgccgaaactaagaac

SEQ ID NO: 31819 - DNA, 1395 bp, Artificial Sequence
  Description of Artificial Sequence: Synthetic coding sequence
atggaaccgtcaagcttagaacttccggcagatacagtccaaagaatcgccgcggaacttaaatgtcatcctacagatgagcgagtggcgcttcacttggatgaagaagacaagcttcgacactttagagaatgcttttacatcccgaaaattcaagatcttccgccggtggatttgtcattagttaataaagatgaaaatgcgatctatttcctggggaattctctgggtctgcagccgaagatggttaagacatacttggaagaggaactcgataagtgggcgaaaattgcagcgtacgggcatgaagtgggcaagagaccatggatcacgggagacgagtccattgtaggattgatgaaagatattgtcggagcgaacgagaaagaaatcgcacttatgaacgcccttacagtaaatcttcacttactcatgttgagcttttttaaaccgactccgaaacgttataagatattgctcgaagcaaaggcatttccatcggatcattatgctatagagagccagttacagttgcatggactcaatatcgaagaaagtatgcgcatgataaagccccgcgagggagaggaaactttacgaatcgaagatattttagaagtgattgagaaagaaggcgactctattgcggtaatcttgttttctggcgtacatttttatacggggcagcatttcaacattcctgccataacaaaagcgggacaagcgaaagggtgctatgtgggatttgatctggcgcatgcagtcggcaacgtagaactgtacctgcatgactggggtgttgactttgcttgttggtgctcatacaaatatttaaacgctggagctggcggtattgcgggcgcttttatccacgagaaacatgctcatactattaaacccgcattggtaggctggtttgggcatgaactgagtacacgctttaagatggacaacaaactccagttgatcccaggcgtttgcggctttcgaattagtaatccccctatcttattggtctgttccttacatgcgtcattagaaatttttaaacaggcgactatgaaagcgctgcgcaaaaaatcggttctgcttacaggttaccttgagtacttaattaaacacaactatggcaaagataaagcagctacgaaaaaaccggttgtgaatatcatcaccccttcccacgtcgaggaacgaggatgtcagttaacgattacgtttagcgttccgaacaaagacgtgtttcaggagcttgaaaagaggggggtcgtctgtgataagagaaatccgaatggtattagagttgcaccagtgccactttataactcgttccatgatgtgtacaaattcacgaatctgctcacatcaattcttgattcagcagagacaaaaaat

SEQ ID NO: 31820 - DNA, 1395 bp, Artificial Sequence
  Description of Artificial Sequence: Synthetic coding sequence
atggaaccgtcgtcccttgagctgcctgcagacactgtgcaacggattgctgctgaactgaagtgtcatcctactgacgagcgcgtggcgcttcacctggacgaagaggataaacttcgtcacttcagagaatgtttttacattcctaaaatccaggatcttccccccgtcgaccttagcctggtgaacaaggacgaaaatgccatctacttcctcggcaattcgcttggacttcagcctaaaatggtcaagacctaccttgaggaggaactggataagtgggccaaaattgcggcttatggccacgaggtgggcaaacgcccgtggattaccggggatgaatctatcgtgggtttgatgaaggatatcgtgggagcaaacgaaaaggaaatagccttgatgaatgcactcactgtaaacctccatttgttgatgctgtcgttctttaagcccaccccaaaacgttacaaaatacttctggaagcaaaggcatttccaagcgaccattacgcaatcgagtctcaacttcaactgcatgggctgaatattgaggaatcgatgcgaatgataaagcctagggagggagaagaaacgcttcggatcgaggatatccttgaggtgatcgagaaggaaggggactcaatagctgtgattctcttttcgggcgtgcatttctacacgggacaacatttcaacatccctgcaattaccaaggcgggccaagcaaagggttgttacgtgggctttgacctcgcccatgccgttggaaacgtcgaactgtaccttcacgattggggtgtcgattttgcatgttggtgtagctataagtacctcaatgcaggtgccggaggcattgcaggggctttcatccacgaaaagcacgcccatactataaagccagcactggttggttggtttggacatgaactttctactcggttcaagatggataacaaacttcagctgattccaggagtctgcggttttagaatttccaaccccccaatcctgctcgtatgctcactgcatgcctcccttgagatattcaagcaagctaccatgaaggcattgagaaagaaatcagtactgctcacgggatacctggagtacctgattaagcacaactacggaaaagataaagcagcaaccaagaaaccagtggtgaacatcattaccccgtcgcatgtggaggaaagaggatgccagcttactattaccttttcagtccctaacaaggatgtgtttcaggaactcgaaaagcgtggcgtggtctgtgacaagcgcaaccccaatggcattcgcgtggcacctgtccctctgtacaattcctttcacgatgtgtataagtttaccaatcttcttacctcaattctggattcggcggagactaagaac

SEQ ID NO: 31821 - DNA, 1395 bp, Artificial Sequence
  Description of Artificial Sequence: Synthetic coding sequence
atggaaccgtcctcccttgagctgccagctgacaccgttcaaagaattgctgcagagctgaagtgccaccccacagatgaacgggtagcactgcacctggatgaagaagataagcttagacattttcgggaatgtttttacatacctaagatccaagacctgccgccagtcgacctgtcactggtcaataaggatgaaaatgcaatctattttctgggaaactccctcgggctccagcctaaaatggtaaaaacgtacctcgaggaagagctagataagtgggctaagattgctgcctacggccacgaggtgggcaaacggccatggattaccggggatgagagcatagtgggcctgatgaaggacattgtgggagcaaacgaaaaggagattgccctgatgaacgcgcttaccgtgaatttgcatttgttgatgttgtcatttttcaagcccactcccaagcgctataagatcctgctcgaggctaaggctttccctagcgaccactacgccatcgaatcgcagctgcaactccatgggctcaacatagaagaaagcatgcgaatgattaagcccagggagggcgaagagacgctaagaatcgaggatattcttgaagttattgaaaaggaaggcgacagcatcgctgtgatcctcttcagtggggtgcacttctacaccggccagcactttaatatccctgcgattacaaaggctgggcaagccaagggctgttatgtgggtttcgaccttgcccacgccgtcggcaatgtggagctgtacctccacgattggggagtcgatttcgcttgctggtgtagctataagtacctgaatgcgggcgctggcggcatcgccggcgctttcatacacgagaagcatgcccataccatcaagccagctctggtggggtggtttggccatgaattatccacacgcttcaagatggacaataagctgcagctcattcctggagtgtgtggattcaggatatccaatccccctatccttttggtgtgttccctccatgcatcgctcgagattttcaagcaggcaactatgaaggcactccggaaaaagtccgttctgctgacaggatatctcgagtaccttattaagcacaactatggcaaggacaaggccgccacaaaaaagccagtggtcaacattatcacccctagtcatgtcgaagagagagggtgccagctcactatcaccttttcagtgcccaacaaggatgtcttccaggagctggagaaacgcggcgtggtctgcgataagaggaaccctaacggaattcgcgtcgcaccggtgcctctgtacaattcatttcacgatgtctataaattcacgaatctgctgacatccattctcgacagcgctgaaacaaagaac

SEQ ID NO: 31822 - DNA, 1395 bp, Artificial Sequence
  Description of Artificial Sequence: Synthetic coding sequence
atggaaccttcttcattggaactccctgctgacactgtgcaaagaatagctgctgaactcaagtgtcatcctacggatgaacgcgtggcgctgcatctggatgaggaggacaagttgagacacttcagagaatgcttctacattccaaagattcaggacttgccaccagtggatctgtcgcttgtgaacaaagacgagaacgcaatttactttttggggaatagccttggcctgcaaccaaagatggtgaaaacgtaccttgaggaagagcttgacaagtgggccaaaatagccgcatacggccatgaagtcgggaaaagaccctggattactggtgatgagtcaattgtgggactcatgaaagatatagtgggtgcaaacgaaaaggaaattgcgctgatgaatgccttgaccgtcaatctccacctgctgatgctgtcgttctttaaaccgacccccaagagatacaaaatacttctggaagcgaaggcattccccagcgatcactacgcaattgagtcgcagctccaacttcatggtcttaacatagaggagtcgatgagaatgatcaaacccagggagggagaggaaaccctgcgaattgaagatattctggaggtcattgaaaaggagggtgactccatcgcagtgattttgttttccggggtccatttctacaccgggcagcatttcaatattccagcaattaccaaggcaggccaggcaaagggatgctatgtgggatttgatctcgcacatgcagtgggtaacgtggagttgtacttgcacgactggggcgtcgatttcgcatgctggtgttcctacaaatatcttaatgcaggggcaggtgggatcgccggagcgtttatccatgaaaagcatgcacacactattaagcctgcactggtgggatggtttggacatgaactgagcacccggtttaagatggacaataaactccagctgatccctggggtgtgtggttttagaatttcgaacccaccgatcttgctcgtgtgttcacttcacgcctccctggagattttcaagcaagccaccatgaaggccctccggaagaaatccgtgcttctcaccggataccttgagtacctcataaagcacaattatggaaaggataaggcagccacgaagaagccagtggtaaacatcataacgccgtcacacgtcgaagagcggggatgtcagcttacgatcactttttcggtgccgaacaaggatgtctttcaggagcttgaaaagcgaggtgtggtgtgcgataagcgtaatcctaacggaatccgggtggctcctgtgcctctgtacaattcgtttcatgatgtctacaagtttaccaaccttctcacttcaattttggactcagcagaaaccaagaac

SEQ ID NO: 31823 - DNA, 1395 bp, Artificial Sequence
  Description of Artificial Sequence: Synthetic coding sequence
atggagccatcctcgctggaacttcctgcggacaccgtgcagcgcatcgccgcggaacttaagtgtcatccgaccgacgagagagtggcgctccatcttgacgaagaagataagctccggcattttagggaatgcttctacattcctaagatccaggaccttccaccagtcgatttgtcgctggtgaataaggacgaaaacgcgatttactttcttggaaactcccttggactgcaaccaaagatggtcaaaacttacctcgaagaagaacttgacaagtgggcaaagatagcagcatacggacatgaggttggtaagaggccatggattaccggagatgagtctatcgtgggccttatgaaggatattgttggtgccaacgaaaaagaaatcgctctcatgaacgcacttactgtgaatctgcaccttctgatgttgtcgtttttcaaaccgacccctaagcggtacaagatcctgttggaagcaaaggcgtttccatctgatcattacgcaattgaatctcaactgcagctccacggtcttaacatcgaagaaagcatgagaatgatcaagccaagagagggcgaggaaacccttcggatagaagatattctggaagtgattgaaaaagagggtgattctatcgctgtcatactgttttcaggagtccatttctacactggacagcactttaacattccagcgatcaccaaagcaggacaagcaaagggttgctacgtgggatttgaccttgcccacgcagtcggtaacgtggagctgtacctgcatgactggggggtcgattttgcctgttggtgttcctataagtacctgaacgcaggggcaggcggcatagccggagcattcatacacgagaaacacgcccatactataaagccagcacttgtcggatggtttggacatgaactgagcactcgcttcaagatggataacaaactccagcttattcccggagtgtgcggcttccgcatttcaaatcctccaatccttttggtgtgtagcctccatgcatcgcttgaaatctttaagcaggcaactatgaaggcactgcgcaagaaatcggtgctgctcaccggctacctggagtacctgattaagcacaattacggcaaggataaggcagccactaaaaagcccgtggtgaacataatcactccttcgcatgtggaagaacggggctgtcaactgaccatcactttctcagtgcctaacaaagatgtgtttcaagagctggaaaagagaggggtggtgtgtgataagaggaaccctaatggcattcgtgtggcgcctgtgccgctgtacaattcattccatgatgtttacaagtttactaacttgctgacttcgatccttgattcggcagagacgaagaac

SEQ ID NO: 31824 - DNA, 1395 bp, Artificial Sequence
  Description of Artificial Sequence: Synthetic coding sequence
atggaaccgtcgagtttggaattgcctgcagacacagtgcaacgtatagcagctgagctcaagtgtcatccgacggatgagcgtgttgcactgcacctagatgaagaggacaagctcagacattttagagagtgtttctatattccaaagatccaagatttgccacccgtagatctttctctagtaaacaaggacgaaaacgcaatatatttcctcggaaattctcttggactgcaaccaaagatggttaaaacctaccttgaagaggagctcgataagtgggcaaagattgcagcgtatggccacgaagttggtaaacgtccttggattacaggagacgagtcaatagttggattgatgaaggatattgttggagctaacgaaaaagaaatcgctctaatgaatgccttaactgttaacctccatttgcttatgctttccttctttaagccaactccaaaaaggtacaagatccttctcgaggctaaggcttttccatcggatcactacgcgatcgaaagccagttacagctgcacggacttaatattgaggagtcaatgcggatgattaagccaagagaaggagaagaaactttacgtatcgaggatattcttgaagttattgagaaggagggcgactcaatcgctgtaatcctattctcaggtgtccacttctatacgggacaacactttaacataccagctataacaaaagctggacaagcgaaaggatgttacgtcggattcgatcttgcacatgctgtcggaaacgttgaactctacctccatgattggggagtagactttgcttgctggtgtagttataaatatttgaatgccggtgcaggaggcatagctggagcttttatacatgagaagcacgcgcacacaatcaaaccggcgttagtgggttggttcggtcatgagctgtcgaccagatttaagatggataacaagcttcagctgataccaggagtctgcggttttcggatcagtaacccaccgatactgctagtctgttcacttcatgcttctctggaaatcttcaagcaggccaccatgaaggcattacgaaaaaaatcagttcttttaaccggttacctcgaatatcttatcaaacataattacggtaaagacaaggcagcaactaagaagccagttgtgaacattatcactccatcacacgtagaagagcgcggatgtcaactaaccattacgttctcagttccgaacaaggacgtttttcaggaacttgaaaaaagaggagtagtatgtgataaacgaaaccccaatggaattcgagtagcccccgttccattatacaattcattccacgacgtctataaattcaccaatcttctaacttcaattctcgactcagccgagacaaaaaat

SEQ ID NO: 31825 - DNA, 1395 bp, Artificial Sequence
  Description of Artificial Sequence: Synthetic coding sequence
atggaaccatcgtccctggaactccccgccgatactgtgcaaaggatcgcggccgagcttaagtgccaccccacggacgagcgtgtcgctttgcatctggacgaagaggacaagctgcggcacttccgcgagtgcttctacatcccgaagatccaggatcttccaccagtggacctcagtctcgtgaataaggacgagaatgccatttactttctgggcaattcgttgggactgcagccgaagatggtcaagacctacctggaagaggagctggacaaatgggccaaaatcgccgcatacggacatgaagtgggaaaacgcccatggatcactggagacgaatccatcgtcggactgatgaaggacatcgtcggagccaacgaaaaggaaatagccctgatgaacgcgctgactgttaacctgcacttgctcatgctctcctttttcaaaccaacccctaagcggtacaaaatcctgctggaggccaaggcgttcccttctgatcattacgcaatcgagtcacaactccaactgcatggcctgaacatcgaagagtccatgcgcatgatcaagccaagagagggagaggaaacccttcgtatcgaggacatcttggaggtgatcgaaaaagagggagacagcatcgcagtgatcctgttctctggagtgcatttctacacgggacagcacttcaacatcccggccatcacgaaggccggccaggcaaagggatgttacgtgggattcgacctggcccatgcagtggggaatgtggagctttacctccacgattggggagtggacttcgcctgctggtgctcctacaagtacctgaatgcaggtgccggaggaatcgctggggcgttcatccatgaaaaacacgcccacaccatcaagcctgctctggtgggctggttcggccatgaactgtccacccgctttaagatggacaataagctccagctcatcccaggggtctgcggctttcggatctcaaatccgccaatccttctggtgtgcagcctccacgcgtccctggaaatcttcaagcaggccacgatgaaggcgctgcggaaaaagtcagtgctcctgaccggatacctcgagtatctcatcaagcataactacggaaaggacaaggcggctactaaaaagccggtcgtcaatatcatcaccccgtcccacgtggaagaaagagggtgccaactgaccataactttctcggttccgaacaaggatgtctttcaggaattggaaaagcgcggagtcgtctgcgacaaacgcaatccaaacggaattcgggtggccccggtgccgctgtataactcgtttcacgacgtctacaaattcaccaacctgctgacctcgattctcgattcggctgagactaaaaac

SEQ ID NO: 31826 - DNA, 1395 bp, Artificial Sequence
  Description of Artificial Sequence: Synthetic coding sequence
atggagcccagctctctggaactcccagctgataccgtgcagagaattgcagcagaactgaagtgccaccctactgacgagagggtggccctccatctggatgaggaggataaacttagacactttcgcgagtgcttctatatcccaaagatccaagatctgccacccgtagatctgagtttggttaacaaagacgaaaacgcaatctactttcttggcaattcacttggcctgcaacctaagatggtcaagacttacctcgaagaggaacttgacaaatgggcaaaaattgcagcgtacgggcacgaggtggggaaacgcccttggattaccggggatgaaagcatcgtgggattaatgaaagacatcgtaggcgcaaacgagaaggaaattgctcttatgaatgccctcactgttaaccttcacttactgatgctgtcattttttaaacctaccccgaagagatacaagattctgttggaggcaaaagcattccccagcgatcattacgccatcgaatcccagctccaactccacggattgaatatcgaagagagtatgaggatgatcaaaccacgcgagggggaagaaactctcagaatcgaagatattcttgaagtgatcgagaaagagggagatagtattgcagtcatcctcttctcaggcgtccatttctacaccggccagcattttaacatcccagccatcactaaagctggccaggcaaagggttgctacgtcggcttcgaccttgcccacgcggtcggcaatgtcgagctttatctgcacgattggggcgtcgattttgcttgttggtgcagctataagtacttgaatgcgggagcgggagggatagctggcgccttcattcacgagaaacacgctcacacgattaagcccgcattggtcggatggtttggccatgagctgagtacacgtttcaagatggacaacaaactgcagctgattccaggcgtctgtggcttcagaatcagcaaccccccaattctacttgtctgtagcctgcatgcttcattggagatctttaagcaggctacaatgaaggccctccgcaaaaaaagtgtcttgctcaccggctatctggagtacctgatcaagcacaattatggcaaagataaagctgcgacaaagaagcccgtggttaatattattacaccatcccatgtggaggagagaggatgtcagctgaccatcactttctccgtgccgaacaaggatgttttccaggagttggagaagaggggggttgtgtgtgacaagaggaaccctaacggcatcagagtcgcccctgtgcctctgtacaactcttttcacgacgtgtataaattcaccaacttactgacatcaatccttgattccgctgagaccaaaaac

SEQ ID NO: 31827 - DNA, 1395 bp, Artificial Sequence
  Description of Artificial Sequence: Synthetic coding sequence
atggagccaagcagccttgagctccctgcggacactgtgcagcgcatcgccgcggaactgaagtgccacccaaccgatgagcgggtggccctgcatttggatgaagaggataagttgcgccactttagggagtgtttttacatcccaaagatccaggacctgcccccggtggacctcagtctcgtgaacaaagatgaaaacgccatctactttcttgggaacagccttggactgcagccgaagatggtcaagacctaccttgaggaagagctcgacaaatgggccaaaatcgctgcctacggtcatgaagtcggcaagcgaccgtggataaccggagatgaatcgatcgtcggactgatgaaggacatcgtcggtgccaacgagaaggagatcgcgttgatgaacgcgctcactgtgaacctgcatcttctgatgttgagctttttcaagccgactccgaagagatacaaaatcctgttggaagctaaggcattcccaagcgaccattacgcaatcgagtcgcagctccaactgcatggccttaacatcgaggaatcaatgcggatgatcaaacctcgcgaaggtgaggagactctgcggatcgaagatattctggaagttattgagaaggaaggggattcgatagccgtgatcctgttttcaggcgtgcacttttacacgggccaacatttcaatattcccgcgattactaaagccggacaggcgaagggatgctacgtggggttcgacctggcccacgccgtcggcaatgtggagctgtacctgcatgactggggggtggattttgcctgctggtgctcgtataagtacctgaatgccggcgccgggggtatagcaggagcattcatccacgagaaacacgcacacactataaagccggccctggtcggatggttcggacatgagctgtcaacccgcttcaagatggacaataagctccaactgatccctggagtctgcggatttaggatcagcaatcccccgatccttctcgtctgtagcctgcacgcctccttggaaatcttcaagcaggcgaccatgaaagccctgcgcaagaagagcgttctgctgaccggctatctcgaatacctgatcaaacacaactacggaaaggataaggcggctacgaagaagccggtggtcaatatcatcaccccgagccacgtggaagagcgcggctgccagctcacgattactttctccgtgccaaacaaggacgtgttccaagaactcgaaaagcggggagtggtgtgcgacaaaagaaacccgaatgggattcgagtggcacccgtcccactgtacaactcgttccacgacgtgtacaagtttaccaatctgctgacgtcgatccttgactccgccgaaactaaaaac

SEQ ID NO: 31828 - DNA, 1395 bp, Artificial Sequence
  Description of Artificial Sequence: Synthetic coding sequence
atggaaccatcgtctcttgagctgccggccgacactgtccagcgcatcgcggccgaactcaagtgccatccaactgatgagcgcgtggccctgcacctggatgaggaagataaactcagacacttccgggagtgtttctacattcctaagattcaagacctccccccggtcgatctgtcgctggtgaataaagacgaaaacgcgatttacttcctcggaaacagcttgggactgcagcctaagatggtgaaaacctacctggaagaagagctggataaatgggccaaaatcgccgcctatggtcatgaggtgggtaagcggccgtggatcacgggagacgagtcaatcgttggactcatgaaggacattgtgggagcaaatgaaaaggagatcgctctgatgaacgccctgaccgtgaatctccatctcctgatgttgagctttttcaagccgactccgaagcggtacaagatcctcctggaagcaaaggcatttccgagcgaccactacgcgatcgaatcccagctgcagttgcatggacttaatatcgaggagtcaatgcgcatgatcaagccccgagaaggagaagagactctgaggatcgaggacatccttgaagtcatcgaaaaagagggtgactccatcgctgtgatcctgttctcgggagtccacttctacactggccaacattttaacatcccggcgatcaccaaggctgggcaggctaaggggtgctacgtcggattcgacctggcacacgccgtggggaatgttgaactttacctgcacgattggggagtggacttcgcctgctggtgctcgtacaagtacctgaatgccggggcgggcggaattgcaggagctttcatccacgaaaagcatgcgcatactatcaaaccagcactcgtgggctggttcggccacgaactgtccacccgctttaagatggataacaaactgcaactgattccgggtgtgtgtggatttcgcatctccaacccgccaatcctcctcgtgtgttcgctgcatgcgtcactggaaatcttcaaacaggccaccatgaaggccttgagaaaaaagtcggtgctcctcaccgggtacttggaatacctgatcaaacacaactacggcaaggacaaggctgcgactaagaagccggtcgtgaacatcattactccttcccacgtggaggagcggggatgccaactgaccatcacgttttccgtgccaaacaaggatgtgttccaggagctggaaaagcggggcgtcgtgtgcgataaaagaaaccctaatggcataagggtggcacccgtcccactctacaacagcttccacgacgtctataagttcaccaacctgcttaccagcatcctcgactcagccgaaaccaagaac

SEQ ID NO: 31829 - DNA, 1395 bp, Artificial Sequence
  Description of Artificial Sequence: Synthetic coding sequence
atggaacccagttctctggaactgcctgcagatacagtgcagaggatcgctgccgagctgaagtgccatcccaccgacgagagagttgcactccatttggacgaggaggataaactgaggcactttcgggaatgtttctacattcccaagattcaggacctcccccccgtcgacctcagtctggtcaacaaagacgagaacgccatttacttcttggggaacagtctgggactgcagccaaagatggtgaagacatacttggaagaagagttggataagtgggctaaaatcgcagcttacgggcatgaggtcggtaagcgcccctggatcaccggcgacgaaagcatcgtggggctgatgaaggatatagtgggcgcaaatgaaaaggaaattgccctgatgaacgcactgacggtcaatctccatctgctgatgctgtccttttttaaaccaactcccaagcggtataagatcctcctggaggccaaggcctttccaagcgaccactacgccatagaatctcagctccagttgcatggcctcaatatcgaggagtcaatgagaatgattaagcctcgagaaggggaagaaaccttgcgcatagaggacatcctggaggtgattgagaaagagggggattccattgccgtcatcctgttttccggcgtccacttttacacgggacaacattttaacatcccagccatcacaaaggccggacaggcaaaggggtgttacgttggctttgacctggcccatgcggtcggtaacgtagagctgtacctgcatgactggggagtggactttgcctgttggtgctcttacaaatatctcaacgccggagcaggagggatcgcaggagcttttatccatgagaagcacgctcacacaatcaagccggccctcgtaggatggtttgggcatgagctctccacccggtttaaaatggataataagcttcaactcatccctggggtgtgtggctttcgcattagtaaccctcctatcctgttggtatgcagcctccatgcctctctggagatcttcaagcaggcaacgatgaaggccctcagaaaaaaaagcgttttgctcaccgggtatctggagtacttgatcaaacataactatggcaaggacaaggccgccaccaagaaacctgtcgtaaacataataactccctctcatgtagaagaaagaggatgtcaattgaccatcacattttcagtacccaacaaagacgtcttccaggagctggagaagcggggggtcgtgtgcgataaacggaaccccaacggtatcagagtcgcccccgttccactgtacaattcttttcacgacgtttacaagttcacaaatctgctgacaagtatccttgactccgcagaaacaaagaac

SEQ ID NO: 31830 - DNA, 1395 bp, Artificial Sequence
  Description of Artificial Sequence: Synthetic coding sequence
atggagccatcatcactggagctgcccgcagataccgtccagcgcatcgccgcagaactcaaatgtcaccctacagacgagcgagtcgccctgcatctcgatgaagaggataagctaaggcatttccgtgaatgcttctatataccaaaaatccaggatctcccacctgtcgacctgtctctcgttaacaaagatgaaaatgcgatttattttctcggtaatagtcttgggcttcagcctaagatggttaaaacatatcttgaggaagaactggacaagtgggccaagatcgctgcgtatggtcacgaggttggcaaaagaccatggataacgggtgacgagtcaattgttggtttgatgaaggacattgtgggagcgaacgaaaaggagattgccctgatgaacgctttgacggtgaatctgcatctgctgatgcttagcttctttaagcccactcctaaaaggtataagatcctcctggaagcaaaggctttcccctccgaccactatgcaatcgagtctcagctgcaactgcatggacttaatatcgaggagtctatgagaatgattaaaccacgagagggcgaggaaaccctccggattgaagacatcttggaggtcatcgagaaagaaggtgactccatcgccgtgatcctgttcagcggcgtacatttctacacgggacagcacttcaacatccctgcgatcacaaaagccgggcaagcaaaaggatgctatgtgggctttgatctagcccacgcagtcggcaatgtcgagctgtatctccatgattggggagtggatttcgcctgctggtgcagctacaaatacctcaatgctggcgccggcgggattgcgggggcattcattcatgaaaagcacgcccacaccatcaaaccggctctcgtaggctggttcgggcatgagcttagcaccaggtttaagatggacaacaagctacagctgatccctggggtgtgtggctttcgaatctccaatccacctatcctactggtgtgtagcctgcacgccagtctcgagatctttaagcaggccacgatgaaagctttgcggaaaaagtcagtgctcctaactgggtatttagaatacctcatcaagcataattacggcaaggataaggctgctaccaaaaaacccgttgtgaacataattacaccttcacatgtcgaggagagagggtgtcagcttacaattactttttcagttccaaataaggatgtattccaagaactggaaaagaggggagtggtttgcgacaaacggaatcccaacggaattcgcgtagcaccagtgcctctctataactccttccatgacgtgtataaatttactaacctcctgactagtatcttggattccgcggagacaaaaaac

SEQ ID NO: 31831 - DNA, 1395 bp, Artificial Sequence
  Description of Artificial Sequence: Synthetic coding sequence
atggagccgagctccctggagctccctgcagataccgtgcagagaatcgctgcagaacttaagtgtcaccctactgatgagcgcgtggcgctccatctcgacgaagaggacaagctgcggcactttagggaatgtttctacatcccgaagatccaggacctcccgccagtggacttgtcgctcgtcaacaaagatgaaaacgcgatttacttcctggggaacagcctgggactccagccgaagatggtcaagacttatctggaggaggagctcgacaagtgggcgaagatcgccgcatacggtcatgaggtgggaaagcgcccctggatcacgggagacgaatccatcgtgggactgatgaaagatatcgtcggcgcaaacgaaaaggaaatcgcgctgatgaacgcgctcacggtcaatctccacttgctcatgctgtcttttttcaaaccgaccccgaagaggtacaaaatcctgctggaagccaaagcgttcccaagcgaccattatgcaatcgaatcccagctgcagttgcatggactgaatatcgaagagtcgatgcggatgattaaaccaagagaaggagaagaaactctcaggattgaggacatcctcgaggtaatcgagaaagagggcgacagcattgccgtcatcctgttctccggagtgcacttctacaccggccagcactttaacataccggccattaccaaggccgggcaggcaaaaggctgctacgtcgggttcgacctggctcacgccgtcggaaacgtggagctgtatctgcacgactggggggtggatttcgcgtgttggtgctcgtacaaatacctgaacgcaggagcgggaggaatcgcgggcgcgttcattcatgagaaacacgcccataccattaagcccgctctcgtgggatggtttggccacgaactgtccacccgctttaagatggacaacaagctccagctgattccaggtgtgtgcggatttcgcatctccaacccacccatcctgcttgtctgctccctccacgcctcattggaaatctttaagcaagcaaccatgaaagccctgcgaaagaaaagcgtgcttctgaccgggtacctcgaatacctgatcaagcacaattacggaaaggacaaggccgcgaccaagaagcccgtcgtcaacatcatcactccgagccacgtggaggagcgcggatgccagctgactatcaccttttccgtgccgaataaggacgtgtttcaggagctggaaaagcggggcgtggtgtgcgataagcgcaatccgaacggaattcgggtggcgcctgtgccattgtacaattccttccacgatgtctataagttcaccaacttgctcactagcatcctggattccgcagagactaaaaac

SEQ ID NO: 31832 - DNA, 1395 bp, Artificial Sequence
  Description of Artificial Sequence: Synthetic coding sequence
atggagccgtccagcttggagctcccggctgataccgtccagcgtatcgctgcagagctgaagtgccaccccacagatgaaagggtggcactgcaccttgatgaagaagacaagctcagacacttccgtgaatgtttctacatcccaaaaattcaggacctgccaccagtggatctgtctcttgtcaacaaagatgaaaatgcgatctatttcctgggcaacagtctggggttgcagcctaagatggtcaaaacctatcttgaggaagaacttgacaagtgggctaaaatcgccgcatatgggcatgaggtcggcaaacgcccgtggattaccggggatgagagcatcgtggggctgatgaaagatatagtcggtgctaatgaaaaggaaatagcacttatgaacgccttgacagttaatctccatctccttatgctcagcttttttaagcccacccccaaaaggtataaaatcttgctggaggcaaaagccttcccatcagatcactatgcaatagaatcccagttacagctgcatggcctgaatatcgaggaatccatgagaatgatcaagccacgcgagggagaggagaccctgaggattgaggacattctcgaggtgatagagaaggagggcgattctatcgccgtaatcctgttctcaggggttcacttctacaccggacaacactttaatattcccgcgatcacgaaagcgggacaggccaaaggatgctacgtcggcttcgatctggcgcacgccgtcggcaatgtggagctttatttgcacgattggggagtggatttcgcatgctggtgctcatataagtacctgaacgccggcgcgggcggcatcgcaggagccttcattcacgaaaagcacgcccacaccataaaacccgctttggtgggctggttcggacacgaattgagcaccaggtttaagatggacaataagcttcagcttatccccggggtctgtgggtttagaatcagtaatccacccatcctcctcgtgtgctcactccatgccagtctggagattttcaagcaggccacgatgaaggcactgcgcaagaagtccgtcctgttgaccggttatctggaatacctaataaagcacaactacggcaaagataaagctgccaccaagaagcccgtggtgaatatcattactccatctcacgtcgaagaacgcggctgtcagctcacgataacattttctgtccctaataaggatgtgttccaggaattggaaaagcgaggcgtcgtttgtgacaaacggaaccccaatgggatacgggtggctcccgttccattgtacaacagcttccacgacgtgtataagtttacgaatctgctcacttcaatcctggacagcgctgaaaccaagaac

SEQ ID NO: 31833 - DNA, 1395 bp, Artificial Sequence
  Description of Artificial Sequence: Synthetic coding sequence
atggaacctagtagcctggagctcccagccgacaccgttcagcgtatagctgccgaattgaaatgtcatcctacagatgagcgtgttgctctgcaccttgacgaagaggataagctgaggcattttcgggaatgtttctatattcctaagatccaggacctcccaccagtggacctctcactggtgaacaaagatgagaacgcgatctacttcttggggaactcgcttggcctccagcccaagatggtgaagacataccttgaggaggaacttgacaaatgggctaagatagccgcttacgggcacgaagtcgggaaacggccatggattactggtgacgaaagtatcgtggggctcatgaaagacattgtcggcgctaatgaaaaggagatcgcgttgatgaatgccctcacggtgaacctgcatctgttaatgctgagtttttttaaaccaacccctaagagatacaagatactgcttgaggccaaagctttcccctcagatcactatgcaatcgaatcgcaactgcaactccacggcctgaatatcgaggagagcatgcgcatgattaagcctcgggagggcgaagagaccctgagaattgaagacattctcgaggtgatcgagaaagagggtgactccatagccgtgatattattcagtggcgtacacttctacaccggacagcacttcaacatcccggctattaccaaagcaggacaggcaaagggctgctatgtggggtttgacctagcgcatgcagtgggcaatgtggagctctacttgcacgactggggcgtggacttcgcctgttggtgctcgtataagtatctcaacgccggggccgggggtattgcgggggcttttatacatgagaagcacgcccacaccatcaagcctgccctggtgggttggtttggccatgagttatctacccgatttaagatggataacaaactgcagctgattccgggtgtctgcggcttcaggatttcaaacccaccaatactattggtgtgttctttacacgctagcctggagatttttaagcaagcaactatgaaagcccttagaaaaaagtctgtcttgctgacgggatacttggagtatctaatcaaacacaattacggaaaagacaaggcggcaaccaagaaaccggtagtcaatatcatcactccatcccacgtagaagaaaggggttgtcagctaacgatcaccttttctgttccaaataaagatgttttccaggagctagagaaaaggggggttgtctgtgataaaaggaatcctaacggcatccgcgtcgccccagtgcccttatataacagtttccacgatgtttataagttcactaatctactgacttcaatcttggattctgccgaaacgaaaaat

SEQ ID NO: 31834 - DNA, 1395 bp, Artificial Sequence
  Description of Artificial Sequence: Synthetic coding sequence
atggagcccagttctttagaactaccagctgatactgtgcagagaatcgccgcagagttaaaatgtcatccaacggacgaacgggtggctctccacttggacgaggaagacaagctcaggcattttcgggaatgtttctatattcctaagatccaagatttgccaccggtcgacttatcgctcgttaacaaggatgaaaacgccatctacttcctcgggaacagtttaggcctgcagccaaagatggtgaagacttacttagaagaggaactggataaatgggctaagatagcagcctatggtcatgaagtagggaagagaccatggatcaccggggacgagtccatcgtgggcctcatgaaagacattgttggggccaacgagaaggaaatagctctcatgaatgcacttacggtaaacttgcatcttctgatgctctccttctttaagcccactcctaagagatacaagattctgctggaggccaaagccttcccaagcgaccattacgccattgagtcacagcttcagttgcatggactgaatattgaagagtccatgaggatgataaaacctcgagaaggcgaggagactctacggatcgaggatattctggaggtcatcgaaaaagagggagactcaatagccgtgattttgtttagcggggtacacttctacacgggccagcatttcaatatacccgccatcaccaaagccggtcaagccaaggggtgctacgtggggtttgatttggctcacgccgtggggaatgtggaactatacctacacgactggggagtggatttcgcttgttggtgtagttacaagtatctcaacgcaggagctggaggtattgcaggagcctttatccacgagaaacatgctcataccataaaacccgcgctcgtgggctggttcggtcacgagctgtccaccagatttaagatggacaataagctgcagctcatcccgggcgtgtgtgggtttaggatctctaatccacccattcttcttgtttgctccctgcacgcttcacttgagattttcaagcaggcgacaatgaaagcacttcgaaagaagtcagtattactgaccggctatctggaataccttattaagcataattatggaaaggataaggccgcgaccaagaaacccgtggtgaacatcattactccctcccacgtagaggaacggggttgtcagcttacaatcacatttagtgtcccaaataaagatgtattccaagagctcgaaaaacgaggggttgtatgcgacaaaaggaatcctaatggcatccgcgtggctcccgtacctttatataatagttttcacgatgtctacaaattcaccaacctcctgacctcgatcctggactccgcagagactaagaac

SEQ ID NO: 31835 - DNA, 1395 bp, Artificial Sequence
  Description of Artificial Sequence: Synthetic coding sequence
atggagcccagctccctagagctgccagctgacaccgtccagcggatcgccgcagagctgaagtgccacccgactgacgaacgcgtggccttgcacctggacgaagaagataagctcagacatttccgggagtgcttctacattcccaagatccaggacctccccccagttgatctatccctggtgaacaaggatgaaaatgctatatacttcttaggaaattctctggggctgcagcccaaaatggtcaaaacttatctggaggaggaattggataaatgggcaaagatcgccgcctacggacatgaagtagggaagcgaccttggattaccggggatgaaagtatcgtgggtttgatgaaggacatcgtgggagccaacgaaaaagaaatcgccctaatgaacgctctgactgtaaacctacatctgctgatgctttcattttttaagccaacaccaaagcgctacaagatcctgctggaagctaaagccttcccatcagatcattacgccatagagagtcagctgcaactccatggcctcaatattgaagagtcaatgaggatgatcaagccacgagagggggaagagactttgaggatcgaggatattctagaggtgattgaaaaagaaggcgacagtatcgcagtaatactgttttcgggcgtccatttctacacgggccaacatttcaacattcctgccatcacaaaggcgggacaagcaaaggggtgctacgtcggcttcgatctcgcgcatgccgtggggaacgtggaactgtatctccacgactggggggtggacttcgcctgctggtgttcttataagtacttgaatgctggggccgggggaatagctggggcattcattcacgaaaagcacgcacataccatcaagccagcgctggtcgggtggttcggtcatgagcttagcacaagattcaagatggacaacaaactacagctgattccgggagtgtgtgggttccggatctctaatccacctatactgctggtttgttcactgcacgcgagccttgagattttcaaacaggccactatgaaagccctgcgcaaaaaatccgtgctactcacgggctatctcgagtatttgattaagcataactacggaaaagataaggcggccacgaagaaaccagtggttaacattattacgccttcgcacgttgaggagcgaggatgccagttgacaataacattttctgttcctaacaaagacgtgtttcaggaactggaaaaacgcggggtcgtgtgtgacaagcggaatcccaacggtatccgtgttgcaccagtcccactctacaactcctttcacgatgtgtacaagttcaccaatctcctcacatcgatcttagatagcgccgagaccaagaat

SEQ ID NO: 31836 - DNA, 1395 bp, Artificial Sequence
  Description of Artificial Sequence: Synthetic coding sequence
atggaacccagcagccttgagctcccagctgatacagttcagcgtattgccgcggagttgaagtgccacccgacggatgaacgggtcgcccttcacctggatgaagaggacaaattaaggcattttcgagagtgcttttacatacccaagatccaggaccttccacccgtcgatctaagcctggttaacaaggatgaaaatgcaatctattttttaggtaattctcttgggcttcagcctaaaatggtaaaaacatatctagaggaagagctggacaaatgggctaaaatagcagcatacggccacgaagtcggcaaaaggccttggattacgggtgacgaatctattgttggcctcatgaaagacatcgtgggggccaacgaaaaggaaatcgctctaatgaacgcgctgacagtgaatctgcatcttttgatgttgtctttcttcaagcctactccaaaacggtataaaatcctgttagaagcaaaggcttttccgtcagatcattacgcgattgagagccagctgcaactgcacggccttaacattgaagagtcgatgaggatgataaaaccacgcgagggcgaagagacccttaggattgaggacatcctggaagtcatcgaaaaagaaggggatagtattgctgtcatcctgttctcaggggtacacttctacacaggccagcactttaatatcccggcaataaccaaagctgggcaggccaaaggctgttatgtaggttttgacctggctcacgccgtagggaacgtggaactctacctgcacgactggggggtcgattttgcttgttggtgtagctacaaatacctcaatgccggcgccggcggcattgctggggccttcatccatgagaagcatgcacataccataaaacctgcgcttgtaggctggttcgggcatgaattgtcaacacgcttcaagatggacaataagctccagttgatccctggcgtctgcggtttcagaatctctaatccgcccatcctgcttgtatgcagtctgcacgcctctctggaaatctttaagcaggctactatgaaagcacttaggaaaaaatcagttctcctaacaggatacctggaatatctcattaaacacaactacggaaaggataaggctgctactaagaaacctgtggtcaatattatcacgccatctcacgtggaagagcgggggtgtcagctgacaattactttcagcgtgcccaataaagatgtgtttcaggagctggagaagcgaggggtggtttgtgacaagaggaaccccaatggaatacgagtcgctccagtgccactctataactctttccacgatgtatacaaatttaccaatctgctgacaagtattttagattcggccgagacaaaaaat

SEQ ID NO: 31837 - DNA, 1395 bp, Artificial Sequence
  Description of Artificial Sequence: Synthetic coding sequence
atggaaccatcatctctcgaacttcctgccgatacggtgcagcggatcgcagccgaactcaaatgtcatcccacagacgaacgggttgccctacatctagatgaagaggataagctccggcactttagggaatgcttttatatccccaaaattcaggatctacctcccgtggatctttctctggtgaataaggatgaaaatgcaatctactttctaggaaactccttaggacttcagccaaagatggtgaaaacgtacctcgaagaagaactagataaatgggctaagatcgccgcatatgggcatgaggtggggaaaaggccatggattactggagatgaatctatcgtcggactcatgaaagatatagtcggggccaatgaaaaggaaatagctcttatgaatgccctgactgttaatctgcatctgctgatgcttagtttctttaagcctactccaaaacggtataaaatactcctcgaagccaaagccttcccatcagatcattatgccatcgaatctcagttacagcttcacgggctcaatatcgaagaatccatgaggatgatcaaacctagggaaggagaagagacacttagaatagaagatatcctagaggttatagaaaaagaaggggattctatagccgtgattctcttttccggagtgcatttctatacagggcagcatttcaatatacccgccattactaaagccggacaggctaaagggtgttatgtaggatttgacttagcccacgccgtgggaaacgttgaactctatttacatgattggggagtggattttgcttgttggtgttcctacaaatatctaaacgcgggggctggaggaatcgcaggggcatttatccacgaaaaacatgcccacacaataaaacctgctttagttgggtggtttgggcatgaactttctacacgctttaaaatggataataaacttcagctgatccctggagtgtgcgggttccgaatctcaaatcctcctatcttactggtttgttcactccacgcttcacttgaaatattcaagcaggccactatgaaggcactccgaaaaaaatccgtacttcttacaggatacctggaatacctgataaaacataattatgggaaagataaagcagccactaaaaaacctgtcgtgaatatcatcacacccagtcatgtcgaggaaagaggatgccagcttactataacatttagtgtacccaataaggatgtttttcaggaactagaaaaacggggggtggtgtgtgataaacggaatccaaatgggataagggtggctcctgtgcctctctataattctttccatgatgtatacaagttcactaacctactgacatctattttagattcagccgaaacaaagaat

SEQ ID NO: 31838 - DNA, 1395 bp, Artificial Sequence
  Description of Artificial Sequence: Synthetic coding sequence
atggagccgtcgagcttggagctcccggccgacactgtgcagcggatagccgctgaactgaagtgccatcccaccgacgaacgggtggccttgcatcttgatgaagaggacaaactgaggcacttccgtgagtgcttctacatcccgaagattcaggatctcccgccagtggacttgagccttgtgaacaaggacgaaaatgccatttacttcctgggaaactcactggggctgcagccgaagatggtcaagacctacctggaggaggaactcgacaagtgggcaaagatcgctgcttacggccatgaggtgggaaagcgcccctggatcactggtgatgagtcgatcgtgggactgatgaaagatatcgtgggtgccaatgaaaaagagatcgctctgatgaacgcgctgactgtgaacctgcatttgctgatgttgtctttcttcaagccaactccgaaaaggtacaagatcctgctggaggcaaaggcgtttccgtccgaccactacgccattgaatcacaactccagctgcatggactgaacatcgaagaatcaatgagaatgatcaagcctagagagggagaggaaaccctgcgaatcgaggacatcctggaagtgatcgagaaagaaggagactcaatcgccgtgattctgttctctggggtgcacttttacaccggacagcacttcaatatcccagcaatcaccaaagccggacaggcgaaagggtgctatgtgggattcgacctggcccacgccgttggaaatgtggaactgtacctccacgactggggagtggactttgcgtgttggtgcagctacaagtaccttaacgcgggcgccggcggtatcgcaggtgcatttatccatgaaaagcatgcgcacactatcaagcccgcactggtcggctggttcggtcatgaactctccactaggtttaagatggataacaaactccagcttattccaggagtgtgtggatttcggatctccaacccgccaatcttgctcgtgtgctccctgcacgcctccctcgaaatctttaaacaagccactatgaaagccctccggaagaagtccgtgctgctgactggctacctggagtacctgatcaaacacaattacggaaaggacaaggcggccaccaagaaacctgttgtgaacatcatcactccgagtcacgtggaggaaagaggctgccaactgaccatcactttctcagtgccgaacaaagacgtgtttcaggagttggagaagcgaggcgtggtgtgtgataagcgcaatccgaatgggatccgcgtggcgccagtcccactgtacaatagctttcacgacgtgtacaagtttacgaacctgctgacctcgatcctggattcggctgagactaagaac

SEQ ID NO: 31839 - DNA, 1395 bp, Artificial Sequence
  Description of Artificial Sequence: Synthetic coding sequence
atggagcctagcagcctggaattacccgccgataccgttcaaagaatcgcagccgagctcaagtgccaccccactgatgagagagtggccctgcacctagacgaagaggataaactgcggcactttagggagtgtttctatattcccaaaattcaggacctgccaccagtggatctgtcactggtgaacaaggatgaaaatgcaatctattttttggggaattccttagggttgcaaccgaagatggtcaagacatatctcgaggaggaacttgacaaatgggccaagatagcagcatatggccatgaggtgggaaaaagaccttggatcactggcgatgagtcaatcgtaggcctcatgaaggacatcgtgggcgccaatgaaaaggaaatcgcactcatgaacgctctgaccgtgaacttgcatctcctcatgctaagcttctttaagcctaccccaaaaagatataaaatacttctcgaagctaaggcttttccttccgatcactacgcgattgagagccagctgcagctacatgggctgaatatagaagaatccatgcgcatgatcaaaccacgagagggggaagaaacgctcaggatagaagacatcctggaggtgatagaaaaggaaggtgattcgatcgctgtgattttgttcagtggagttcatttttatactggtcagcatttcaatattccagccatcacaaaagccgggcaggccaaagggtgttatgtgggtttcgatctggcccatgcagttggtaacgtggagctgtatcttcacgattggggagtggacttcgcctgctggtgctcttataagtatctcaacgcgggcgctggcgggatcgctggtgcgttcatccacgagaaacatgctcacaccatcaagccggcattggtgggatggtttggccacgaactctctacacgcttcaaaatggacaataaactgcaacttattcccggggtgtgcggtttccgcatttcaaatccacctattctcctcgtgtgcagcttgcacgcctcccttgagattttcaagcaggcgaccatgaaggccttacgcaagaaaagcgtgctcttgaccggttacctggaatacttgataaagcataactatggtaaagacaaggctgccaccaaaaagcctgtggtcaacataatcacgccttctcacgtggaggagcgcggttgtcagctgaccatcacttttagcgtaccaaataaggacgtctttcaggagttggagaagcgtggcgtagtatgtgataaacgaaaccctaacgggatccgagtggcccccgtacccttgtacaattcattccacgatgtgtacaagttcacgaatctgctcactagcattctggattccgcggaaacaaagaat

SEQ ID NO: 31840 - DNA, 1395 bp, Artificial Sequence
  Description of Artificial Sequence: Synthetic coding sequence
atggagcctagtagcctggagcttccagctgacaccgtgcaacgcattgctgctgaattgaagtgtcatcctacggatgaaagagtggctctgcatctcgatgaggaagacaagctccgccattttcgggaatgcttttacatccccaagatccaagaccttccacctgtggacctgtcacttgtaaacaaggatgaaaacgctatttattttctcggaaacagcttggggcttcaacccaaaatggtgaagacatacctggaggaggagctggataaatgggcgaaaattgctgcatacgggcatgaagttggtaaaaggccttggatcactggagatgagtccatagtgggactcatgaaggacattgttggagcaaatgagaaggagattgcactgatgaacgcgctcactgttaacctgcatttgctgatgctctcattctttaaacctacccctaagcggtacaaaattcttctcgaggcaaaagctttccctagcgaccattatgctatcgagtcacagctccagctccacggcttgaacattgaggagagcatgagaatgatcaagccaagagaaggagaagaaacactgcgtattgaagacattctagaggtcatcgaaaaggaaggagactctatcgccgtcatcttattcagcggcgtccatttctacactggtcaacactttaacatcccagctattacaaaggctggccaggcaaagggctgctacgtcggctttgacttggcccacgcagtcggaaacgtggaactttacctccacgattggggagtggatttcgcttgttggtgctcgtacaagtacttaaatgcgggcgccggcgggatcgcaggggcatttatccatgagaaacacgctcacaccattaaaccagctctggtgggttggtttggacacgaactgtccactagatttaaaatggataataagctgcagctgattcctggcgtttgcggatttaggattagtaacccacctattcttttggtgtgcagccttcatgcctcacttgagatcttcaaacaagcaacaatgaaagctctgagaaagaaatctgtactgttaacaggttatttagaatatctcatcaagcataactacggtaaggacaaagctgctactaaaaaaccggtggttaacatcatcacccccagccacgtcgaagaaaggggctgccagctgactattacattttcggtgcctaacaaagatgtgttccaagagctggagaagaggggagtcgtctgtgataagcggaatccgaacggcatcagagtggcccctgtacctttgtataactctttccatgatgtgtacaagtttacaaatctcttgaccagtatcctggattccgcagagaccaagaac

SEQ ID NO: 31841 - DNA, 1395 bp, Artificial Sequence
  Description of Artificial Sequence: Synthetic coding sequence
atggaaccgtccagcctggagcttccggccgacactgtgcaacgcatcgcagcggaactcaagtgccacccaactgacgaacgcgttgcactccacctggatgaagaagataagctgcggcatttcagggagtgcttctatatcccaaagatccaggacctcccaccggtggatcttagccttgtgaataaggatgaaaacgccatctactttcttggaaattcactgggactccagccgaaaatggtgaaaacttatctcgaagaggaattggataagtgggctaaaatcgccgcttacgggcacgaggtgggcaagcgcccctggattacgggagacgagtctatcgtcgggctcatgaaggacatcgtcggtgccaacgaaaaggagatcgctctcatgaacgccctcactgtgaacctccacctgctgatgctgtcatttttcaagccgaccccgaagcgctacaaaatcctgttggaagctaaggcctttccgtccgaccactacgccatcgaatcgcagctgcaactccacggcctcaacatcgaggagtcgatgaggatgatcaagccgagagagggcgaggaaactcttcgcatcgaggacatactggaggttatcgagaaagagggggactcaatcgcggtgatcctgttctctggagtgcacttctacacgggccagcacttcaatatcccagcgattaccaaggccggccaagcgaaaggttgctacgtgggatttgaccttgcccacgccgtgggcaatgtggaactttacctccatgactggggagtggatttcgcgtgctggtgttcgtacaaatacctgaatgctggagctggaggaatcgcaggggcgttcatccacgaaaagcatgcccacaccatcaagccggccctcgtcgggtggtttggacacgagctttcgaccagattcaaaatggacaacaaactgcagctcattcctggagtctgcggatttaggatttcgaatccgccgatcctgctggtctgctcccttcacgcatcacttgagatcttcaagcaggcgactatgaaggcgctccgcaagaaatccgtgctgctgaccggctacctggaatacttgatcaagcataactacggaaaagacaaggccgccactaaaaagcctgtggtcaacatcatcaccccatcgcatgtcgaggaacggggatgccagctgactatcacgttttccgtgccgaataaggacgtctttcaagagctggaaaagcggggtgtggtgtgcgacaagcggaatccgaacggcattcgagtggcccccgttcctctgtacaactcatttcacgatgtgtacaagttcaccaacctgctcacctcgatcctggattcagcagagacgaagaac

SEQ ID NO: 31842 - DNA, 1395 bp, Artificial Sequence
  Description of Artificial Sequence: Synthetic coding sequence
atggagccttcttctctcgaactgccagccgacacagtacagagaattgcagctgagttaaaatgccacccaacagatgaacgggtcgccctgcatctcgacgaagaagataaacttcggcacttccgcgaatgcttttatatcccaaaaatccaggatctgccccctgtggacctgtctctagtcaacaaagatgaaaatgctatatactttctagggaattctctgggactccagcccaaaatggtcaaaacttacctggaagaagagctcgataaatgggccaagatcgccgcatatggacacgaagtcggaaaaagaccttggatcactggagatgaaagtatcgtcggactcatgaaagacatagttggagccaacgaaaaagaaattgctctaatgaatgcgttaactgtgaacctacatcttctcatgctttcattctttaaaccaacacctaaacgttataaaatactgcttgaagccaaagctttcccttcagaccactacgcaatagaatctcagttacagcttcatggactgaacatagaggaatccatgcggatgataaaacccagggaaggagaagaaactctgagaatagaagacatattagaagtcatagaaaaggagggggattctatagccgtaatactcttttcaggggtgcatttctatactgggcagcacttcaacattccagcaattacaaaagctgggcaggccaaaggatgctatgtgggatttgacctcgcacatgctgtgggaaatgtagaattatacctacacgattggggagtggacttcgcctgttggtgctcctataaatatctgaacgccggggccggaggaatagccggggctttcattcatgaaaaacatgctcacactatcaaacccgctctggtgggatggttcgggcatgaactcagtacacggtttaaaatggataataagttacaactgattcctggagtgtgtggattccggatctcaaacccccctatactgcttgtgtgttcactccatgcgtctttagaaattttcaaacaggctacaatgaaagcattaagaaagaaatcagtgcttctaactggatatctggaatatctcatcaaacataactacggaaaagataaagccgcaacaaaaaaaccagtagtaaatataattacaccttctcatgtcgaggaaagggggtgccagctcactattacattcagtgtccctaataaagatgtgtttcaggaactcgaaaaacggggagttgtgtgcgataaaaggaatccaaatggaatccgagtggcccctgtaccgttatataattcttttcatgatgtgtataaattcacaaatctcctaacaagtatccttgattccgctgaaactaaaaac

SEQ ID NO: 31843 - DNA, 1395 bp, Artificial Sequence
  Description of Artificial Sequence: Synthetic coding sequence
atggagccgagttccctggagctgccggcagacaccgtccagagaattgccgcggagctgaagtgccatcctacggatgaacgagtggcactgcatttggacgaagaggataagctcagacatttccgtgagtgtttctatatacccaagatccaggacctgccccctgttgacttgagtttggtcaataaggatgagaatgccatctattttttgggtaattcgctgggactgcagcccaagatggtgaagacgtatttagaggaggagctagataagtgggcgaagattgctgcctacggccatgaggtcggaaaaagaccttggatcacgggcgatgaatctatcgttggattgatgaaagatatagtaggagcaaatgaaaaagagatagccttaatgaacgctctgactgtcaatctgcaccttctgatgttgtcgttttttaagccaactcccaaacgctataaaatcctgcttgaggccaaggcctttccatctgatcactatgcaattgagtcgcagttacagctgcatgggctcaacatagaagagtcgatgaggatgattaaaccccgtgagggtgaggagaccctcaggatcgaggacatcctggaagttattgagaaagaaggcgatagcatcgctgtcatcctgttttcaggcgtgcatttttatacaggccagcactttaacattcctgctattactaaagccggacaggcgaaagggtgttatgtgggtttcgatctcgcacatgctgtggggaacgttgagctatacctccacgactggggagtggactttgcctgctggtgctcatacaagtaccttaatgcaggcgcaggcggaatagccggcgcctttattcacgagaagcacgcacacactattaaaccggcccttgtcggatggttcgggcatgaactatctacaaggttcaagatggataataaactgcagctgatacctggcgtctgcggcttccggatctccaacccacctatcctgctggtatgctcgttgcatgcatccctcgaaatcttcaaacaggctactatgaaagctctccggaaaaaatctgtgcttttaacgggatatctcgagtatctgatcaaacacaactacggaaaggacaaggctgcgacaaaaaagcccgtggtgaacattatcaccccttcccacgtcgaagagcgaggctgtcagcttaccatcacattctccgtgcctaataaagatgtgttccaggagttagaaaagcgcggcgtcgtttgcgacaagcgaaacccaaacgggataagggttgcgcccgtacccctttacaattcctttcatgatgtgtacaaattcaccaaccttttgacttcaatcttagatagcgctgagacaaagaac

SEQ ID NO: 31844 - DNA, 1395 bp, Artificial Sequence
  Description of Artificial Sequence: Synthetic coding sequence
atggaaccctcgtcccttgagctcccagcggataccgtgcaacgcattgcagcagagctgaagtgccatccgaccgatgagcgtgtggcgcttcaccttgatgaggaagataagctccgccactttagggagtgtttttacattccaaagatacaggaccttcctccggtggatctctcgcttgtgaacaaagatgagaatgcaatctactttctgggtaactcgctggggctgcaaccgaagatggttaaaacctacctggaggaagaactggacaagtgggccaagatcgcagcttatggtcatgaagtcggcaagcggccatggattaccggagatgaatcaattgtcggcctcatgaaggatatcgtcggagctaatgaaaaggagattgcacttatgaacgcccttactgtgaacctgcatctgttgatgcttagcttctttaagcctactcctaaacgttacaagatcctgctggaagctaaggcatttccttccgatcattacgcgatcgaatcccaacttcaactgcacggtctgaatatcgaagaatccatgagaatgatcaagccccgggaaggcgaggagacgctgagaattgaggacatactggaagtcattgaaaaggaaggcgattctattgcagtgatcctgttctccggagtgcacttctatactggacagcactttaacattccagcaatcactaaggcgggccaggcaaagggttgttacgtcggattcgacctcgcacatgcagtgggaaacgtggaattgtatctccatgactggggagtcgattttgcctgttggtgctcgtataagtaccttaacgcgggagccggggggatagcaggtgcattcattcatgaaaagcatgcccacactattaagccggcactggtgggatggtttggacacgagctgtcaactagatttaagatggacaacaaattgcaactcatccccggagtctgcggatttcgcatttccaatcctcctatcctgcttgtgtgctcactgcacgcgtcacttgaaatctttaagcaggcaaccatgaaagcccttcggaagaagtccgtgctgttgactggctacctggaatacctgattaagcacaattacggtaaggacaaggctgcaactaagaagccagtcgtgaatatcataactccttctcacgtggaagaacgcggttgtcaacttactattaccttttcggtgcctaataaggacgtgtttcaagaacttgaaaagcgtggtgtcgtgtgtgataaaagaaaccctaatggcattcgtgtggcccctgtgcctttgtacaacagctttcacgatgtctacaagtttactaatcttttgacctcaattctcgattccgcagaaaccaagaac

SEQ ID NO: 31845 - DNA, 1395 bp, Artificial Sequence
  Description of Artificial Sequence: Synthetic coding sequence
atggagccttcatctctcgagcttccggctgacaccgttcagaggatcgctgccgaactcaaatgtcaccctacagatgagcgggtcgcgcttcacctagatgaagaggacaagttgcggcacttccgagagtgtttttatattccgaaaatccaagacctccctcctgtagacttaagccttgtcaacaaggatgaaaacgccatttactttttagggaactctctggggctgcagccaaaaatggtgaaaacatatctcgaagaggaactggacaaatgggcgaagattgcggcgtacggacacgaagtggggaagagaccatggataacaggggatgagtccattgtaggcctgatgaaagatatcgtcggggcaaacgagaaggagatcgctctcatgaatgcactgacagttaacctacacttacttatgctgtccttttttaaaccaactcccaagcggtacaaaatactcctcgaggctaaggccttccccagcgaccactacgctattgagtctcagctccagctacacgggctgaatatagaggagtccatgcgaatgattaagccccgcgagggggaggaaaccctgagaatcgaggacattctggaggttatcgaaaaggagggtgatagtatcgcggtaattctattctcaggggtgcatttttatactggccaacactttaacattccggcaatcaccaaagctgggcaggctaaaggatgctatgttgggtttgatctcgctcacgccgtgggcaacgtggagctgtacctgcacgactggggcgtagacttcgcttgttggtgtagctacaaatatttaaacgcaggcgctggcggaatcgcgggcgccttcattcatgagaagcatgcccacactatcaaacccgcactggtcggatggttcggacatgagctgagcactcgatttaagatggacaacaaactccagctgattcccggagtgtgtggttttcggatctccaatcctccaatcctgctggtttgctctctgcatgccagcctcgagattttcaaacaggctactatgaaggcactgaggaagaaaagtgtgctcctgactggatacctggagtatctgataaaacataattatggaaaagataaggcagctacaaagaaacccgtcgtcaatatcattactccgtcgcatgttgaggagagagggtgtcagctgacgattacgttttctgtgccaaataaggacgtctttcaggaacttgaaaagcgtggcgtcgtgtgcgataagcggaatccaaacgggatcagagtggcgccagtccctctgtacaatagcttccacgacgtgtacaaatttacaaatttacttacaagcatcttggattcagcagaaaccaagaac

SEQ ID NO: 31846 - DNA, 1395 bp, Artificial Sequence
  Description of Artificial Sequence: Synthetic coding sequence
atggagccaagctcgctggaactgcccgccgacaccgtccaaagaatcgcagctgaattaaaatgccaccccaccgacgaacgcgttgccttgcacctggatgaggaggataagctgcgccactttagagaatgcttttatatacctaaaattcaggatctcccccccgtggatctgagcctcgtcaacaaggacgagaacgctatttacttccttggcaactctttggggctgcagccaaagatggtgaagacctaccttgaggaagagctcgataaatgggcgaaaattgctgcatatggccatgaggtgggtaaacgcccatggattaccggcgacgagtccatcgtggggctgatgaaggatatcgtcggagctaacgaaaaggaaattgcccttatgaatgcacttaccgtgaatttgcacctgctaatgttgtcttttttcaagccaacgccaaagaggtataagatattattggaggcaaaagcttttccgtctgatcattatgcgatagagagccagttgcagctgcacggcctgaacattgaggagagtatgcgcatgatcaagccaagagagggagaagagaccctgcgcatcgaggatatcctggaggtcatcgaaaaagagggggactcaatcgccgtgatcctcttttccggcgtacacttctacactggccagcattttaatattcctgctatcactaaagccggccaggctaaaggctgttacgtgggctttgaccttgcacacgctgtgggaaacgtagagctgtatcttcacgactggggcgtagactttgcgtgttggtgttcatacaaatacctgaacgcaggggccggtggcatcgcaggcgcctttatacacgaaaagcatgcccacacgatcaagcctgccctggtgggctggttcggccacgagctgagtaccagattcaagatggataacaaacttcagttgatacctggagtgtgcggctttaggattagcaacccaccgattttgttggtctgctccctgcacgccagtttagagatctttaaacaggcaaccatgaaagcactgagaaagaagtccgtcctacttacaggctatctggagtacctgattaaacacaactacggcaaggataaagctgccactaaaaagccagtggtgaacatcatcaccccctcgcacgtggaagagcgcggctgccagctgaccatcacattctctgtccccaataaggatgtcttccaggaacttgaaaagcgcggcgtcgtgtgtgacaagaggaatcctaatggtatccgagttgctcctgtgcctctctacaactctttccacgatgtctacaagttcacgaacctccttacttccatcctggactctgccgagacaaaaaat

SEQ ID NO: 31847 - DNA, 1395 bp, Artificial Sequence
  Description of Artificial Sequence: Synthetic coding sequence
atggaaccttcatcccttgaactacctgctgacactgtccagaggatcgcggcagaattgaagtgtcatccaactgacgaaagggttgccttgcatttggatgaggaagacaaacttcgacacttcagggaatgcttctacatcccaaaaattcaggatcttcctcctgtggatttgagtcttgtaaataaggacgaaaatgccatttattttcttggaaattctctaggactgcagcctaaaatggttaaaacttatctcgaagaggagcttgataagtgggctaagatcgcagcatacggtcacgaagttgggaaaaggccttggatcacaggagatgaaagtatagtaggcttaatgaaggatatagttggggcaaatgagaaggagattgctttgatgaacgcccttacagttaacttgcaccttctaatgttgagcttcttcaagcctactccaaagcgttataaaatactccttgaagccaaagcattcccatctgatcattacgccattgaatctcaactccagctccatggacttaacattgaagagtctatgcggatgataaaaccacgggaaggcgaagaaaccctgagaatagaagatatcctcgaggtgatagaaaaggaaggggattcaatcgcagttatactttttagtggagttcacttctacaccggccaacacttcaacatcccggcgattaccaaggcgggccaagctaaaggatgctatgtaggtttcgatttggctcacgccgttgggaatgttgagttgtaccttcacgactggggtgtagacttcgcttgctggtgctcttacaagtatctaaatgccggtgccggtggcatagctggagccttcattcatgaaaaacatgctcacaccatcaagccagctctcgtcggctggttcgggcatgaattaagcacaaggtttaaaatggacaataagctgcagttgattcctggcgtttgtggctttaggatatcaaacccccctattttgctcgtttgttcattacacgcatctcttgagattttcaaacaagctacaatgaaggcattacgtaaaaaatctgtacttctcaccggttaccttgaatatcttattaagcataactacggaaaggacaaagcagccactaaaaaacctgtggttaatattattacacctagtcatgtcgaggagcgtggctgtcaattgacgataacgttctccgtgccaaataaagacgttttccaggagctcgagaagaggggtgttgtttgtgataagagaaatcctaatggaatcagggtagctccagtccccctttataacagctttcacgacgtgtacaaattcactaaccttctcacatccattttggattcagctgagactaagaat

SEQ ID NO: 31848 - DNA, 1395 bp, Artificial Sequence
  Description of Artificial Sequence: Synthetic coding sequence
atggagccgtcttcgctggagctgccggcagatacggtgcagcgcatcgccgcggagctgaagtgccatccaactgatgagcgggtggctttgcacctggatgaggaagacaagctcagacatttcagagaatgcttctatattccaaagattcaggatctaccgccagtggacttgtctctggttaataaggatgagaacgctatctactttctcggcaactctctgggcctccaaccaaagatggttaagacctacttagaggaggaactcgataagtgggcaaagattgccgcatacggccacgaggtggggaagagaccctggatcaccggcgacgaaagcatagtgggactgatgaaggatatcgtgggagcaaacgaaaaagagatcgccttaatgaatgcccttaccgtgaaccttcacctgctgatgctgagttttttcaaacctacccccaagcgctacaagatcctgctggaagccaaagcatttccatccgatcactatgctatcgagtctcagctgcagcttcatgggttgaacatcgaggagagcatgcggatgatcaagccacgggagggagaagaaacactgcgcatcgaggatattttggaagttattgagaaggagggggactctatcgccgtgatattgttcagcggcgttcacttttacacgggccagcacttcaatatcccggccattactaaggctgggcaggccaaaggatgttatgtcgggttcgatctggcccacgcagtagggaacgtggagctgtatcttcacgactggggggttgattttgcgtgctggtgtagctacaagtatctcaatgcaggcgctggaggcattgccggggcgttcatccacgagaagcacgctcacactatcaagcccgctctagttggttggttcggccatgagctctcgacacgcttcaaaatggacaataaactgcaattgattcctggcgtgtgcggcttcaggatctctaaccctcctattctactggtatgcagcctccatgcctctttggagatattcaaacaggccaccatgaaagctcttcggaaaaagtcagtcctgctgaccggttacctcgaatacctgattaagcataattacggaaaagataaggctgctaccaagaagccagtggtgaacataattactcccagtcacgttgaagagagaggatgccagttaacgatcaccttttctgtgccgaataaggacgttttccaggagctggaaaaacggggagtggtttgcgacaagcgaaatccgaacggaatccgggttgcaccggtgccgctctataactccttccacgacgtgtataagtttacaaatcttttgacctcaatcttagacagtgcagagacaaagaac

SEQ ID NO: 31849 - DNA, 1395 bp, Artificial Sequence
  Description of Artificial Sequence: Synthetic coding sequence
atggaaccatcgtcgcttgagctgcctgccgacaccgtccaacgcatcgccgccgaactcaagtgccacccgaccgacgagcgggtggccttgcacctggatgaagaggacaagctccgccatttccgggagtgtttctacattcctaaaatccaggaccttccgccggtggacctttccctcgtcaacaaggatgaaaatgccatctactttttgggaaacagcctgggactgcaaccgaagatggtcaaaacctacctggaagaagaactggataagtgggccaagatcgctgcttacgggcatgaagttggcaagcgcccttggataacgggtgatgaaagcatcgttggccttatgaaagacatcgtgggcgccaatgaaaaggagatcgccctgatgaacgctctgaccgtcaacttgcacctgttgatgctgagctttttcaagccaacgccgaagagatacaagattttgctggaagcaaaggccttcccgagcgaccattatgccatcgagtcgcaattgcagctccacggccttaacatcgaagagtccatgcgcatgatcaagccgcgcgagggcgaggaaaccctgcggattgaagatattctcgaagtcatcgagaaggagggagactccattgcagtgatccttttttccggagtgcacttctacaccggacagcatttcaacatccctgcgatcaccaaagcgggacaggccaaaggatgctacgtgggatttgacctcgcacatgctgtgggaaatgtcgagctgtacctgcatgattggggagtggatttcgcatgctggtgctcgtacaagtacctcaacgccggcgcaggaggaatcgcaggagctttcattcacgagaaacacgcacacaccatcaagcctgctctcgtcggctggttcggacacgagctctccactagattcaagatggataacaaactccaacttatccctggagtttgcgggtttaggatctcgaatccaccgatcctcctcgtttgctcactgcacgcttcattggaaatcttcaagcaggccactatgaaggcactgaggaagaaaagcgtgctgctgactggatacctcgaatacctgatcaagcacaactacggaaaagataaggctgctaccaagaagccggtggtcaatatcatcaccccgagccacgtcgaagaacggggctgccagctgactatcaccttctcggtgcctaacaaagacgtgtttcaagagctcgaaaaacgcggagtggtctgcgacaagagaaacccgaacggaatccgagtcgccccagtgccactgtataactcgttccatgatgtgtacaagtttaccaacctgctcaccagtatccttgactcggccgaaacgaagaac

SEQ ID NO: 31850 - DNA, 1395 bp, Artificial Sequence
  Description of Artificial Sequence: Synthetic coding sequence
atggaaccttcctcgctcgagttgcccgcggacacagtccaaaggattgctgccgaactgaaatgtcaccccacagacgaacgggtcgccttacaccttgatgaagaagacaagctacggcactttcgagaatgcttttacatacccaaaatacaggacttgcctcctgtagacttgagcctggtcaataaagatgagaatgcaatttactttctaggtaactcattggggctacagccgaagatggttaaaacttatctcgaggaggagctggataagtgggctaagatcgctgcgtacgggcatgaagtgggaaaacggccgtggattactggcgatgagtctattgtgggactgatgaaggacattgttggcgctaatgaaaaggaaattgccttaatgaatgccttaaccgttaatctacatttactgatgctctccttcttcaagcctaccccaaagcgctacaaaatcctgttagaagccaaagctttcccttcggatcattacgccatcgagtcacagcttcagcttcacggcctcaatattgaggagtccatgcgtatgatcaaacccagggagggcgaagagacattacgcattgaggacatactggaagtgattgagaaggagggggactccatagcagtgatcctgttctctggcgttcacttttacaccggtcaacacttcaatatccctgctattacgaaagcaggacaggccaaaggctgctatgtcgggtttgatctggcgcatgcagtgggaaacgtcgagttatacttacatgattggggagtggactttgcctgttggtgctcctacaagtacctcaacgcgggtgcaggtggcatcgccggcgcatttatccatgaaaaacatgcccacaccataaaaccagccctcgtgggctggttcggccatgaattgtctacacgctttaaaatggataacaaacttcagttaatccctggggtctgtggatttcgcatctctaacccgcccattctcctcgtgtgttcgttgcacgcttccctggagatctttaagcaggccaccatgaaagcgctgcgcaaaaaatcagtgttgctaactggatacctagaatacttgattaaacataattacggaaaggacaaagccgccacaaaaaaaccggtggtgaatataatcacaccttctcacgtggaggaacggggctgtcagttgaccatcacgtttagtgtgcccaacaaggatgtgtttcaggaactcgagaaaagaggggtggtctgcgacaaacgcaacccaaatgggattcgggttgcccccgttccgctctacaactccttccacgacgtctacaagttcaccaaccttcttacttccatcctcgacagcgctgagacaaaaaat

SEQ ID NO: 31851 - DNA, 1395 bp, Artificial Sequence
  Description of Artificial Sequence: Synthetic coding sequence
atggagccttcctcgctggaactgcctgcagatactgtgcaacggatcgcggccgagcttaaatgccaccctaccgacgaaagggtcgctctgcacctcgatgaagaggacaaactcaggcacttccgcgaatgcttttacatcccaaagatccaggacttgccgccagtcgacctgtcgctggtcaacaaggatgagaatgccatctacttcctcggtaatagcctgggactccaaccgaagatggttaaaacctatctggaagaagaacttgacaaatgggcaaagatcgccgcatacggacacgaagttggaaagcgaccgtggatcactggggacgagtccatcgtcgggctgatgaaggacatcgtgggagcaaacgaaaaagaaatagcactgatgaacgctctgacggtgaatctgcacttgcttatgctgtctttctttaagcccacgcctaagcgctacaagatcctcctggaggccaaggcattcccttctgatcactacgcgatcgaatcacagttgcagctgcatgggttgaacatcgaagaatcgatgcggatgatcaagccacgggaaggggaggagacgctgcggatcgaggatatccttgaggtgatcgagaaagaaggagacagcatcgccgtcattcttttctcaggggtgcatttctacactgggcagcatttcaatatccctgccattactaaagcgggacaggccaagggctgctacgtcggattcgatttggcgcacgccgtgggcaacgtggaactgtacctgcatgattggggagtggacttcgcgtgctggtgttcgtacaagtatttgaacgccggagcaggcggaatcgcgggagctttcattcatgagaagcacgcgcacaccattaagcccgcactggtggggtggtttgggcacgaactctcaaccagatttaagatggacaacaaactgcagctgatcccgggtgtgtgcgggttccgcatttccaacccacccattctgcttgtgtgttccctccacgcatccctggaaatcttcaagcaagccaccatgaaagccttgagaaagaaaagcgtcctgctgacgggctacttggagtacctgatcaagcacaactacggaaaggataaggccgctaccaagaagccggtggtgaacatcatcactccttcacacgttgaagaaagaggctgtcaattgactatcacgttcagcgtgccaaataaggacgtgtttcaggagctggagaagaggggtgtggtttgcgataaaaggaatcccaacggcattcgggtcgcaccggtgccactgtacaactcgttccatgacgtatacaagttcactaatctgctgaccagcatcttggattccgcagagactaagaat

SEQ ID NO: 31852 - DNA, 1395 bp, Artificial Sequence
  Description of Artificial Sequence: Synthetic coding sequence
atggaaccgtctagccttgaacttccggctgatacggtccaacggatcgctgcggaactgaagtgtcaccccactgatgagcgcgtggccctgcacctcgacgaagaagataagctgaggcattttagagaatgtttttacatcccgaaaatccaggatctgccaccagtggacctgtctctggtcaataaggatgaaaatgcgatttactttctcggaaactccctggggttgcagcctaagatggtgaaaacctaccttgaggaggagctcgataagtgggcgaagattgccgcttacgggcacgaagtggggaagcggccatggatcacgggtgatgaaagcatcgtgggccttatgaaggacatcgtcggagcgaacgagaaggaaattgcactgatgaacgcacttactgttaatctccatttgttgatgctttcgtttttcaaaccaaccccaaagagatacaagattcttcttgaagcaaaggcatttccttccgatcattacgcaatcgagtcacaacttcaacttcacgggctcaacattgaggaaagcatgcgcatgataaagcctagagagggtgaagaaaccttgcgcatcgaggacattctggaggtcattgaaaaagaaggggattcgatagcagtgatcctcttctccggggttcacttttacactgggcagcacttcaatattcctgcaattacgaaggcgggtcaagccaagggttgttacgtcggatttgatttggcacatgccgtgggaaacgtcgaactttacttgcatgattggggtgtcgattttgcatgttggtgctcctacaaatatcttaatgcgggagcagggggaatcgccggagcattcattcatgaaaagcatgcacataccattaagcctgcacttgtgggatggttcggacatgaactgtctactagattcaagatggataacaagctccagttgattccaggcgtgtgcggctttcgtatttcaaatccccctatcctcctggtgtgctcgttgcatgcctcacttgaaatcttcaagcaggcaacgatgaaggcactgagaaagaagagcgtcttgcttactggttaccttgaatacctgatcaagcataactatggtaaggacaaagcagcaaccaagaagcctgtggtgaacattatcactccatcccacgtggaggagcgtggttgtcagcttactattaccttcagcgtgccaaacaaggacgtgtttcaagagctggagaaaaggggagtggtgtgtgataagcgcaatcctaacggtattcgggtcgcacccgtgcctctctacaactcgttccacgacgtgtacaagttcaccaacttgttgaccagcattctggacagcgcagagactaagaat

SEQ ID NO: 31853 - DNA, 1395 bp, Artificial Sequence
  Description of Artificial Sequence: Synthetic coding sequence
atggaaccatcttcccttgagctgcctgcagatactgtacagagaattgcagctgagttgaagtgtcaccctacggatgaaagagtcgcactgcatctggatgaagaggataagttacggcacttccgggaatgtttctacattccgaagatccaagacctgccgccagtagacctgtcccttgtgaacaaagatgagaacgcgatatacttcttgggaaattcactaggactgcagcccaagatggtcaagacctacctagaggaggaactggacaaatgggccaagatcgccgcctatggtcatgaagttggaaagcgtccctggatcactggcgacgaaagcattgtggggctgatgaaagacatcgtgggggccaacgaaaaagagatagcactgatgaatgccttgactgttaatcttcatctattgatgctctcttttttcaaaccaacccctaagcgctataagatcttactcgaggctaaagcgtttccatccgatcactatgccattgaatcgcagttacagctacacggcctgaatatcgaagagagcatgagaatgatcaaaccccgagagggggaagaaactctgcggattgaggatatactagaggtgattgaaaaggagggtgactcaatcgccgtaattctcttctcaggggtacacttctataccggccaacacttcaacatacctgcgataacgaaagccgggcaagccaaggggtgctatgttggatttgacctggcgcacgcagtcggtaatgtagagctgtacttacacgattggggggtggatttcgcgtgctggtgcagctataagtacctgaatgcaggtgcaggaggaatagctggcgcattcattcatgaaaagcatgcccacaccattaagccagcccttgtgggctggtttggtcatgaactgagcacacgctttaagatggataacaaactccagttaatccccggagtgtgcgggttccgaatcagcaatccacctatccttttggtttgctctctgcacgcatccctcgagatctttaagcaggcaaccatgaaagccttgcgaaagaaaagtgtcttgctcaccggctatctcgaatacctgataaaacacaactacggcaaggataaagctgcgactaagaaacccgtggtcaacatcatcacaccatcccacgtggaggaacgaggctgtcaactgacaataactttttcggtacctaataaagacgtatttcaggaattggaaaaaagaggcgtggtctgtgataagagaaatcccaatggcatccgggtggccccggtccctctctataacagctttcatgacgtgtacaagttcaccaacctgttgacatccatcctggactccgcggagaccaagaac

SEQ ID NO: 31854 - DNA, 1395 bp, Artificial Sequence
  Description of Artificial Sequence: Synthetic coding sequence
atggagccatcgtcgctcgaacttcccgccgacacggtgcagcggattgcagccgagttgaaatgccatccgacggacgagcgggttgctttgcatctggacgaggaggacaagttgcgtcattttagggaatgtttttatatacccaaaattcaagacttacctccggtcgacttgagcctggtcaataaagatgagaatgcgatctacttcctcgggaacagtctagggctgcagccaaagatggtgaagacttacctggaggaggagctcgataagtgggccaagattgctgcctacgggcatgaagtgggcaaacgaccctggattacaggcgacgagagtatcgtaggcttgatgaaggatatcgttggcgccaatgaaaaagaaatcgccctaatgaacgcactcactgttaacctccatctgcttatgttgtccttctttaaacctacacctaagaggtacaagattttgctcgaggccaaggcgtttccaagcgatcactacgctatcgagtcccagctccaacttcatggtttaaacatagaagaatctatgaggatgatcaagcctagagaaggggaggagacactcaggatcgaggacatcttagaagtcatagagaaggagggcgacagtatcgccgtgatccttttctctggtgtgcatttctacacaggacagcatttcaacattccggcaatcaccaaggccggtcaggccaaagggtgctacgtgggttttgatttagcccatgcagttgggaatgtggagttatacctgcacgattggggcgttgactttgcatgttggtgtagttacaagtatctgaacgccggtgctggcgggatagcaggagctttcatccatgaaaagcacgcacataccataaaacccgcgctggtgggctggtttggacacgaattgtcaacgcgcttcaagatggacaataagctgcagctaatcccaggtgtgtgtggcttcagaattagtaatccccctatcctactagtttgcagtctccatgcttctctggaaatctttaagcaagcaactatgaaggcgctccgcaagaagagcgtgttactgactggctaccttgagtatttaataaagcacaattatggtaaggacaaggcggcaaccaaaaagcctgttgtaaacattattacaccctcccacgtcgaggaacgcggatgtcagctcactattacgttctccgtgcctaataaggatgtttttcaggaacttgagaaaagaggggtcgtatgtgataagcgcaatcctaatggcattcgtgtggctcctgtccctctctataactcgttccatgatgtatacaaattcacgaaccttcttacaagtatactagactccgcagagaccaaaaat

SEQ ID NO: 31855 - DNA, 1395 bp, Artificial Sequence
  Description of Artificial Sequence: Synthetic coding sequence
atggagccatcaagcctggagctccctgctgataccgtgcagagaatcgccgctgaacttaaatgccaccctacggacgagagagttgccctccacctggacgaagaggacaagctgcggcactttagggaatgcttttacatcccaaagatccaggacctgccgccggtggacctgtcacttgtgaataaggatgaaaatgctatctactttctgggaaactccctgggattgcagccaaagatggttaagacctacttggaagaagaacttgataagtgggccaagattgccgcgtacggacatgaggtgggaaagaggccttggatcaccggtgacgagtcaattgtgggcctgatgaaggatatcgtgggagctaacgagaaagaaattgccctcatgaatgctcttactgtcaacctccatcttctcatgctgtcgttctttaagccgaccccaaagcggtacaaaatcctcttggaagcgaaagccttcccgtcagaccactatgctatcgaatcccagctccaactgcacgggctgaacatcgaagaatcgatgcgcatgatcaagccgcgagagggcgaagagactctgcgcattgaggacattctcgaggtcatcgaaaaagaaggcgactcgatcgctgtgatcctgttctccggagtccatttctacacgggccagcacttcaacatccccgccattaccaaggccggccaagccaaggggtgctacgtcggattcgacctggcgcatgctgtgggaaacgtggaactttacctgcacgattggggagtggactttgcctgctggtgttcatacaagtatctgaacgcaggggccgggggcatcgcgggagcctttatccacgagaaacacgctcatactatcaaaccggcgttggtgggctggttcggacacgagctttcaacccgattcaaaatggacaataagctccaactcatccctggtgtctgcggattccgcatctcgaacccgccgatcctgctcgtctgctcgctgcacgcatcgttggagatctttaaacaggcgactatgaaggcactgagaaaaaagtccgtgctgctgacgggatacttggagtacttgattaagcacaactacgggaaagataaggcagccactaagaaacccgtggtgaacatcattactccttctcatgtggaggaaagaggatgccaattgaccatcaccttttcagtcccaaataaggacgtgttccaggaacttgaaaaaaggggcgttgtctgcgacaagcgcaacccgaatggaattcgcgtcgcgcccgtgcctctctacaactcattccatgatgtgtacaagttcactaacctgctcacttccatcctggactccgcagagactaagaac

SEQ ID NO: 31856 - DNA, 1395 bp, Artificial Sequence
  Description of Artificial Sequence: Synthetic coding sequence
atggagccatcgagtctcgagttgccagccgatacggtgcaacgcattgccgccgaactgaagtgccaccctacggacgagcgggtggccctgcacctggacgaggaagataagctgcggcatttccgggagtgcttctacattcccaagatccaggacctccctccggtggatctttccctggtcaacaaggatgagaacgcaatatacttcttgggtaattcgttgggacttcagccgaagatggtgaaaacctacctggaagaagagctcgacaagtgggctaagatcgcggcctacgggcacgaagtcggaaaaagaccatggatcaccggagacgaatctatcgtgggcttgatgaaggatatcgtgggcgccaatgagaaagaaatcgccctgatgaacgcgttgaccgtgaacctgcaccttctgatgctttccttctttaagccaaccccaaagagatataagatcctgctggaggcgaaggcattcccatcagaccactacgcgatcgagtcccagctgcagttgcacggactgaacatcgaagagtccatgcgcatgatcaaaccacgggagggagaagagactctgagaattgaagatatcctggaggtgatcgagaaggagggtgacagcattgccgtgatccttttttcgggagtgcatttctacaccggacagcacttcaacatccctgcgattaccaaagcgggccaagcaaaggggtgttacgtgggatttgatcttgcgcatgctgtcggcaatgtcgagctgtatctgcatgattggggcgtagacttcgcctgctggtgttcatacaagtacctgaacgcgggagctggaggtatcgcgggcgcgttcatccatgagaaacacgcacatacgatcaagccggccctggtgggctggttcggacacgaactgtcgactcgctttaagatggataacaagctgcagctgatcccgggagtctgcggatttagaatatcaaatccccctatcctgctggtgtgcagcttgcacgctagcctggagattttcaagcaggctactatgaaggcgcttcggaagaaatcggtgttgctcaccggttacctggaatacttgatcaagcacaattacgggaaagacaaagccgccaccaaaaagccggtggtgaacatcattactccttcgcacgtcgaagagagagggtgccaactgactatcaccttctcggtcccgaacaaggacgtctttcaagagctggaaaaaagaggcgtcgtttgtgacaaacgcaatccaaacggaatccgcgtcgcaccagtgcccctgtacaacagcttccatgatgtttacaagttcaccaatttgttgacctcaatcctcgacagcgcagaaaccaaaaat

SEQ ID NO: 31857 - DNA, 1395 bp, Artificial Sequence
  Description of Artificial Sequence: Synthetic coding sequence
atggaaccatcatcgcttgaacttcccgcggatacggtgcaacggattgctgcagaactgaaatgtcacccaacggacgagcgagtggcccttcatctggacgaagaggataaacttagacattttcgtgagtgcttctacatccccaagattcaggacctgcctcctgtggatctgagcctggtgaacaaggacgaaaatgctatatacttcctgggtaactcgctgggacttcagcctaaaatggtgaaaacctatcttgaggaagaactcgacaagtgggcgaagatcgctgcgtacggtcatgaagtcggcaagaggccatggatcactggagatgagtcgattgtcgggcttatgaaggacatcgtgggtgccaacgagaaagaaattgcacttatgaacgcacttactgtcaaccttcatcttctcatgctgtcgtttttcaagccaactcccaagagatacaagatactgctggaagcgaaggcgttcccatccgaccattacgcgattgaatcacagctccagctccacggactcaacatagaggaatcgatgagaatgattaagcctcgggaaggagaggaaacgctccgaattgaagatatcttggaggttattgaaaaggagggcgattccatcgccgtgatcttgttcagcggggtgcacttttacactgggcaacactttaacataccggcaatcaccaaggcaggacaagctaaaggttgttacgtcgggtttgacctggcacacgcagtaggtaatgtagagctttacctgcatgattggggtgtcgattttgcctgttggtgttcttacaagtacctgaacgcgggagccggagggattgcaggagcattcattcacgaaaaacatgcacatactatcaagcctgcgctcgtgggatggtttggccatgaactctcgaccagattcaagatggataacaagctccagctcatacctggagtgtgtggcttccgcatttccaacccgcccatactcttggtttgctcgctgcacgcatcgctcgaaatctttaaacaagccactatgaaggcactgaggaaaaagagtgtgctgcttaccggctaccttgaatacctgatcaaacataactatggaaaggataaggcagcgactaagaagccagttgtgaacatcatcactccttcacatgtggaggagcgtggatgtcaacttaccattactttttcagtgcctaataaggacgtgtttcaggaacttgagaaacgcggtgtggtctgcgataaacgtaatccaaatggaattcgcgtggctccggtgcctttgtacaacagtttccacgacgtgtataagtttaccaatctcctgacctccattctggattccgcagaaaccaagaat

SEQ ID NO: 31858 - DNA, 1395 bp, Artificial Sequence
  Description of Artificial Sequence: Synthetic coding sequence
atggaaccctcgagcttggaattgccagctgacaccgtgcaaaggattgccgcggaactgaagtgccacccaaccgatgaacgagtggcacttcacctcgatgaggaagataagctcagacattttcgggaatgcttctatatcccaaagattcaagatctcccccctgtcgatctgtcactggtgaacaaggatgagaacgcaatctacttccttggaaatagtctgggactgcaacccaagatggtgaaaacctacttggaagaagaactggataagtgggcgaagatagccgcatacggtcatgaagtgggaaaaagaccttggatcaccggcgacgagtctattgtgggtcttatgaaagatattgtgggagcaaacgaaaaggaaatagcacttatgaacgcacttactgtgaaccttcaccttttgatgcttagcttctttaaaccaactcctaagcgctacaagatcctcctggaagcgaaggcatttccctcagatcattacgcaattgagtcacaactgcaacttcatggactgaacatcgaagaatccatgagaatgatcaaacctcgagaaggagaagaaactcttagaattgaggacatactcgaggtgattgagaaggagggtgactcgattgccgtgattcttttctcaggtgtgcacttttacaccggacagcactttaacattcccgcaattacgaaggcaggtcaagcaaagggttgctacgttggctttgaccttgcccatgccgtcgggaatgtcgaattgtaccttcatgattggggagtggactttgcatgctggtgcagctacaaatatctcaacgcaggcgcaggtggaattgcaggagcatttatccatgaaaagcacgcccatactattaagccggccctggtgggctggtttgggcatgaacttagcacccgctttaagatggataacaaactgcagctcatccctggcgtctgtggtttccgcatctccaatccgccaattctcctcgtgtgtagccttcacgcgagcctggagatcttcaaacaagcaaccatgaaggctttgagaaagaagtcggtgcttctgactggttacctcgaatacctgatcaagcacaactacggaaaggacaaagctgcaactaagaagccagttgtgaacatcattactccctcgcatgttgaagagcggggctgtcaactgacgattaccttttccgtgcctaacaaggatgtgttccaagaactcgaaaagagaggtgttgtgtgtgataagcgtaacccaaatggaatccgagtggcccctgtgcccctctacaattcgtttcatgatgtgtataagtttacgaacctcttgacctcgatcctggattcggctgaaaccaagaac

SEQ ID NO: 31859 - DNA, 1395 bp, Artificial Sequence
  Description of Artificial Sequence: Synthetic coding sequence
atggaaccttcttctttggagttgcccgccgatacagtgcagcgcatcgctgctgaacttaagtgccatccaacagacgagagggtcgcgttgcacctcgacgaggaggataaactccggcactttcgcgaatgcttttacattccgaagattcaggacctgcctccagtcgatctgtctctagttaataaggatgagaatgctatatattttctgggaaattcacttggactgcagccgaaaatggtgaaaacatacctcgaggaagagttggataaatgggccaagatcgctgcatacggtcacgaagtggggaaaaggccttggattacaggtgacgaaagtatagtggggctgatgaaggacattgtcggtgctaatgagaaagaaattgccctcatgaatgctttgacagtcaacttgcatctattaatgctgagcttcttcaagcccacaccaaaaaggtataagatacttctggaggcaaaagcctttccatcggatcattacgcaatcgagtcccagctgcagctgcacggattgaacatagaagagagcatgcgcatgataaagcctcgcgagggcgaggagactctgcgtatcgaagatatcctggaggttatcgagaaggaaggggactccattgcggtcatcttattcagcggcgtgcatttctatacgggtcagcatttcaacattcccgcaataacgaaggccgggcaggcaaaaggctgctacgtgggttttgatctggcccacgcggtggggaacgtagagttgtacttgcacgactggggagtggattttgcttgttggtgttcctacaaatatcttaatgccggcgctggtggcattgcaggagcgttcattcacgagaaacacgcacacacaattaagcccgctctcgttgggtggttcggccatgagctgtctactaggtttaaaatggataataagcttcagctcatacctggggtttgcggcttcagaatctctaatccaccaatcctcctggtgtgcagcttgcacgctagtctagagattttcaagcaagctacaatgaaggcgctacggaaaaaatcagttcttctcaccggatacctcgagtatctgatcaaacacaactatggcaaagacaaagctgcaacaaagaagcccgtcgttaatatcatcacaccatctcatgtggaagagaggggatgtcagctcaccattactttcagcgtgccaaataaagacgtgtttcaggaactggagaagagaggggtggtgtgtgacaaacgcaaccctaatggaatcagagtggcccctgtgccgctgtataattcctttcacgacgtgtacaaatttaccaacttgctgactagtattctggatagcgccgagacgaagaat

SEQ ID NO: 31860 - DNA, 1395 bp, Artificial Sequence
  Description of Artificial Sequence: Synthetic coding sequence
atggagccttcgagccttgagctccccgcagacaccgtgcagaggattgcagctgagctgaaatgtcaccctactgatgaaagagtggcactgcatcttgatgaagaggataagttgagacatttccgagagtgcttttacatcccaaagattcaggacctccctcctgtggacctgtcactggtgaacaaagacgaaaacgcgatctatttcctcggtaattcgcttggtttgcagccgaagatggttaagacctaccttgaagaggagctggacaagtgggcaaagattgcagcatacgggcacgaagtcggtaagcgcccgtggattactggcgacgaatccatcgtcggactgatgaaggacatcgtgggtgccaatgaaaaagaaattgccctgatgaatgcactgactgttaacctccatcttctgatgcttagctttttcaagcctaccccaaaacgatacaaaattctccttgaagcgaaggccttcccttcggatcactacgcaatcgaaagccaactgcagctgcacggtttgaatattgaagaatccatgcggatgatcaagcctagggagggagaagaaactctccgcattgaggatattcttgaggtgatcgagaaagaaggagattctatagcagtgatattgttttccggagtgcacttctacactggccagcactttaacatccccgcgatcacgaaggcaggacaggctaagggctgttacgtgggttttgacctggcacatgcggttggtaacgtcgaactctaccttcacgactggggagtcgactttgcgtgctggtgctcctacaaatatcttaatgcaggcgcaggaggtattgcgggggcattcatccatgagaagcatgcccatacgataaagccggcgctggtgggatggtttggacatgagctctcgactaggtttaagatggataacaagttgcagctgattcctggagtctgtgggtttcggatctccaacccgcctatactgctggtctgttcgctgcatgcatcccttgagatctttaaacaggcaaccatgaaggcattgagaaagaagagcgtcctcctgactgggtacctggagtacctgattaagcacaattatggaaaagataaagccgcaaccaaaaagcctgtcgtgaacatcatcacccctagccatgtggaagaacggggttgccagctcactattactttttcggtgccaaacaaggatgtgtttcaggaactggaaaaaaggggggtggtgtgcgacaagcgcaatccaaacgggataagagtcgcaccagtgccattgtacaattctttccatgatgtgtacaagtttaccaaccttctgacgagcatacttgatagcgccgaaactaagaac

SEQ ID NO: 31861 - DNA, 1395 bp, Artificial Sequence
  Description of Artificial Sequence: Synthetic coding sequence
atggaacctagctcgctggaactccccgccgatactgtccagcggatcgccgcggaactgaagtgccatcctactgacgaaagggtcgctctgcacctggacgaagaagataagttgcggcatttccgggaatgcttctacatcccgaaaatccaagacctgccaccagtggacctgtccctcgtgaacaaggacgagaacgccatttactttctgggtaactcgctgggactgcagccaaagatggtgaaaacgtacctggaggaagaacttgataagtgggccaaaattgcagcttacggacacgaggtcggaaagcggccgtggatcacgggggacgaaagcatcgtgggactgatgaaagatatcgtgggagccaatgagaaagagatcgcgcttatgaacgcacttacggtcaaccttcatctcctgatgctgtcattcttcaaaccaacccccaagagatacaagatccttctggaagcgaaagcgttcccgtcggatcattacgcaatcgaatcccagttgcagctgcacggactgaatatagaagagtcgatgcgcatgatcaagccaagagaaggcgaagaaacccttcgcatagaggatatcctggaagtgatcgagaaggaaggggacagcattgccgttatcctgttcagcggagtgcatttctacactggtcagcactttaacatccccgccattaccaaggccggacaggccaaaggatgttacgtgggttttgacctggctcacgccgtgggtaacgtggaactgtaccttcacgactggggcgtcgacttcgcctgctggtgttcgtataagtacctcaacgcaggagcaggtggtatcgccggagcctttatccacgaaaagcacgcccacaccatcaaaccggcactggtggggtggtttggccatgaactgtctactcggttcaagatggataacaagctgcaactgatccccggagtgtgcggattccgaatctccaacccgccgatcctgctcgtctgctcactccatgcttcgctggaaatctttaagcaagccactatgaaggccctgcgcaagaagtcagtcctgttgaccggctacctggagtatctgatcaagcataactacgggaaggacaaggccgcaaccaagaaacccgtggtgaatatcatcacgccgtcacatgtggaggaaaggggatgccagctgactatcacttttagcgtgccgaataaagatgtgtttcaggagctggaaaagcgcggcgtcgtgtgtgacaagcgcaatccaaatggaatccgggtggcgcccgtgccgctgtacaattcgttccatgacgtctataagtttaccaacttgcttaccagcatcctcgactcagctgaaaccaaaaat

SEQ ID NO: 31862 - DNA, 1395 bp, Artificial Sequence
  Description of Artificial Sequence: Synthetic coding sequence
atggaaccgtcgtcgctggaactgccagcagacactgtccagcgcatcgccgctgagttgaaatgccacccgactgacgaacgggtggctctgcacctggatgaggaagataagttgcggcattttcgcgagtgcttttacatccccaaaatccaggacctgccacctgtagatctcagcctcgtcaacaaggacgaaaatgcaatctacttcctgggcaactcccttggactccagccgaaaatggtcaagacttacctcgaagaagagctggataaatgggcaaagattgcagcttacggccacgaggtgggaaagcgcccttggattactggggacgagtcaatagtgggtttgatgaaggacatcgtcggagctaatgaaaaggaaattgcactcatgaacgcacttaccgtcaacctgcatctgctgatgctctcattcttcaagccaacccctaagagatataagatcctcttggaagccaaagcatttcctagcgatcattacgctatcgaaagccaactgcagcttcacggcctcaatatcgaggagtccatgcggatgatcaagcctagagaaggagaagaaactctccgaatcgaggacatcttggaggtgatcgagaaggagggagattcgattgcggtgatcctgttctccggcgtgcacttctataccggccagcacttcaatatcccggccataaccaaggcagggcaagcgaaaggttgctacgtcggattcgatttggcgcatgccgtgggaaacgtggaactctacctgcacgattggggagtcgactttgcctgctggtgcagctacaagtacctgaacgcgggagcgggcggaatcgccggagctttcatacacgagaagcatgcgcataccattaagccggcgttggtcggttggttcggacatgaactcagcacccgcttcaagatggataacaagttgcaactcatccctggagtatgcggcttccgcatttcaaatccccctatcctgcttgtctgctcactgcatgcttcgctggagatcttcaagcaagcgaccatgaaggccctcagaaagaagtcagtgctgctcacgggataccttgagtacctgattaagcacaactacgggaaggacaaggccgcaactaaaaagccagtagtgaacatcatcaccccgtcccacgtcgaggagagaggatgtcagctgacgatcaccttttccgtgccgaataaagacgtgttccaggaactggagaaaaggggggtggtgtgtgacaagaggaatcccaatggcatcagagtcgccccggtgccactgtacaattcgtttcacgacgtttacaaattcactaaccttctcacttctatcctggattccgcggaaaccaagaac

SEQ ID NO: 31863 - DNA, 1395 bp, Artificial Sequence
  Description of Artificial Sequence: Synthetic coding sequence
atggagccgtccagcctcgagctgcctgccgatacggtgcagcgaatcgcagccgagctcaagtgtcaccctacggacgaaagggtggcactgcacctggacgaggaagataaactacgtcacttcagagagtgtttttacatcccaaagattcaggatttgcccccagtggacctcagcctggtcaacaaggatgagaacgccatctattttttggggaactcactgggcctccaacctaaaatggtgaaaacgtaccttgaagaggagctggataagtgggcaaagattgctgcctatgggcacgaagtcggcaagaggccctggatcaccggggacgagtccatagtgggcctgatgaaagacattgtgggggccaacgagaaagaaattgcgctgatgaatgctctcactgttaatttgcacctgctgatgctgtcgtttttcaagccgacccctaagaggtacaagattctgctcgaagcaaaggcctttccgtctgatcattacgccatcgagagtcagctacaacttcatggcctgaacatcgaagagagtatgcgcatgattaagcctagggagggggaggaaaccctgcggattgaagatatcttagaagtcattgaaaaagaaggagattcgattgcagtcatactattttctggcgtccacttctataccggccagcattttaacattcctgcaatcacaaaagccggccaggcaaaaggctgttatgtagggttcgatcttgcccatgccgtgggtaatgtggaattatatctgcacgattggggtgtggatttcgcatgttggtgttcctacaagtacttaaacgccggagccggaggaatcgctggtgccttcattcacgaaaaacacgcacacacgattaagcctgccctggtaggctggtttgggcacgaactgtctactaggtttaaaatggacaacaaactgcagctgattcccggagtctgtggttttcgcatctcaaaccctccgatcctacttgtgtgttcactgcacgcttcacttgagatctttaagcaggccacaatgaaggccctgcgaaagaagtctgtgctactaactggctacctagaatatctaattaagcacaattacgggaaggacaaggcagccacaaagaagcccgtggtcaacatcatcacccccagtcacgtcgaagaacgcgggtgtcagctgaccatcacattcagcgttcccaacaaagatgtgttccaggaactggagaaaaggggcgtggtgtgtgataagcggaatcccaatggcatccgcgttgcacccgtgccgctctataactccttccacgatgtttacaagtttacaaatctgctgacatctatactggattcggccgaaactaagaat

SEQ ID NO: 31864 - DNA, 1395 bp, Artificial Sequence
  Description of Artificial Sequence: Synthetic coding sequence
atggagccgtcatcccttgaactgcctgctgatactgtgcagcgcatcgcagccgagctcaagtgtcacccgactgatgaacgcgtagctctccacctggatgaggaggacaagttgcgccacttccgcgagtgcttctacattcccaagattcaggacctccctccagtagatctgtcccttgtgaacaaggatgaaaacgctatctatttcctgggcaattccttgggattgcaacctaagatggtcaagacctatctcgaggaggagctggacaaatgggccaagatcgcagcgtatggacacgaagtaggaaagaggccctggattaccggtgacgagtccatcgttggattgatgaaggacatcgtgggtgctaatgaaaaggagattgccttgatgaatgctctgaccgttaacttgcatttgctcatgctgtctttcttcaagccaacgcccaaaaggtacaagatcctgctggaggctaaggcgtttccaagtgaccattatgccatagaaagtcagctgcagctgcatggattgaatatagaagaatccatgagaatgatcaaacctagggaaggtgaagagactcttagaatcgaagatatattggaggtgatcgagaaagaaggagactccatcgccgtcatcctgttctccggcgtgcacttctacacaggacagcacttcaacatccctgccatcactaaagcgggccaagctaaaggctgttatgtgggctttgacttggcacacgctgttggtaatgtagagctgtatctccacgactggggcgtggactttgcgtgttggtgtagttacaaatatctcaacgctggagcgggcggtatcgcgggagccttcatccatgagaaacacgcccacaccattaagcctgcacttgtgggatggttcggccacgagctgtcaaccagattcaagatggataataagctccagctgattcccggagtgtgcggatttaggatctcaaatcccccaatccttctggtatgttctctccacgcgtctctggaaatttttaagcaggctaccatgaaagcactcaggaaaaaaagcgtcttgctgactggttacctggaatacttgattaagcacaattacggtaaagataaggccgcaacaaaaaagcctgtggtgaacatcattaccccttcccacgtcgaggagagaggctgtcagttgactatcacgttcagtgtacccaacaaggatgtgtttcaggagctggagaagagaggtgtcgtatgtgataaaaggaatcctaacggcatcagagtggccccagtgcctctttataattctttccacgacgtttacaagttcacgaacttgctgacttccattctggatagtgccgaaaccaaaaat

SEQ ID NO: 31865 - DNA, 1395 bp, Artificial Sequence
  Description of Artificial Sequence: Synthetic coding sequence
atggagccgtcctctttggaactgccagccgatacagtgcagaggatcgccgctgaactgaagtgccatcctactgatgagagagtggccctgcatctcgacgaggaagacaaactgcgtcacttccgagaatgcttctatatcccaaagatccaggatctgccccctgtcgaccttagcctggtcaacaaggacgagaacgccatttacttcctaggcaattccctggggctgcagcctaagatggtaaagacctatcttgaagaggaattagacaagtgggccaagatagccgcctacggccatgaagtcggaaagaggccttggattaccggcgacgaaagcattgtggggctgatgaaagatatcgtaggagccaacgagaaagaaatcgctttgatgaacgcactgaccgtaaacctccatttactgatgctctccttcttcaagcccaccccaaaacggtacaagatcctgttggaggccaaggcctttccatctgaccactacgccattgaatcccaactccaacttcatggccttaatattgaggagagtatgagaatgatcaagccaagagaaggtgaggaaacccttcgaattgaggacatactcgaagtcatcgagaaggagggagattctatcgctgtcatcttattcagcggagttcacttctacacagggcaacatttcaatatcccagcaataacgaaggcagggcaggctaaaggctgctacgtcggcttcgatctggcccacgccgtgggcaatgtggaactgtatctccacgactggggagtggatttcgcctgttggtgcagctacaagtacctcaatgcaggagccggcggaatcgcaggggcatttattcacgaaaaacatgcccataccataaaaccagcgctcgtaggctggttcggacatgaactgagcacccgattcaaaatggataacaaacttcaactgataccaggggtatgcggcttccgaatcagcaacccaccaatcttgctcgtgtgttctctgcatgcctctttggaaatttttaagcaagcgacaatgaaggcactcaggaaaaaatcagtcctgctgacgggatacctggaatacctcataaaacacaattacggcaaggataaagctgcaacaaagaagcccgttgtaaacattatcaccccttctcacgtggaagaaaggggctgccaactcacaatcaccttctccgtaccaaataaagacgtgtttcaggagctcgaaaagagaggggttgtgtgtgataagaggaacccgaatggcatccgtgtggcgcctgtacctctgtataactcgttccatgatgtatataaattcaccaatctgctgacatctatcctggactccgccgaaaccaaaaac

SEQ ID NO: 31866 - DNA, 1395 bp, Artificial Sequence
  Description of Artificial Sequence: Synthetic coding sequence
atggagccatcgtcgcttgaactgcctgcggacaccgtgcagcggattgccgcagaattgaaatgtcaccctactgacgagagagtcgcccttcatctggatgaagaggataagctgaggcactttcgagagtgcttctatatacccaaaattcaagacctgcccccggtggatctctcgctggtcaataaggacgagaacgccatctatttcttggggaactccctgggcctgcaaccgaagatggtcaagacctacttggaggaagagttggacaagtgggccaagatcgcagcatacggccatgaagtgggaaaacgaccttggattaccggtgatgagagcattgtgggattgatgaaggacatcgtcggcgcgaacgaaaaagagatcgcactcatgaacgcactgacggtcaacctgcacctcctgatgctttcgtttttcaagcctacgcccaagcgctacaaaattcttctggaagctaaggcatttccatcagaccattacgcaatagaatcccagctccagctgcacggtttgaatattgaagaatccatgagaatgatcaagccacgcgaaggagaagagactctgaggattgaagatattctggaagtgattgaaaaagaaggagattcgatagcagtgattctgttcagcggcgtccacttttacactggccaacatttcaacatcccagctattaccaaggcagggcaagcaaagggttgttacgtgggctttgacctggcgcacgctgtcggaaatgtcgagctgtacctgcatgattggggggtcgacttcgcgtgttggtgttcatacaaataccttaacgctggagcaggaggcattgccggagctttcattcatgaaaagcacgcccatactatcaaaccagcacttgtgggctggtttggccacgaactttcgacccgctttaagatggacaacaagctgcaactcatccctggagtgtgtggatttcgcatctccaatcctccaattcttttggtgtgtagcctgcacgcttcgctggagatctttaaacaagcaaccatgaaggcacttcgtaagaagtccgtcctcctcactggttatctggaataccttatcaagcataactacgggaaggataaggcggcgaccaaaaagccagtggttaacattatcactccttcccatgttgaagagcgggggtgccagctgactatcactttcagcgtgcctaacaaggatgttttccaagagctcgaaaaacggggagtcgtctgtgacaagcggaatcctaatggtatcagagtggcaccagtccctttgtacaactcatttcacgatgtctacaagtttactaatctgctgacttcaatactggactcggcagaaaccaagaat

SEQ ID NO: 31867 - DNA, 1395 bp, Artificial Sequence
  Description of Artificial Sequence: Synthetic coding sequence
atggagccctccagtcttgaactcccagctgacacagtgcagcggatcgcggcggaattgaaatgccacccaaccgatgagagagttgccctgcacctggacgaggaggataagctccggcatttccgagagtgtttctatatcccaaaaatccaggacttgcctcctgtagacctgagcctagtgaataaggacgaaaacgcaatctacttcctcggcaattccctcgggctccagccaaaaatggtaaagacttacctggaagaagaattagataaatgggccaaaatagccgcttacgggcatgaggtgggcaaaaggccgtggatcaccggggacgagtctatcgtcggattgatgaaagacatcgtgggagctaacgaaaaagaaatcgctctcatgaacgccctgacagtcaaccttcacctcttgatgctctccttcttcaagcccactcctaagcgttacaagattctattggaagcaaaagcgttcccaagcgatcactacgcgattgagtcacagctacagctgcatgggttaaacatcgaagaatccatgaggatgattaagcccagagagggggaagagaccttaagaattgaggacatcctggaagtgatcgagaaagaaggcgactccatcgcggtgatcctcttctcaggggtgcatttctataccggacaacatttcaacattccggcaattactaaggccgggcaggcaaagggctgctacgtgggctttgatcttgctcacgcagtggggaatgtggaactatacctgcacgattggggagtagatttcgcgtgctggtgttcttacaagtatctgaacgccggcgccggcgggatcgctggtgcattcatccatgaaaaacacgcgcacactattaaacccgcactcgtaggatggttcggacatgaactgtccacccggttcaagatggataataagctccagcttatcccaggagtttgcggatttaggatctcaaacccccccatcctcttggtgtgctcccttcacgccagcttggaaatattcaaacaagccactatgaaagcgctgagaaagaagtctgtgctgttgactggctacctcgagtatctgattaaacacaattacggaaaggacaaagcagctaccaaaaagcctgtcgtcaatataatcactccctcacacgtagaagagagaggatgtcagcttacaattaccttctctgttccaaacaaggacgtgtttcaggaactggaaaaacggggagtggtgtgcgacaaaagaaatcctaatgggattagagtagccccagtccctctgtacaactcattccatgacgtatacaaattcactaacctactgacttccattctagattctgcagaaacaaaaaat

SEQ ID NO: 31868 - DNA, 1395 bp, Artificial Sequence
  Description of Artificial Sequence: Synthetic coding sequence
atggagccaagtagtcttgaattaccagcagatacagtacaaagaattgctgctgagttgaagtgtcatccaaccgatgaaagagtagcacttcatttagatgaagaagataaacttcgtcatttcagagaatgtttttatattccaaaaatccaagatttgccaccagttgacttatcattagtaaacaaggatgaaaatgctatttattttttaggaaatagtttaggtttacaaccaaagatggttaaaacatatttagaagaagaattagataaatgggcaaaaattgccgcttatggacatgaagttggtaaaagaccatggattacaggagatgaatcaatagttggacttatgaaagatattgtaggtgcaaatgaaaaagaaatcgctcttatgaatgcattaacagttaaccttcacttgttaatgttaagtttttttaagccaacaccaaaaagatataagatcttattagaggcaaaggcatttccatcagatcattacgctattgaatctcaacttcaattgcatggattaaatattgaagagagtatgagaatgattaaaccacgagaaggagaagaaactttaaggattgaggatatacttgaagtcattgaaaaagaaggagattcaatagcagttattttattttctggagttcatttttatacgggtcaacattttaatattccagcaataacaaaggctggacaagcaaaaggatgttatgttggatttgatttagcacatgctgttgggaatgttgaattatatcttcatgattggggagtagattttgcatgttggtgttcatataagtatttaaatgctggagcaggaggaattgcaggtgcttttattcatgaaaaacatgcacatactattaaaccagcactagtaggttggttcggacatgagcttagtactcgatttaagatggacaataagctacaattaattccaggagtttgtggatttcgaatctctaatcctcctattcttttagtttgcagtttacatgcttcgcttgaaatttttaaacaagctacaatgaaagcattaagaaaaaaatcagtattattaactggttatcttgaatatttaataaaacataattatggaaaagataaagctgcaacaaaaaaaccagtagtcaatattataacaccaagtcatgtagaagaaagaggatgtcaattaaccattacatttagtgtacctaataaagatgtctttcaagaattagaaaaaagaggagttgtatgtgataagcgtaatccaaatggaattagagttgctccagtaccactttataattcgtttcatgatgtatataagttcacaaaccttttaacttctattttagattcagccgaaacaaaaaat

SEQ ID NO: 31869 - DNA, 1395 bp, Artificial Sequence
  Description of Artificial Sequence: Synthetic coding sequence
atggagccatcttcgctagagctccccgcggacaccgtgcaacgcatcgccgcggagctgaaatgccaccctacagacgagagagtcgcgttgcatctggatgaggaagataaactcagacacttcagggagtgcttctatatacctaagatccaggatcttccccccgtcgatctcagcttggtgaacaaggacgaaaatgccatttacttcctgggaaattccttagggttgcagccaaagatggtgaaaacgtacctggaggaagagctcgataagtgggccaaaattgcagcttatggccacgaggtgggaaagcggccatggatcaccggcgacgagtcaatcgtcggcttaatgaaggatatcgtaggggcaaacgaaaaggagatcgcactgatgaacgctctcaccgtgaacttacatttgttaatgctgtctttctttaagccaaccccaaaacggtataagattctgttggaagccaaagcattcccatcagaccactatgctatagagagtcagctacagctccatgggcttaacatagaggagtcaatgagaatgataaagcctcgagagggcgaggaaactcttcgcatagaggatatactggaggtgatcgagaaggaaggtgactcaattgctgtgatactgtttagcggcgttcatttctacaccggccagcatttcaatatcccagcaatcacaaaggccggacaggcgaagggatgctacgtgggttttgatctggcccacgccgtcgggaacgtggaactgtatttgcacgactggggggtagattttgcctgctggtgttcctacaaatacctaaacgccggagccgggggaatcgctggggctttcattcatgagaagcacgcacacaccatcaagccagcgctggtcggctggtttggccatgagctgtcaacaagattcaagatggacaacaaactccagttaattcccggtgtctgtggctttagaatctcaaaccctcctatcctactggtttgtagcctgcacgctagcctagaaattttcaagcaggctacaatgaaggccctgcggaaaaagagcgtgctgctgaccggctatctcgaatatctgataaagcataattacggaaaagacaaagcagccacaaagaagcctgtggttaatataattactccctctcacgtagaagagaggggctgccagcttactatcaccttctcggtgcccaataaggacgtttttcaggaattggagaagcgtggggtagtttgcgacaagaggaatccaaatggaattcgtgtggcacctgtccccctctacaacagcttccacgacgtgtataagttcaccaatctcctgaccagtatcttggattctgcagaaacaaagaac

SEQ ID NO: 31870 - DNA, 1395 bp, Artificial Sequence
  Description of Artificial Sequence: Synthetic coding sequence
atggaaccaagtagtctcgagttgccagcagacaccgttcagcggattgccgctgagcttaagtgtcatcctacagacgaacgcgtcgcccttcacctggatgaggaagacaaactccgacacttcagggagtgtttttatattcccaagatccaggatctgccacccgtggatctgagccttgttaataaggacgaaaatgctatttatttcctgggtaattccctcggtcttcaacccaaaatggtgaaaacctacctggaggaagagctcgataagtgggcaaaaatcgcggcctacggacacgaagtgggcaaaagaccctggattacaggggacgagagtatagtgggcctgatgaaagacatcgtcggagcaaacgagaaagaaatcgctctgatgaacgctctgaccgttaatctgcatctgcttatgctgtctttctttaagcctacgcctaaacgctacaaaatattgctcgaggcgaaagcgtttccgagcgaccattatgctatcgagtcccagctgcagctgcatggtctcaacatagaggagtctatgcgcatgatcaaacctcgggaaggtgaggaaaccctgaggattgaagacatactcgaggtgatagagaaagaaggcgactccatagcagtgatcctgttcagcggcgtgcatttttacaccggccaacatttcaatatccccgccattaccaaggcagggcaggctaaaggatgctacgtggggttcgatcttgctcacgctgtggggaatgtcgaactgtacctccacgattggggcgtcgactttgcctgctggtgttcctacaagtatctgaacgcaggtgctggcgggatagccggtgcttttatccatgagaaacacgcccacacaataaagcccgcacttgtgggatggtttggtcacgaactgtcaaccaggtttaagatggacaacaaactgcaattgattcctggagtctgcggcttccgaatctctaatcctccaattttgctggtgtgttctctccacgcatccctggagatcttcaagcaggctactatgaaggcccttaggaaaaaatcagtactcctgacaggctacctggagtacctcatcaagcacaattacggcaaggacaaagcagccactaagaaacccgtcgtgaacattataactccgagtcacgtggaggaacggggatgtcagcttactatcacattctcagtacccaataaagatgttttccaggagctcgagaagaggggtgtggtttgtgataaaagaaacccaaacggaattagagtggcaccggtgcccttgtacaacagtttccatgacgtatacaagtttaccaaccttctgaccagcatccttgactctgctgagactaaaaat

SEQ ID NO: 31871 - DNA, 1395 bp, Artificial Sequence
  Description of Artificial Sequence: Synthetic coding sequence
atggagccaagctcattggaattgcctgctgacacggtgcaacgcatcgccgccgagctgaagtgccacccgaccgatgagcgggtggccctccacctggatgaagaagataagttgagacatttccgggagtgtttttacattccaaagatccaagatctgccaccagtggatctctcgctggtgaacaaggatgaaaatgcaatctactttctgggaaactcgctcggacttcagcctaagatggtcaagacctaccttgaagaagagctcgataagtgggctaagattgcagcttacggacatgaagtgggcaaaagaccgtggattactggagacgaatccatcgtgggcctgatgaaagatatcgtgggagcaaatgaaaaggagattgcacttatgaacgcacttaccgtcaatcttcatctcctgatgctcagctttttcaaacctactccaaagcggtacaaaattcttcttgaagcgaaggcattcccttcggatcattacgccatcgaatcgcagctgcagcttcacggactgaacatcgaagaatcaatgcggatgattaagccccgggagggtgaagaaaccctgcgaatcgaggacatcctcgaagtcattgaaaaagaaggcgatagcattgcggtcatacttttcagcggagtgcatttctacaccggacagcactttaacattcccgcaattactaaggctggacaagccaaggggtgttatgtgggatttgatcttgcgcacgcagtgggcaacgtggagctgtacctgcacgattggggagtggattttgcttgctggtgttcgtacaaatacctgaatgccggtgcaggaggtattgccggagcatttatccatgaaaaacatgctcataccatcaagccggcactggtgggctggttcggacatgaattgtcaaccagattcaagatggacaacaaactccagctgataccgggtgtgtgtggctttagaatttccaaccctccgatacttctggtgtgttcgcttcatgcatccctggaaatctttaagcaggccactatgaaagctctccggaagaagagcgtcctcctgaccgggtaccttgagtacctgattaaacacaactacggaaaggacaaggccgcaaccaaaaagcctgtggtcaacattatcaccccctcacacgtggaagagaggggttgtcagctcaccattactttttctgtcccgaacaaagacgtgttccaggaacttgaaaagcgaggtgttgtgtgtgacaaacgtaatccaaatggtattagagtggcaccagtgcccctgtacaatagcttccatgatgtttacaagtttactaatctgctgacttcgattcttgacagcgccgaaaccaaaaac

SEQ ID NO: 31872 - DNA, 1395 bp, Artificial Sequence
  Description of Artificial Sequence: Synthetic coding sequence
atggagccctccagtctcgagcttcctgcggatactgtgcagaggattgcggccgaactgaaatgtcatcctactgacgaacgagtcgccctacacttggatgaagaagacaaactccgccattttagagagtgtttctatatcccaaagatccaggacctgcctcctgtggacctgagtctagttaataaggacgagaacgccatctattttttaggaaactctttagggttgcagcctaaaatggtaaagacctacctcgaggaagaactggacaaatgggctaagatcgcggcctatggacacgaagtaggcaagaggccatggattactggagatgagtcgatcgtagggttaatgaaggatatcgttggcgcaaacgagaaagagatcgccctgatgaatgccctgacagtgaacctgcaccttctcatgttaagcttcttcaagcccacgcctaaacggtacaaaattctcttggaagctaaggcatttcccagcgaccactatgccatagaaagtcagctgcagttacacggtttgaatatcgaggaatcaatgcggatgatcaagcctcgggagggagaggagacccttcgcatcgaggacatcttggaggttatcgaaaaagagggggattccattgctgtaattctgtttagtggcgtgcacttctatacagggcagcacttcaatattcctgcgattaccaaggccggtcaggcgaagggttgctacgtggggtttgaccttgcgcatgctgtgggcaacgtggagctatatcttcacgactggggcgtggactttgcatgctggtgcagttataagtaccttaacgccggggcagggggcattgcaggagcttttatccacgagaagcacgcccatacgataaaacccgccctagtaggctggttcgggcacgaacttagtacaagatttaagatggataacaagctgcagctgatcccaggcgtgtgtgggttcagaataagcaaccctcccatcctgctggtatgctccctgcacgcctccctagagatcttcaaacaggccacaatgaaagcactgcggaaaaaatctgtgttgctcactggatacctagaatacctcattaagcacaattatgggaaagacaaggctgccactaagaaacctgtagtaaacatcatcaccccaagccacgttgaagagagaggctgtcagctgactattactttttctgtcccaaacaaggatgtttttcaggaattggagaagaggggggtggtgtgtgacaagagaaatccgaatgggattcgcgtggctcccgtgccactctacaatagttttcacgacgtgtacaaattcactaacctcctgacaagcatacttgattctgccgagaccaagaac

SEQ ID NO: 31873 - DNA, 1395 bp, Artificial Sequence
  Description of Artificial Sequence: Synthetic coding sequence
atggagccaagctccctggaactgccagccgacactgtccagcggatcgctgcggagcttaaatgccacccgaccgacgaaagggtcgcactgcacctggacgaggaagataaactccgccatttccgggagtgcttttacatccccaaaatccaggaccttccacctgtggacctgtccctggtcaataaggacgaaaacgccatttactttctgggaaattccttgggactgcaaccgaagatggtcaaaacctacctggaggaagagctggataagtgggccaagatcgccgcctacggtcatgaggtcggaaagcgcccgtggatcaccggagatgagagcatcgtcggactgatgaaagacatcgtgggagcaaatgaaaaggagatagcacttatgaatgccctcactgtgaacctgcaccttcttatgctctcctttttcaagccgactcctaagcggtacaagatccttctcgaagcgaaagccttcccaagcgaccattacgcgatcgaatcgcaactgcagctgcacggcctgaacatcgaggaatcgatgcgcatgatcaagccacgcgaaggcgaagaaactctccgaatcgaagatatcctcgaagtgatcgagaaggagggagacagcatcgctgtgatcctgttcagcggcgtgcacttctataccggccagcactttaacatcccagccattactaaagccggtcaagctaaaggatgctacgtcggctttgacctggcccacgccgttggcaacgtggagctctacctgcacgactggggcgtggacttcgcatgctggtgttcctacaaatacttgaacgcgggagccggcggcatcgccggcgccttcatccacgaaaagcacgcccacaccatcaagccagctctggtgggatggtttggacatgagttgtcaactcgcttcaaaatggacaacaaactccagctcatccctggagtttgtggttttcgcatctcaaatccgccgatccttctcgtgtgctccctgcatgcgtcgctcgaaatcttcaaacaggccactatgaaggccctcagaaagaaaagcgtgttgctcaccggctacctggagtacctgattaagcacaattacggaaaggataaggcggcgaccaagaaacctgtggtgaacatcatcactccgtcccacgtcgaggaaagaggatgccagctgactatcaccttctccgtgcccaacaaggacgtctttcaggaactggagaagcggggagtcgtctgcgataagcgcaatccgaacggaatccgggtggcgcccgtgccactgtacaatagctttcacgatgtgtacaagtttactaatctccttacctccattcttgacagcgcagagacgaagaac

SEQ ID NO: 31874 - DNA, 1395 bp, Artificial Sequence
  Description of Artificial Sequence: Synthetic coding sequence
atggagccaagttcgctggagctaccagcagatacagtgcaaaggatcgctgccgagttaaagtgtcatcccacagacgagcgggtggcccttcacctggacgaggaagataaactacgtcatttccgggagtgtttttatatccctaaaatccaagacctaccccccgtggatcttagtttggtgaataaggacgagaatgctatttattttctggggaactctttgggactccagcctaaaatggtgaagacatacctagaagaggaattggataagtgggctaagattgcagcttatggtcacgaggtgggaaagagaccttggattacaggggatgaaagcatagttggcctcatgaaggacattgttggcgccaacgaaaaggagatcgctctcatgaatgctttaacggtgaacctccatctgcttatgctgagcttcttcaagccgacccccaaacggtacaaaattctgctggaggccaaagctttccctagcgaccactacgctattgaatcacagctgcagctgcatggattgaacattgaagaaagtatgagaatgattaaacctagggaaggcgaggagaccctcagaatagaggatattctggaggttatcgagaaagagggagactcaatagccgtaatcctgttctcgggggtacacttctataccggccaacattttaacatccctgctatcaccaaagctggtcaggccaaaggctgctatgtgggattcgacttagcccatgccgtggggaacgtggaactctacttgcacgactggggggtggacttcgcgtgttggtgcagttataaatatcttaacgcaggggcgggcggaatcgccggcgcattcatccatgagaagcacgctcataccatcaaaccggccttggtgggatggttcgggcacgaactgtcgaccaggttcaaaatggataacaaactgcagctcattcctggcgtgtgcggatttcgcatctccaatccaccgatcctcttggtgtgtagcctgcatgcatctctggagatcttcaaacaggccacgatgaaagctctgcggaagaagtcagtgctcctaacgggctatctggagtaccttatcaagcacaactatggcaaagacaaggctgccactaaaaaaccggtcgtcaacatcataacgccctctcatgtggaggagcgggggtgccagttaactatcaccttctccgtccctaataaggacgtcttccaggaactggaaaagaggggtgttgtctgtgataagaggaatcccaatggaattcgagttgcgcccgtccccctgtacaatagtttccatgatgtgtataagtttacaaacctgctgacgtcaatactggacagtgccgagaccaaaaac

SEQ ID NO: 31875 - DNA, 1395 bp, Artificial Sequence
  Description of Artificial Sequence: Synthetic coding sequence
atggagcccagctctctggagctcccagcagatacagtgcagaggatagctgccgaactgaagtgccacccaactgacgagcgagtggctctccacctggatgaggaggacaagctgagacactttcgggaatgcttctatatccccaagatacaggacctcccccctgttgacctgagcctagtaaataaagacgagaatgcaatctacttcctcgggaactcccttggcctgcagcccaaaatggtaaaaacttacctcgaggaagagctcgacaagtgggcaaagatcgccgcatacggacacgaagtgggcaagcgcccctggatcacgggcgacgaatctatcgtggggcttatgaaggacatagtgggcgcgaatgagaaggaaattgctctcatgaatgctctgacggtgaatctgcatctcttgatgctctccttctttaaacccaccccaaagcgctacaagatattgctggaagccaaagcctttccctcagatcactatgcaatcgaaagtcagctgcagttacacgggctgaatatcgaggaatcgatgcgaatgattaagcctagggagggggaagagacgctccgcatcgaagacattctggaagtcattgagaaggagggagattctatcgccgtgatccttttctctggcgttcacttttatacaggccagcatttcaatattccggccatcacgaaggccggacaggctaagggctgttacgtcggcttcgatctcgctcatgcagttgggaacgtcgagctgtatctacacgactggggagtagatttcgcctgttggtgctcctacaagtatctgaacgcaggtgcgggcggtatcgccggcgcatttattcacgagaaacacgctcacaccattaagcctgctctcgtaggctggttcggtcacgaactctctacaaggttcaagatggataacaagctgcagcttattccaggagtgtgtggcttccgcatttctaacccacctattctgcttgtatgctcccttcacgcctccttggagatttttaagcaagccactatgaaggctctgcgtaaaaaatctgtgctgcttaccgggtacctggaatacctgataaagcacaactatggaaaagacaaagccgccactaagaagcctgtggttaacatcatcaccccttctcatgtggaggagagaggatgccagctgacaataacctttagtgtacccaacaaggacgtcttccaggaattagagaaacgtggagtcgtgtgcgataagaggaaccctaacggtatccgggtagcacctgttcctttgtataattccttccatgacgtgtacaagttcactaacctgcttacatccatactggattcggccgagacaaagaat

SEQ ID NO: 31876 - DNA, 1395 bp, Artificial Sequence
  Description of Artificial Sequence: Synthetic coding sequence
atggaaccgtccagcctcgaactgcctgcagacaccgtgcaacggatcgcagccgagttgaagtgtcatcctaccgacgaacgggtggcactgcacctggacgaggaagataagctgcgccactttcgcgagtgtttctacattcctaagattcaagatctgccaccggttgatctgtcgctggtcaataaggacgaaaacgcaatttactttctgggaaactccctgggcctccagcctaagatggtcaagacgtaccttgaggaagagctcgacaaatgggccaagattgccgcatacggtcatgaagtcggaaaacgcccttggattaccggtgatgaatcaattgtgggactcatgaaggatatagtgggagcgaatgagaaggaaatcgccctgatgaacgcactgaccgtcaaccttcatcttctgatgctctcctttttcaagccaactcccaagagatataagattttgctggaggcaaaagcattcccatccgaccactacgccattgaatcccaactgcagcttcacggcttgaatatcgaagagtcgatgagaatgattaagccccgggaaggggaggaaaccttgagaatcgaggatattctcgaagtgattgaaaaggaaggagattccattgcagtgatcctgttttccggagtccatttctacactgggcaacatttcaatattcctgccattactaaggccggccaggcaaagggatgttacgtcggtttcgatcttgcgcacgcagtgggaaacgtggagctctacctccacgactggggcgtggatttcgcttgctggtgttcgtacaagtacctgaatgcaggagcaggcggaatagccggcgcctttatccacgaaaagcacgcccatactatcaaacccgcgctggtcggatggtttgggcatgaactttccactagatttaagatggacaataaactgcagcttattcctggggtgtgtggtttcagaatctctaaccccccaatattgctggtctgttcgctccatgcttccctcgagatattcaaacaagcaaccatgaaagcacttcgaaagaagtccgtccttctgacgggatacctggaatacctgataaagcacaattacggaaaagataaagcagcaaccaaaaagcctgtcgtgaacatcatcactccttcccacgtggaagaacggggatgccagcttaccatcactttttcagtccctaataaggacgtctttcaagaactcgagaagagaggggttgtttgtgacaagaggaaccctaatggaatcagagtggcacctgtgcccttgtacaacagttttcatgatgtgtacaagtttaccaatcttctgacttcgattcttgacagcgcagaaacgaagaat

SEQ ID NO: 31877 - DNA, 1395 bp, Artificial Sequence
  Description of Artificial Sequence: Synthetic coding sequence
atggaaccgtcgtcgctagaactaccggcggatacggtacaacgaatagcggcggaattaaaatgtcatccgacggatgaacgtgtagcgttacatctagatgaagaagataaactacgacattttcgtgaatgtttttatataccgaaaatacaagatttaccgccggttgatctatcgttagtaaataaagatgaaaatgcgatatattttttaggtaattcgttaggtctacaaccgaaaatggtaaaaacgtatttagaagaagaactagataaatgggcgaaaatagcggcgtatggtcatgaagtaggtaaacgtccgtggataacgggtgatgaatcgatagttggtttaatgaaagatatagttggtgcgaatgaaaaagaaatagcgctaatgaatgcgttaacggtaaatctacatctattaatgttatcgttttttaaaccgacgccgaaacgatataaaatactactagaagcgaaagcgtttccgtcggatcattatgcgatagaatcgcaactacaattacatggtttaaatatagaagaatcgatgcgaatgataaaaccgcgtgaaggtgaagaaacgttacgtatagaagatatactagaagtaatagaaaaagaaggtgattcgatagcggtaatactattttcgggtgtacatttttatacgggtcaacattttaatataccggcgataacgaaagcgggtcaagcgaaaggttgttatgtaggttttgatctagcgcatgcggtaggtaatgtagaactatatttacatgattggggtgttgattttgcgtgttggtgttcgtataaatatttaaatgcgggtgcgggtggtatagcgggtgcgtttatacatgaaaaacatgcgcatacgataaaaccggcgttagttggttggtttggtcatgaactatcgacgcgatttaaaatggataataaactacaactaataccgggtgtttgtggttttcgaatatcgaatccgccgatattattagtttgttcgttacatgcgtcgttagaaatatttaaacaagcgacgatgaaagcgttacgtaaaaaatcggtactactaacgggttatttagaatatttaataaaacataattatggtaaagataaagcggcgacgaaaaaaccggtagtaaatataataacgccgtcgcatgttgaagaacgtggttgtcaattaacgataacgttttcggtaccgaataaagatgtatttcaagaactagaaaaacgtggtgttgtttgtgataaacgaaatccgaatggtatacgtgttgcgccggtaccgttatataattcgtttcatgatgtatataaatttacgaatctattaacgtcgatactagattcggcggaaacgaaaaat

SEQ ID NO: 31878 - DNA, 1395 bp, Artificial Sequence
  Description of Artificial Sequence: Synthetic coding sequence
atggaaccgagttccctcgagcttccagcagacacagtccagagaatcgctgcggagcttaaatgccaccccactgatgaacgggtggcgctgcatttggatgaggaagataagttgcggcacttccgcgaatgcttctacattcctaaaattcaggatctaccacccgtcgacctctcactggtgaataaggacgaaaacgcaatatattttctaggtaactcgctcggtcttcagcctaagatggttaaaacctatcttgaagaggaactagataaatgggctaagatcgccgcatacggtcacgaggttggtaaacgaccttggattacgggcgacgagtccattgtggggctgatgaaagacatcgtgggggcgaatgagaaggagatcgcattgatgaacgctcttaccgtgaacttgcacctgctaatgctgtcgttctttaagccgacccctaagcgatataagatcctgctggaagccaaagccttcccatccgaccactacgctatcgagtcgcagctccagctacatggactcaatattgaggagtcaatgagaatgatcaaaccacgggagggagaggagactctccgcattgaggatattctcgaagtgatcgagaaagaaggggacagcattgccgtaatactcttctccggggtgcacttctacacaggccagcatttcaacatcccggcaatcacgaaggccggccaggcaaaaggatgctatgtgggctttgacctggcccatgctgtgggcaatgtggagctgtatctccacgactggggcgtggatttcgcatgctggtgctcttataaatatctgaacgccggagctggtgggattgcgggcgctttcatccacgaaaagcacgctcacaccatcaagcctgccctcgtcggctggttcgggcacgagctgagtacgcggttcaaaatggataacaaactgcagctaattcccggcgtgtgcggtttccggattagtaaccccccaattctgttggtgtgcagtctacacgctagcctcgaaatatttaaacaggctacaatgaaagccctacgaaagaagtctgtgctgttaaccggctacctagagtacctgattaagcataattatggtaaggacaaagccgctacaaaaaagcctgtagtcaacataattactcctagtcatgtggaagagagggggtgtcaactgacaatcacattttccgtacctaataaagacgttttccaggaactggagaaacgcggtgtggtctgtgataaacggaatcccaatggaatcagagtggcccctgttcccctgtacaactcattccatgatgtgtacaagttcacaaatttattgacatccatcctagattccgccgaaaccaagaat

SEQ ID NO: 31879 - DNA, 1395 bp, Artificial Sequence
  Description of Artificial Sequence: Synthetic coding sequence
atggagccgagttctcttgagctcccagccgacacagttcagcgtattgccgctgaacttaagtgccaccccacggatgagagggtggcccttcatctggatgaagaagacaagttgaggcacttccgcgaatgcttttacattccaaagattcaggatctccctcccgtggacttgagtttagtgaacaaggatgagaatgccatatacttccttggaaatagcctcggcttacagccaaagatggtcaaaacctacctggaggaggagctggacaagtgggcaaaaatcgccgcctacggccatgaggttggaaaaaggccgtggatcaccggagacgagagcattgtcggccttatgaaagacatcgttggcgccaacgaaaaagagatcgctttgatgaatgctctgacagtgaatctgcacctcctgatgctatctttttttaagcctactcctaagcggtacaaaatactgcttgaggccaaggcctttccctcagatcactatgcgattgagagccagttacaattgcatggactgaacatcgaggagagcatgcggatgatcaagccacgggagggtgaggaaacgttgagaattgaggatatcttagaggttatcgagaaggagggggactcgattgccgtcatccttttctcaggggtacacttctacacaggtcagcattttaatataccggccataaccaaggccggtcaggcaaaggggtgctacgttggtttcgacctagcccacgccgtcggcaacgtggagctctacctgcacgattggggcgtagactttgcatgctggtgtagctacaagtacttaaacgcaggtgccgggggcattgccggcgccttcatccatgaaaaacacgcccacaccatcaagccagctttagttggctggtttggtcatgagcttagtaccagatttaagatggacaacaaattacagcttataccaggagtgtgtggttttcgaatttctaatcctcccatactccttgtttgcagcctgcacgccagcctggagattttcaagcaggccaccatgaaagccctgcgaaagaagtcagtgttgctgactggttacctggagtacctgatcaagcataattatggaaaagataaggccgcaaccaagaaaccagtggttaatattataacgccctcccacgtcgaggaacgcggctgccagctcacaattactttttcggtgcccaacaaggacgtgttccaggagctggagaaaagaggtgtcgtgtgcgacaagcgcaacccaaatggaatccgcgtggcccccgttcccctctacaactcctttcacgatgtgtacaaattcacaaacctgctaacaagtattttggactcagctgagaccaagaat

SEQ ID NO: 31880 - DNA, 1395 bp, Artificial Sequence
  Description of Artificial Sequence: Synthetic coding sequence
atggagccttcatcgcttgaactgcccgctgatactgtccaacgcatagccgctgagctgaagtgtcaccccactgacgagcgcgtggccctgcacctggatgaggaggataagttgcgacacttccgcgagtgcttctacatccccaagatccaagacctgccgccggtcgacctctcgcttgtcaataaggacgagaacgcaatttacttcctaggcaactctctgggactgcagccgaagatggtgaaaacgtacctcgaagaagagctggacaagtgggccaagatcgccgcctacggacatgaggtcggtaagcgcccctggatcactggtgacgaaagcattgtggggctcatgaaggatattgtaggagccaacgagaaggagatcgccctcatgaacgccctcaccgttaacctgcatttgctgatgctgagcttcttcaagcccaccccaaagcggtacaaaatcttattggaagctaaggcctttccctctgatcactacgctatcgagtctcagttgcagctgcacggcttgaacatcgaagagtccatgaggatgataaagccccgtgagggtgaggagacccttcgcattgaggacatcctggaggtcatcgagaaagaaggtgactccattgcggtcatattgttctctggtgtccatttctacacgggtcagcacttcaacatccccgcaatcaccaaggctggccaggctaaaggatgctatgtgggcttcgaccttgcgcatgccgtgggtaatgtggagctctatctgcacgattggggcgtcgacttcgcctgctggtgttcttacaagtatctcaacgctggtgccggcggaattgcgggtgcgttcattcacgagaagcatgcgcacactatcaagccggccctggtgggatggttcggccacgagttgagcacgcgcttcaagatggataacaaactccagttgataccgggcgtgtgtggcttccgcatctcgaacccccccattctcctcgtctgtagtctccacgcctcgctcgagatcttcaaacaagccactatgaaggcccttcgcaagaagtctgtgctgttgaccggttacctcgaatacctcatcaaacacaactacggaaaggacaaagccgccacgaagaaacccgtggtgaacataattaccccctctcatgtggaggagcgcggctgccagttgaccatcactttctccgtgcccaataaggacgttttccaagagctagagaagaggggagtagtatgcgataaacgtaatccgaacggaattcgcgttgcacccgttccgttgtacaacagcttccacgacgtctacaagttcaccaatcttttgaccagcatcctggattccgccgagaccaagaac

SEQ ID NO: 31881 - DNA, 1395 bp, Artificial Sequence
  Description of Artificial Sequence: Synthetic coding sequence
atggagcccagcagcctggaactgcccgcagacacagtacagcggatcgccgccgagcttaagtgccatcctacagacgaacgcgtcgccctacatctagatgaggaagacaagcttaggcactttagggaatgcttctatatcccaaagattcaggatttacctcctgttgatctctccctcgtgaacaaggatgagaacgctatctacttcctcgggaactcccttggcctccagcctaagatggtgaagacttatctcgaagaagaacttgacaagtgggcaaagatcgccgcttatggacacgaagtcgggaagaggccttggatcacaggggacgagagtatagtcggcctgatgaaggatatcgttggagccaacgagaaggaaattgcacttatgaatgctctcactgtgaatttgcacttacttatgctttctttttttaaaccaactccaaaacggtacaagatcctactcgaggcgaaggctttcccgtcagaccattacgctattgagagccaactgcagctgcacggtctgaacattgaggaaagtatgagaatgatcaagcccagagagggggaagagactctgagaatcgaggacatcctggaggttatagagaaggaaggagattctatcgcagtgatcctttttagcggcgtacacttctacaccggccaacacttcaatattcctgcaattactaaggctggtcaggccaagggatgttacgttggatttgacctggcacacgctgtcgggaatgtagagctctaccttcatgactggggggttgactttgcttgctggtgctcctataaatatctcaatgccggtgctggcggcatagccggtgccttcatccacgagaaacatgcccacacgataaagccggccctcgttgggtggttcggccacgagcttagcaccaggttcaagatggacaataagctgcaactcatcccaggtgtgtgtggctttaggatcagtaacccgcctatcctgctggtgtgtagcctgcatgcaagcttggaaattttcaagcaggctacaatgaaagcccttcggaagaagagcgtccttcttaccgggtacctggaatatttgatcaaacataattatggaaaggacaaggctgctaccaaaaagcccgtagtgaatatcatcacacccagccatgtggaggagcgaggatgccagctcacaattacgttctcagttcccaacaaagacgtttttcaggagctagagaagagaggtgtcgtgtgcgataagaggaacccaaacggcatcagggtcgcacctgtacctttgtacaactcttttcacgatgtctataagttcacaaacttactgacctccatcctagactccgctgaaacgaaaaac

SEQ ID NO: 31882 - DNA, 1395 bp, Artificial Sequence
  Description of Artificial Sequence: Synthetic coding sequence
atggagccttcgtcgctggagcttcctgctgacaccgtccaaagaatcgccgctgaactgaagtgtcatccgacggatgaaagagtggccctccatctcgatgaagaagataagttgcgccacttcagggaatgtttctacattcctaagatccaggatctgccccccgtggatctctctcttgtgaataaggatgagaacgctatctactttctgggcaactccctcggacttcagccgaaaatggtcaagacctatttggaggaagagctggacaagtgggcaaagattgcagcatacggccatgaagtgggaaaaagaccgtggattacgggtgatgagtccattgtgggccttatgaaagacatcgtgggtgccaatgagaaggagattgcgcttatgaatgccctgaccgtgaatctgcacttgctgatgctgtcatttttcaagcctactcctaaacgctacaaaattcttcttgaggcaaaggcgtttccctcagaccattacgcaatagaaagccaactccaactgcacggactgaacattgaggagtcaatgagaatgatcaagcctagggagggcgaagaaactcttcggatagaagatattcttgaagtcattgaaaaagaaggcgatagcattgccgtcattctgttctcgggggtgcatttctacactggtcaacatttcaacattcctgcaataacgaaagctggacaagcaaagggttgttacgtggggtttgatttggctcatgcagtgggtaatgtggaattgtatcttcacgattggggagtcgatttcgcgtgttggtgttcctacaagtatctgaacgctggagctggaggcatcgccggtgcctttatacatgagaaacacgcacatactataaagccagcacttgttggctggtttggtcacgaactttctactcgttttaagatggacaataagctgcagttgatcccaggagtctgcggttttagaatcagcaacccaccaattttgctcgtgtgctcgctgcacgcctcgctggagatcttcaagcaggcaactatgaaggcactccgcaagaagtccgtgctgttgaccggatacctggaatacctgattaaacataactacgggaaagacaaggcagcgaccaagaagccagtggttaacattatcactcccagccatgtcgaagaacggggatgtcaattgaccattaccttttcggtgcccaacaaggacgtgttccaggaacttgagaagcggggggtggtgtgcgacaaaaggaatccaaacggtatacgagtcgcaccagtgcccctttacaactcgtttcatgacgtgtacaagtttaccaaccttcttacctccatcctggattctgcggaaaccaagaac

SEQ ID NO: 31883 - DNA, 1395 bp, Artificial Sequence
  Description of Artificial Sequence: Synthetic coding sequence
atggagccttcctcgctcgaactccctgcagacaccgtccaaaggattgcagcggaactcaagtgccaccctaccgacgaaagagtggcacttcatctcgatgaagaggataagctgaggcacttcagagagtgcttctatatccctaagattcaagatctccctcccgtggatttgtctttggtcaataaggatgaaaatgcaatttactttttggggaacagcctgggccttcagcccaagatggtcaagacgtaccttgaagaagaattggataaatgggccaagattgcagcctacgggcatgaagtgggtaagcgtccatggatcaccggagacgaaagcatcgtgggacttatgaaggacatagtgggagctaacgagaaggagattgcccttatgaacgccctcaccgtgaacctgcacctccttatgctttcctttttcaagccaactcccaagaggtataagatccttctggaagcaaaggcgttccccagcgaccactacgccatcgagtcgcaacttcaacttcatggactgaacatcgaggagtcaatgcgcatgattaagccaagggagggagaagaaaccctcagaattgaggatatactggaagtgattgagaaggagggagatagcattgctgtgattcttttttcaggggtccacttttacaccggtcaacactttaacattcccgcgattacgaaggcaggacaagccaagggttgctacgtggggttcgacctggcccatgcagtgggtaacgtcgagctgtaccttcacgattggggggtcgatttcgcatgttggtgttcatacaagtacttgaacgcaggtgccggaggaatagccggtgcctttatccatgaaaagcatgcacacactatcaaacctgcacttgtggggtggtttggacatgagctgagcactagatttaagatggataacaagctccagcttataccaggcgtctgtggattcagaatttcgaacccgcccattctccttgtttgttccttgcatgcttccctcgaaatctttaagcaggcaactatgaaagccctgcgtaagaagagcgtgctgctgaccggttacctggaatacttgatcaaacacaattacggaaaagacaaggccgcaacgaagaaaccagtcgtgaatatcataaccccgtcgcacgtggaggagcgcggatgtcagctcactattaccttttccgtccctaacaaagacgtttttcaggagctggaaaagcgtggagtcgtgtgtgacaaacggaaccctaacggtattagagtcgccccagttcctctctacaactcctttcatgacgtgtacaagtttaccaacctgctcaccagcattttggattcggcagaaactaagaac

SEQ ID NO: 31884 - DNA, 1395 bp, Artificial Sequence
  Description of Artificial Sequence: Synthetic coding sequence
atggaaccgtcgtctctggaacttccggccgacactgtccagaggatcgccgccgagctgaagtgccacccaaccgacgagcgcgtggccctgcatcttgacgaggaggacaagctgaggcatttcagggaatgcttctacatccctaagatccaagaccttccgcctgtggatctttccttggtgaataaagacgaaaacgcgatctacttcctggggaatagcctgggactgcagcccaaaatggtaaagacctacctggaagaagaattggacaaatgggcgaagattgcagcgtacgggcatgaagtgggcaagaggccttggatcaccggggacgaaagcattgttggcctgatgaaggatatcgtgggggcgaatgagaaagagatcgcactgatgaatgctttgaccgtcaacctgcatctgctgatgctctccttcttcaagccgaccccaaaacggtacaaaatcctgctggaggctaaggcgttcccgtccgatcactacgccatcgaatcccaattgcagctccacgggttgaacatcgaggagagcatgcggatgatcaagccgcgcgagggtgaggaaaccctgcgcatcgaggacatcctggaggtgatcgaaaaggaaggagattcgatcgccgtgatcctcttctcaggagtgcatttctacaccggacagcacttcaacatcccagccatcaccaaggctggtcaagcaaaaggctgctacgtgggattcgatcttgcgcatgcagtcggcaacgtggaactgtacctgcatgattggggcgtggattttgcgtgctggtgctcctacaagtacttgaacgccggcgcgggtggaatcgccggagcgttcatacacgaaaaacacgcacatactatcaaaccggctctggtgggatggttcggacacgagctctcgacccgtttcaagatggataacaagctgcagctgattccgggagtgtgcggttttcgcatcagcaaccctcctatcctcctggtctgttctctccatgcgtcgttggaaatcttcaaacaggccaccatgaaggctctgcggaagaaatcagtgctgctgactggatatttggagtacctgatcaagcacaattacggtaaagacaaggccgccaccaagaagccggtggtcaatatcatcaccccgtcacatgtggaggaaagaggatgccagctgactatcaccttctcagtcccaaacaaagatgtgttccaagaactcgagaagcggggagtcgtctgcgataagcgcaatccgaacggaatccgcgtggccccggtcccactctacaattcgttccatgacgtctataagttcaccaacctgctgacttccattttggactccgctgagactaagaat

SEQ ID NO: 31885 - DNA, 1395 bp, Artificial Sequence
  Description of Artificial Sequence: Synthetic coding sequence
atggagccatcttcactcgagctccctgctgacaccgtgcagcggatcgcagcggagttgaagtgtcatcccaccgacgagcgggtagccctgcatctagacgaggaagataagctccgtcactttcgggagtgtttctacattcctaaaatacaagacctgccaccggtagatctgtctttggtgaataaagatgagaatgccatctacttcctgggcaattctctcggactgcagcccaaaatggtgaagacttacttggaagaggagctggacaagtgggctaagattgccgcatatggccacgaggtcggcaaacgaccctggataacaggggatgagagcatcgtgggattgatgaaggatatcgtaggtgccaacgagaaagaaatcgctctgatgaacgctctcacagtgaatctgcatctgttgatgctgtcgtttttcaaacccacgcccaaacgctacaaaattctattggaggctaaggcattccctagcgaccattacgccattgaatcgcaactccagctgcacggactgaacatagaagagagtatgagaatgatcaagccaagggagggcgaagaaacgctgagaatcgaggatatactggaagtcattgagaaagagggggatagcattgccgtgattctgtttagcggtgtacacttttataccggccagcactttaacatccctgccattactaaagctgggcaggcgaaggggtgttacgtcggcttcgatcttgctcatgccgttgggaacgtggagctctatctccacgactggggcgttgattttgcttgttggtgttcttacaagtatctgaatgccggagcaggaggaatagccggggcctttattcacgagaagcatgcccataccatcaagccagcccttgtgggctggtttggccatgagctgagcacacggtttaaaatggacaacaaactccaactcattcccggggtatgcggattccgcataagtaatccaccgattctgctcgtatgcagtctgcatgcatctctggagatttttaagcaggcaaccatgaaggccctccggaagaaaagcgtcctcttaacaggatatctcgagtacttgatcaaacataactatgggaaagacaaggctgccactaagaaaccagtggtgaacataatcacgcccagtcacgtcgaggagcgcggttgccaactgactatcacattctcagttcctaataaagatgtgttccaggaactggaaaagcggggggtcgtatgcgataagaggaaccccaacggcatccgggtggcaccagtgcccctctataatagcttccatgatgtctataagttcacaaacctgcttacgagcattctcgattcagctgaaactaaaaac

SEQ ID NO: 31886 - DNA, 1395 bp, Artificial Sequence; identical to SEQ ID NO: 31885
  Description of Artificial Sequence: Synthetic coding sequence

SEQ ID NO: 31887 - DNA, 1395 bp, Artificial Sequence
  Description of Artificial Sequence: Synthetic coding sequence
atggaaccatcgtcgctcgaactgccagcagataccgtgcagaggatagcagcagaactcaaatgtcacccaactgacgaaagagtcgcactccacctggatgaagaggataaactgcggcatttcagagagtgtttctacattcctaaaatccaagacctgccgcctgttgatttgagcctggtcaataaggatgaaaatgcaatctattttcttggaaactcccttggcctgcaaccgaagatggtcaaaacttatttggaagaggagttggataagtgggctaagattgcagcatacggtcatgaggttggaaagcgaccctggattaccggcgacgagtcaattgttggactcatgaaggatattgttggtgccaacgaaaaggagattgcccttatgaacgcacttactgtgaacctgcacctgcttatgctttcctttttcaagccaacgcctaagagatacaagatcctgcttgaggcgaaggcattcccttccgatcactacgccatcgaatcgcagctgcaattgcacggccttaacatagaggaatcaatgcgaatgataaaacctcgggaaggtgaggaaactcttagaattgaagatattctggaagtcatcgaaaaagaaggagacagcattgccgtgattctcttctccggagtccacttctataccggacaacactttaacattcccgcaattaccaaggccggccaagcaaaaggctgttacgtgggattcgatctggcacatgccgtgggtaacgttgaactgtaccttcatgattggggggtggactttgcatgctggtgctcctacaagtaccttaatgcgggcgcaggagggatcgcaggggctttcatccatgagaagcacgctcataccataaaacccgcgcttgtgggttggttcggtcatgaactctccaccagatttaagatggacaacaagctgcagctgatacctggagtgtgcggattcaggatctcaaaccccccgattctcctggtctgctcgttgcatgcatcattggagatctttaaacaagcgacgatgaaggcgctgagaaagaagtcagtgttgctcaccggttacctggaatacctgataaaacataactacgggaaggacaaggccgcaaccaagaagccagtcgtgaatatcattacgccatcacatgtggaagaacgcggttgccagcttactatcactttctcggtgcctaataaggacgtgtttcaggaactggaaaaacgaggagtggtgtgtgataaaagaaacccaaatggaatccgtgtggcgcccgtccctctgtacaactcgtttcacgacgtgtacaaattcaccaatcttctgacctcgattcttgatagcgccgagactaaaaac

SEQ ID NO: 31888 - DNA, 1395 bp, Artificial Sequence
  Description of Artificial Sequence: Synthetic coding sequence
atggaaccttcgtcccttgagctgcccgcagataccgtgcaacgaattgcagcagagctgaagtgccatcctactgacgaacgtgtggcattgcacctggacgaagaagataaactgagacatttcagagaatgtttttacattccaaagatccaggatctgccacctgtcgatctttccctcgtgaataaggatgaaaatgcaatttacttccttggtaactcgcttggcctccagcctaaaatggtgaaaacctacctggaggaggaactggataagtgggctaagatagccgcatatggacacgaggtcggtaaacgtccatggataactggtgatgaatcaattgtcggcctcatgaaagacattgtgggtgcaaacgaaaaagagattgcactgatgaatgcccttactgtcaacctgcatcttcttatgctcagcttctttaagcctacgcctaagagatacaaaattctgctggaagcaaaggcttttccctccgaccactacgcaatcgagtcccaactgcaactgcatggtctgaacattgaggagtcgatgaggatgatcaagccgagagagggtgaagagacgcttcggatcgaagatattctggaagtgatcgagaaagaaggtgattcgatcgcggttatactgttttccggcgtgcacttctataccgggcaacacttcaatatccccgcgattaccaaggcaggtcaggcaaaagggtgctacgtgggctttgaccttgcacacgcagtgggtaatgtggagctgtacctccacgactggggtgttgacttcgcatgttggtgcagctacaagtaccttaatgcaggagccgggggaatcgctggagcatttatccatgagaagcatgcgcataccattaagccggcacttgtgggatggtttggacacgaactctcaacccgttttaagatggacaataaacttcaactgatcccaggcgtctgtggatttagaatttctaacccacccattctgctcgtgtgcagccttcatgcatcgcttgagatctttaagcaagcaactatgaaggcactgcgcaaaaagtcagtgcttctgaccggatatctggaatacctcattaagcacaactacggtaaggacaaagcagccactaagaagccggttgtgaacatcataacgccgtcccacgtggaagaacgaggttgtcagctgactatcacgttttcggttcctaacaaggatgtctttcaagaacttgaaaagcgtggggtggtatgtgataagcggaatccgaacgggattcgggtggcccctgtgccactctacaatagtttccatgacgtctacaaattcactaacctcctgacttcgattctcgactcggcagaaaccaaaaac

SEQ ID NO: 31889 - DNA, 1395 bp, Artificial Sequence
  Description of Artificial Sequence: Synthetic coding sequence
atggaacccagttctttggagttgccagccgacaccgtgcagcgtatagctgccgagctcaaatgccacccaaccgatgaaagggtggcactgcatttggatgaggaagataagctgcgtcatttccgtgagtgcttttatattccaaagatccaggatctccctccagtggaccttagcttggtaaacaaggacgagaatgctatctactttctgggtaattcactgggattgcagccaaagatggtgaagacataccttgaggaggaattggacaagtgggccaagatagctgcctacggtcacgaggtgggtaagcgtccatggatcactggtgatgagtctatcgtaggcttgatgaaggatatcgtcggcgccaacgagaaggagattgctctgatgaatgctctcaccgtaaaccttcaccttctgatgctgtctttcttcaaacctacaccaaagcgctataaaatcttgttggaagccaaggccttcccaagtgaccattacgcaatcgaaagccagttgcaattgcacggtttgaacatagaggagtccatgaggatgataaagcctagggaaggcgaagagacactgcgcatcgaggacatccttgaggttatcgagaaggagggcgatagcatcgctgtcatattgttctctggtgtacacttttataccggtcaacactttaatatccctgcaatcactaaagccggccaggctaagggctgttacgtgggattcgatcttgcccacgctgtaggcaatgttgagctgtatcttcacgactggggcgtggactttgcttgctggtgttcttataagtacctgaacgctggtgctggcggaatcgctggagctttcatccatgaaaagcacgcacacacaatcaagcccgctctggttggatggttcggtcacgagctttccactcgttttaaaatggacaacaaactgcagcttattcccggtgtgtgtggctttcgtatctctaacccccccattttgctggtgtgtagtctgcacgcctctctggagattttcaagcaagcaaccatgaaggcacttcgtaagaagtctgtactcctgacaggatacctggaatatctgataaagcacaactatggcaaggataaggccgccactaagaaacctgttgtgaacatcatcacaccttcacatgtagaggagagaggctgccagcttactattaccttttccgtgccaaacaaggacgtcttccaggagcttgagaagcgtggagtggtttgtgataagaggaaccccaacggtatcagagtggctcctgtgcctctgtacaacagcttccacgacgtctacaaattcacaaatctcctcacatcaattctggacagcgcagagaccaagaac

SEQ ID NO: 31890 - DNA, 1395 bp, Artificial Sequence
  Description of Artificial Sequence: Synthetic coding sequence
atggagccttcttcgctggaactcccagcagatactgtccagcggattgccgcagagcttaagtgtcaccccaccgatgaacgggtggcactccatctggacgaggaagacaagctacgccactttagagagtgcttctatattccaaagatccaggacctcccacctgttgatctctccctcgttaacaaagatgagaatgccatttacttcctcggaaacagcctgggactgcagcctaaaatggtaaagacctacctggaagaggagctagataagtgggctaaaatcgctgcctatgggcacgaagttggcaagaggccctggatcaccggggatgaatccatagtcggtttgatgaaagacatagtgggcgccaatgaaaaagaaatcgccctgatgaacgccctgaccgttaaccttcacctcctgatgctcagcttctttaaacccaccccgaaaaggtataagatcctcttggaagctaaagcgtttccctcagaccattatgccatcgagtctcagcttcaactacacggactgaacatagaagagtctatgcgtatgattaagcctagagaaggcgaggaaacgctgcggattgaggacatccttgaagtgatagagaaggaaggtgactcgatcgccgtcattctcttcagcggagtacatttttacactgggcagcacttcaatattcccgctataaccaaagccggccaggctaaaggatgctatgtggggttcgatctggcccacgcagttggaaatgtcgaactgtatttgcacgactggggcgtggactttgcatgctggtgcagctacaaatatctgaatgccggcgcgggagggattgcaggggcgttcattcatgaaaagcacgcccacactatcaagcccgcgttggttgggtggtttggacacgaactgagtacacggtttaaaatggacaacaagctgcagctgattcccggggtctgcggctttaggatcagtaacccacctatcttgcttgtgtgtagcctacatgcgtctctggagatcttcaaacaggctactatgaaggcattgcggaaaaagtcggtcctgctcactgggtacctcgagtatctgattaagcataactacgggaaggacaaggccgccaccaagaaacccgttgtgaatattatcaccccatcccacgtggaggagaggggctgccaactgaccatcacatttagcgtgccaaataaggacgtgtttcaggagctggagaagcggggtgtggtctgcgataaacgcaatccgaacggaatccgggtggcgccagtgccactatataattctttccacgacgtgtataaattcactaacctactgacatctatactggactccgctgagacaaagaac

SEQ ID NO: 31891 - DNA, 1395 bp, Artificial Sequence
  Description of Artificial Sequence: Synthetic coding sequence
atggagccgtctagtcttgagctgccggccgacaccgttcagcgtatcgccgctgagttgaaatgccaccctactgacgagagagtggctctccacctggacgaagaagataagctccggcattttagagagtgcttttacatccccaaaatccaagacctccctccagtagacctgtccctcgtgaacaaagatgaaaacgcaatctatttcctaggaaactcattaggtttgcaacccaagatggtgaaaacctatctggaggaagagctcgataaatgggccaaaatcgcagcttacggccatgaggtggggaaaagaccttggatcacgggagatgagtccatagtgggcctgatgaaggacatagtgggagccaacgagaaggaaatagccctgatgaatgcgttgaccgtgaacctacacttgctaatgctatccttcttcaagcccaccccaaagaggtacaaaattctactcgaggccaaggcctttccgtccgaccattacgccattgagtcccagcttcagctccatggcctgaatatcgaggaatcaatgaggatgatcaaacctcgggagggtgaggaaaccctgcggatagaggatatactggaagtcatagagaaggaaggagactccattgcggtaatcctgttctcaggcgtgcatttttataccggccagcatttcaatatccctgcaatcacaaaagccgggcaagccaaaggctgctacgttggcttcgatctggcccacgccgtggggaacgttgagctctatctccacgattggggtgtggattttgcttgttggtgtagctacaaatacttgaatgcaggtgctggcggaatcgcaggcgccttcatacacgaaaagcacgcccataccatcaagcccgcacttgtcggatggttcggccacgaactgtctactaggtttaaaatggacaataaactgcagttaatccccggggtttgtggattccggattagtaatcccccgattcttctggtgtgttcactgcatgcttcactcgagatttttaagcaggccacaatgaaggcactgcgaaagaaaagtgtcttactcacaggctacctggagtatctgattaagcacaactatgggaaggacaaggcagctacaaaaaagccagttgtgaacatcatcacaccctcacatgtggaggaaagaggatgccagctcacaattacctttagcgttccgaataaggacgtgtttcaggaactggagaagcgcggcgtcgtgtgtgataaacggaacccgaatggcatccgggtcgcaccagtccctctctacaattcgtttcacgacgtatataagttcactaacctgttgacttcgatcttagacagcgcagagactaagaat

SEQ ID NO: 31892 - DNA, 1395 bp, Artificial Sequence
  Description of Artificial Sequence: Synthetic coding sequence
atggaaccctctagtttggaactcccagcagacactgtacagaggattgctgcggaactgaagtgtcaccctacggacgaacgggtcgccctccatttggatgaagaggacaagttgcggcatttccgcgaatgcttctacatccccaaaattcaagatcttcctccagtcgacctttcactggtgaacaaagatgagaacgccatttactttctcggcaacagtttggggctgcaaccaaaaatggttaagacatatctggaagaggagctggataagtgggccaagatcgctgcttacggtcacgaagtcggtaaaagaccctggatcacaggcgacgaaagcatcgtgggcctgatgaaggacatagtgggcgcgaatgaaaaggaaatcgccttgatgaatgcactgactgtgaacctgcatctgctcatgctgtctttctttaagcccacaccgaaaagatacaagattctgttggaagctaaggcatttccaagcgaccattatgcgattgaaagccagctgcaactccatggattgaacatagaggaatctatgaggatgattaagcctagggagggcgaggagacactgagaattgaggatatcctcgaggtgatagaaaaggaaggggactccatcgcagtgatacttttctccggggtgcatttctatacagggcagcatttcaacatccccgcgatcaccaaggctgggcaggcaaagggatgctatgtggggttcgatctggcgcacgcagtgggcaatgtagaactgtacctccacgactggggggtggatttcgcatgctggtgctcttacaaatacctcaatgcaggcgctggagggattgctggggcttttatccatgagaagcacgcgcataccataaagcctgcgctggtgggttggtttgggcacgaactgtctacacggtttaagatggacaacaagctccagttgattccaggggtttgtgggttcagaatctccaatccaccaatcttgctggtatgcagcctgcatgcctctttggagattttcaagcaggccactatgaaggctctgcgcaagaagtccgtgcttcttactgggtacctggaatatctcattaaacataattatggtaaagataaggcggccactaagaaacccgtggtcaatattatcaccccttctcacgtagaagagcggggctgtcagctcacaatcacctttagcgtgcctaataaagacgtcttccaggagctcgaaaagcgaggtgtcgtctgtgacaagcgcaatccaaacggtatcagagtcgcaccagtgccattgtacaactcttttcacgacgtttataaatttacaaacttgctgacaagcatcctggatagcgccgagactaagaat

SEQ ID NO: 31893 - protein, 4 aa, Homo sapiens
  MOD_RES (2)..(3): Any amino acid
RXXR

SEQ ID NO: 31894 - protein, 4 aa, Homo sapiens
  MOD_RES (2)..(2): Any amino acid
  MOD_RES (3)..(3): Lys or Arg
RXXR

SEQ ID NO: 31895 - protein, 6 aa, Homo sapiens
  MOD_RES (1)..(1): Lys or Arg
  MOD_RES (2)..(5): Any amino acid
  MOD_RES (6)..(6): Lys or Arg
XXXXXX

SEQ ID NO: 31896 - protein, 8 aa, Homo sapiens
  MOD_RES (1)..(1): Lys or Arg
  MOD_RES (2)..(7): Any amino acid
  MOD_RES (8)..(8): Lys or Arg
XXXXXXXX

SEQ ID NO: 31897 - protein, 6 aa, Homo sapiens
LVPRGS

SEQ ID NO: 31898 - protein, 4 aa, Homo sapiens
LVPR

SEQ ID NO: 31899 - protein, 4 aa, Homo sapiens
  MOD_RES (1)..(1): Ala, Phe, Gly, Ile, Leu, Thr, Val or Met
  MOD_RES (2)..(2): Ala, Phe, Gly, Ile, Leu, Thr, Val or Trp
XXPR

SEQ ID NO: 31900 - protein, 4 aa, Homo sapiens
IEGR

SEQ ID NO: 31901 - protein, 4 aa, Homo sapiens
IDGR

SEQ ID NO: 31902 - protein, 4 aa, Homo sapiens
AEGR

SEQ ID NO: 31903 - protein, 4 aa, Homo sapiens
  MOD_RES (1)..(1): Ala, Phe, Gly, Ile, Leu, Thr, Val or Met
  MOD_RES (2)..(2): Asp or Glu
XXGR

SEQ ID NO: 31904 - DNA, 615 bp, Homo sapiens
atggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctga

SEQ ID NO: 31905 - DNA, 800 bp, Artificial Sequence
  Description of Artificial Sequence: Synthetic transcript sequence
taatacgactcactatagggaaataagagagaaaagaagagtaagaagaaatataagagccaccatggctggacctgccacccagagccccatgaagctgatggccctgcagctgctgctgtggcacagtgcactctggacagtgcaggaagccacccccctgggccctgccagctccctgccccagagcttcctgctcaagtgcttagagcaagtgaggaagatccagggcgatggcgcagcgctccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccggccttcgcctctgctttccagcgccgggcaggaggggtcctggttgcctcccatctgcagagcttcctggaggtgtcgtaccgcgttctacgccaccttgcccagccctgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 31906 - DNA, 800 bp, Artificial Sequence
  Description of Artificial Sequence: Synthetic transcript sequence
taatacgactcactatagggaaataagagagaaaagaagagtaagaagaaatataagagccaccatggccggtcccgcgacccaaagccccatgaaacttatggccctgcagttgctgctttggcactcggccctctggacagtccaagaagcgactcctctcggacctgcctcatcgttgccgcagtcattccttttgaagtgtctggagcaggtgcgaaagattcagggcgatggagccgcactccaagagaagctctgcgcgacatacaaactttgccatcccgaggagctcgtactgctcgggcacagcttggggattccctgggctcctctctcgtcctgtccgtcgcaggctttgcagttggcagggtgcctttcccagctccactccggtttgttcttgtatcagggactgctgcaagcccttgagggaatctcgccagaattgggcccgacgctggacacgttgcagctcgacgtggcggatttcgcaacaaccatctggcagcagatggaggaactggggatggcacccgcgctgcagcccacgcagggggcaatgccggcctttgcgtccgcgtttcagcgcagggcgggtggagtcctcgtagcgagccaccttcaatcatttttggaagtctcgtaccgggtgctgagacatcttgcgcagccgtgaagcgctgccttctgcggggcttgccttctggccatgcccttcttctctcccttgcacctgtacctcttggtctttgaataaagcctgagtaggaaggcggccgctcgagcatgcatctaga

SEQ ID NO: 31907 - RNA, 758 nt, Artificial Sequence
  Description of Artificial Sequence: Synthetic transcript sequence
gggaaauaagagagaaaagaagaguaagaagaaauauaagagccaccauggccggucccgcgacccaaagccccaugaaacuuauggcccugcaguugcugcuuuggcacucggcccucuggacaguccaagaagcgacuccucucggaccugccucaucguugccgcagucauuccuuuugaagugucuggagcaggugcgaaagauucagggcgauggagccgcacuccaagagaagcucugcgcgacauacaaacuuugccaucccgaggagcucguacugcucgggcacagcuuggggauucccugggcuccucucucguccuguccgucgcaggcuuugcaguuggcagggugccuuucccagcuccacuccgguuuguucuuguaucagggacugcugcaagcccuugagggaaucucgccagaauugggcccgacgcuggacacguugcagcucgacguggcggauuucgcaacaaccaucuggcagcagauggaggaacuggggauggcacccgcgcugcagcccacgcagggggcaaugccggccuuugcguccgcguuucagcgcagggcggguggaguccucguagcgagccaccuucaaucauuuuuggaagucucguaccgggugcugagacaucuugcgcagccgugaagcgcugccuucugcggggcuugccuucuggccaugcccuucuucucucccuugcaccuguaccucuuggucuuugaauaaagccugaguaggaag

SEQ ID NO: 31908 - RNA, 854 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaugauaagcugccuucugcggggcuugccuucuggccaugcccuucuucucucccuugcaccuguaccucuuggucuuugaauaaagccugaguaggaag

SEQ ID NO: 31909 - DNA, 896 bp, Artificial Sequence
  Description of Artificial Sequence: Synthetic transcript sequence
taatacgactcactatagggaaataagagagaaaagaagagtaagaagaaatataagagccaccatggtatccaagggggaggaggacaacatggcgatcatcaaggagttcatgcgattcaaggtgcacatggaaggttcggtcaacggacacgaatttgaaatcgaaggagagggtgaaggaaggccctatgaagggacacagaccgcgaaactcaaggtcacgaaagggggaccacttcctttcgcctgggacattctttcgccccagtttatgtacgggtccaaagcatatgtgaagcatcccgccgatattcctgactatctgaaactcagctttcccgagggattcaagtgggagcgggtcatgaactttgaggacgggggtgtagtcaccgtaacccaagactcaagcctccaagacggcgagttcatctacaaggtcaaactgcgggggactaactttccgtcggatgggccggtgatgcagaagaaaacgatgggatgggaagcgtcatcggagaggatgtacccagaagatggtgcattgaagggggagatcaagcagagactgaagttgaaagatgggggacattatgatgccgaggtgaaaacgacatacaaagcgaaaaagccggtgcagcttcccggagcgtataatgtgaatatcaagttggatattacttcacacaatgaggactacacaattgtcgaacagtacgaacgcgctgagggtagacactcgacgggaggcatggacgagttgtacaaatgataagctgccttctgcggggcttgccttctggccatgcccttcttctctcccttgcacctgtacctcttggtctttgaataaagcctgagtaggaaggcggccgctcgagcatgcatctaga

SEQ ID NO: 31910 - RNA, 725 nt, Artificial Sequence
  Description of Artificial Sequence: Synthetic transcript sequence
gggaaauaagagagaaaagaagaguaagaagaaauauaagagccaccaugggagugcacgagugucccgcgugguugugguugcugcugucgcucuugagccucccacugggacugccugugcugggggcaccacccagauugaucugcgacucacggguacuugagagguaccuucuugaagccaaagaagccgaaaacaucacaaccggaugcgccgagcacugcucccucaaugagaacauuacuguaccggauacaaaggucaauuucuaugcauggaagagaauggaaguaggacagcaggccgucgaaguguggcaggggcucgcgcuuuugucggaggcgguguugcggggucaggcccuccucgucaacucaucacagccgugggagccccuccaacuucaugucgauaaagcggugucggggcuccgcagcuugacgacguugcuucgggcucugggcgcacaaaaggaggcuauuucgccgccugacgcggccuccgcggcaccccuccgaacgaucaccgcggacacguuuaggaagcuuuuuagaguguacagcaauuuccuccgcggaaagcugaaauuguauacuggugaagcguguaggacaggggaucgcugauaagcugccuucugcggggcuugccuucuggccaugcccuucuucucucccuugcaccuguaccucuuggucuuugaauaaagccugaguaggaag

SEQ ID NO: 31911 - RNA, 1536 nt, Artificial Sequence
  Description of Artificial Sequence: Synthetic transcript sequence
gggaaauaagagagaaaagaagaguaagaagaaauauaagagccaccaaugcagcgcgucaacaugauuauggccgaaucgccgggacucaucacaaucugccucuuggguuaucucuugucggcagaauguaccguguucuuggaucacgaaaacgcgaacaaaauucuuaaucgcccgaagcgguauaacuccgggaaacuugaggaguuugugcagggcaaucuugaacgagagugcauggaggagaaaugcuccuuugaggaggcgagggaaguguuugaaaacacagagcgaacaacggaguuuuggaagcaauacguagauggggaccagugugagucgaauccgugccucaaugggggaucauguaaagaugacaucaauagcuaugaaugcuggugcccguuuggguuugaagggaagaacugugagcuggaugugacgugcaacaucaaaaacggacgcugugagcaguuuuguaagaacucggcugacaauaagguaguaugcucgugcacagagggauaccggcuggcggagaaccaaaaaucgugcgagcccgcagucccguucccuugugggagggugagcgugucacagacuagcaaguugacgagagcggagacuguauuccccgacguggacuacgucaacagcaccgaagccgaaacaauccucgauaacaucacgcagagcacucaguccuucaaugacuuuacgagggucguagguggugaggacgcgaaacccggucaguuccccuggcaggugguauugaacggaaaagucgaugccuuuuguggagguuccauugucaacgagaaguggauugucacagcggcacacugcguagaaacaggagugaaaaucacgguaguggcgggagagcauaacauugaagagacagagcacacggaacaaaagcgaaaugucaucagaaucauuccacaccauaacuauaacgcggcaaucaauaaguacaaucacgacaucgcacuuuuggagcuugacgaaccuuuggugcuuaauucguacgucaccccuauuuguauugccgacaaagaguauacaaacaucuucuugaaauucggcuccggguacguaucgggcuggggcagaguguuccauaaggguagauccgcacugguguugcaauaccucagggugccccucguggaucgagccacuugucugcgguccaccaaauucacaaucuacaacaauauguucugugcgggauuccaugaaggugggagagauagcugccagggagacucaggggguccccacgugacggaagucgaggggacgucauuucugacgggaauuaucucauggggagaggaaugugcgaugaaggggaaauauggcaucuacacuaaagugucacgguaugucaauuggaucaaggaaaagacgaaacucacgugaucagccagcgcugccuucugcggggcuugccuucuggccaugcccuucuucucucccuugcaccuguaccucuuggucuuugaauaaagccugaguaggaag

SEQ ID NO: 31912 - DNA, 767 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgctcgagcatgcatctaga

SEQ ID NO: 31913 - DNA, 750 bp, Artificial Sequence
  Description of Artificial Sequence: Synthetic transcript sequence
taatacgactcactatagggaaataagagagaaaagaagagtaagaagaaatataagagccaccatgggagtgcacgagtgtcccgcgtggttgtggttgctgctgtcgctcttgagcctcccactgggactgcctgtgctgggggcaccacccagattgatctgcgactcacgggtacttgagaggtaccttcttgaagccaaagaagccgaaaacatcacaaccggatgcgccgagcactgctccctcaatgagaacattactgtaccggatacaaaggtcaatttctatgcatggaagagaatggaagtaggacagcaggccgtcgaagtgtggcaggggctcgcgcttttgtcggaggcggtgttgcggggtcaggccctcctcgtcaactcatcacagccgtgggagcccctccaacttcatgtcgataaagcggtgtcggggctccgcagcttgacgacgttgcttcgggctctgggcgcacaaaaggaggctatttcgccgcctgacgcggcctccgcggcacccctccgaacgatcaccgcggacacgtttaggaagctttttagagtgtacagcaatttcctccgcggaaagctgaaattgtatactggtgaagcgtgtaggacaggggatcgctgataagctgccttctgcggggcttgccttctggccatgcccttcttctctcccttgcacctgtacctcttggtctttgaataaagcctgagtaggaaggcggccgc

SEQ ID NO: 31914 - DNA, 1578 bp, Artificial Sequence
  Description of Artificial Sequence: Synthetic transcript sequence
taatacgactcactatagggaaataagagagaaaagaagagtaagaagaaatataagagccaccaatgcagcgcgtcaacatgattatggccgaatcgccgggactcatcacaatctgcctcttgggttatctcttgtcggcagaatgtaccgtgttcttggatcacgaaaacgcgaacaaaattcttaatcgcccgaagcggtataactccgggaaacttgaggagtttgtgcagggcaatcttgaacgagagtgcatggaggagaaatgctcctttgaggaggcgagggaagtgtttgaaaacacagagcgaacaacggagttttggaagcaatacgtagatggggaccagtgtgagtcgaatccgtgcctcaatgggggatcatgtaaagatgacatcaatagctatgaatgctggtgcccgtttgggtttgaagggaagaactgtgagctggatgtgacgtgcaacatcaaaaacggacgctgtgagcagttttgtaagaactcggctgacaataaggtagtatgctcgtgcacagagggataccggctggcggagaaccaaaaatcgtgcgagcccgcagtcccgttcccttgtgggagggtgagcgtgtcacagactagcaagttgacgagagcggagactgtattccccgacgtggactacgtcaacagcaccgaagccgaaacaatcctcgataacatcacgcagagcactcagtccttcaatgactttacgagggtcgtaggtggtgaggacgcgaaacccggtcagttcccctggcaggtggtattgaacggaaaagtcgatgccttttgtggaggttccattgtcaacgagaagtggattgtcacagcggcacactgcgtagaaacaggagtgaaaatcacggtagtggcgggagagcataacattgaagagacagagcacacggaacaaaagcgaaatgtcatcagaatcattccacaccataactataacgcggcaatcaataagtacaatcacgacatcgcacttttggagcttgacgaacctttggtgcttaattcgtacgtcacccctatttgtattgccgacaaagagtatacaaacatcttcttgaaattcggctccgggtacgtatcgggctggggcagagtgttccataagggtagatccgcactggtgttgcaatacctcagggtgcccctcgtggatcgagccacttgtctgcggtccaccaaattcacaatctacaacaatatgttctgtgcgggattccatgaaggtgggagagatagctgccagggagactcagggggtccccacgtgacggaagtcgaggggacgtcatttctgacgggaattatctcatggggagaggaatgtgcgatgaaggggaaatatggcatctacactaaagtgtcacggtatgtcaattggatcaaggaaaagacgaaactcacgtgatcagccagcgctgccttctgcggggcttgccttctggccatgcccttcttctctcccttgcacctgtacctcttggtctttgaataaagcctgagtaggaaggcggccgctcgagcatgcatctaga

SEQ ID NO: 31915 - RNA, 851 nt, Artificial Sequence
  Description of Artificial Sequence: Synthetic transcript sequence
gggaaauaagagagaaaagaagaguaagaagaaauauaagagccaccauggugagcaagggcgaggaggauaacauggccaucaucaaggaguucaugcgcuucaaggugcacauggagggcuccgugaacggccacgaguucgagaucgagggcgagggcgagggccgccccuacgagggcacccagaccgccaagcugaaggugaccaaggguggcccccugcccuucgccugggacauccuguccccucaguucauguacggcuccaaggccuacgugaagcaccccgccgacauccccgacuacuugaagcuguccuuccccgagggcuucaagugggagcgcgugaugaacuucgaggacggcggcguggugaccgugacccaggacuccucccugcaggacggcgaguucaucuacaaggugaagcugcgcggcaccaacuuccccuccgacggccccguaaugcagaagaagaccaugggcugggaggccuccuccgagcggauguaccccgaggacggcgcccugaagggcgagaucaagcagaggcugaagcugaaggacggcggccacuacgacgcugaggucaagaccaccuacaaggccaagaagcccgugcagcugcccggcgccuacaacgucaacaucaaguuggacaucaccucccacaacgaggacuacaccaucguggaacaguacgaacgcgccgagggccgccacuccaccggcggcauggacgagcuguacaagugagcugccuucugcggggcuugccuucuggccaugcccuucuucucucccuugcaccuguaccucuuggucuuugaauaaagccugaguaggaag

SEQ ID NO: 31916 - DNA, 1838 bp, Artificial Sequence
  Description of Artificial Sequence: Synthetic transcript sequence
taatacgactcactatagggaaataagagagaaaagaagagtaagaagaaatataagagccaccatggaagatgcgaagaacatcaagaagggacctgccccgttttaccctttggaggacggtacagcaggagaacagctccacaaggcgatgaaacgctacgccctggtccccggaacgattgcgtttaccgatgcacatattgaggtagacatcacatacgcagaatacttcgaaatgtcggtgaggctggcggaagcgatgaagagatatggtcttaacactaatcaccgcatcgtggtgtgttcggagaactcattgcagtttttcatgccggtccttggagcacttttcatcggggtcgcagtcgcgccagcgaacgacatctacaatgagcgggaactcttgaatagcatgggaatctcccagccgacggtcgtgtttgtctccaaaaaggggctgcagaaaatcctcaacgtgcagaagaagctccccattattcaaaagatcatcattatggatagcaagacagattaccaagggttccagtcgatgtatacctttgtgacatcgcatttgccgccagggtttaacgagtatgacttcgtccccgagtcatttgacagagataaaaccatcgcgctgattatgaattcctcgggtagcaccggtttgccaaagggggtggcgttgccccaccgcactgcttgtgtgcggttctcgcacgctagggatcctatctttggtaatcagatcattcccgacacagcaatcctgtccgtggtaccttttcatcacggttttggcatgttcacgactctcggctatttgatttgcggtttcagggtcgtacttatgtatcggttcgaggaagaactgtttttgagatccttgcaagattacaagatccagtcggccctccttgtgccaacgcttttctcattctttgcgaaatcgacacttattgataagtatgacctttccaatctgcatgagattgcctcagggggagcgccgcttagcaaggaagtcggggaggcagtggccaagcgcttccaccttcccggaattcggcagggatacgggctcacggagacaacatccgcgatccttatcacgcccgagggtgacgataagccgggagccgtcggaaaagtggtccccttctttgaagccaaggtcgtagacctcgacacgggaaaaaccctcggagtgaaccagaggggcgagctctgcgtgagagggccgatgatcatgtcaggttacgtgaataaccctgaagcgacgaatgcgctgatcgacaaggatgggtggttgcattcgggagacattgcctattgggatgaggatgagcacttctttatcgtagatcgacttaagagcttgatcaaatacaaaggctatcaggtagcgcctgccgagctcgagtcaatcctgctccagcaccccaacattttcgacgccggagtggccgggttgcccgatgacgacgcgggtgagctgccagcggccgtggtagtcctcgaacatgggaaaacaatgaccgaaaaggagatcgtggactacgtagcatcacaagtgacgactgcgaagaaactgaggggaggggtagtctttgtggacgaggtcccgaaaggcttgactgggaagcttgacgctcgcaaaatccgggaaatcctgattaaggcaaagaaaggcgggaaaatcgctgtctgataagctgccttctgcggggcttgccttctggccatgcccttcttctctcccttgcacctgtacctcttggtctttgaataaagcctgagtaggaaggcggccgctcgagcatgcatctaga

SEQ ID NO: 31917 - RNA, 1796 nt, Artificial Sequence
  Description of Artificial Sequence: Synthetic transcript sequence
gggaaauaagagagaaaagaagaguaagaagaaauauaagagccaccauggaagaugcgaagaacaucaagaagggaccugccccguuuuacccuuuggaggacgguacagcaggagaacagcuccacaaggcgaugaaacgcuacgcccugguccccggaacgauugcguuuaccgaugcacauauugagguagacaucacauacgcagaauacuucgaaaugucggugaggcuggcggaagcgaugaagagauauggucuuaacacuaaucaccgcaucgugguguguucggagaacucauugcaguuuuucaugccgguccuuggagcacuuuucaucggggucgcagucgcgccagcgaacgacaucuacaaugagcgggaacucuugaauagcaugggaaucucccagccgacggucguguuugucuccaaaaaggggcugcagaaaauccucaacgugcagaagaagcuccccauuauucaaaagaucaucauuauggauagcaagacagauuaccaaggguuccagucgauguauaccuuugugacaucgcauuugccgccaggguuuaacgaguaugacuucguccccgagucauuugacagagauaaaaccaucgcgcugauuaugaauuccucggguagcaccgguuugccaaaggggguggcguugccccaccgcacugcuugugugcgguucucgcacgcuagggauccuaucuuugguaaucagaucauucccgacacagcaauccuguccgugguaccuuuucaucacgguuuuggcauguucacgacucucggcuauuugauuugcgguuucagggucguacuuauguaucgguucgaggaagaacuguuuuugagauccuugcaagauuacaagauccagucggcccuccuugugccaacgcuuuucucauucuuugcgaaaucgacacuuauugauaaguaugaccuuuccaaucugcaugagauugccucagggggagcgccgcuuagcaaggaagucggggaggcaguggccaagcgcuuccaccuucccggaauucggcagggauacgggcucacggagacaacauccgcgauccuuaucacgcccgagggugacgauaagccgggagccgucggaaaagugguccccuucuuugaagccaaggucguagaccucgacacgggaaaaacccucggagugaaccagaggggcgagcucugcgugagagggccgaugaucaugucagguuacgugaauaacccugaagcgacgaaugcgcugaucgacaaggaugggugguugcauucgggagacauugccuauugggaugaggaugagcacuucuuuaucguagaucgacuuaagagcuugaucaaauacaaaggcuaucagguagcgccugccgagcucgagucaauccugcuccagcaccccaacauuuucgacgccggaguggccggguugcccgaugacgacgcgggugagcugccagcggccgugguaguccucgaacaugggaaaacaaugaccgaaaaggagaucguggacuacguagcaucacaagugacgacugcgaagaaacugaggggagggguagucuuuguggacgaggucccgaaaggcuugacugggaagcuugacgcucgcaaaauccgggaaauccugauuaaggcaaagaaaggcgggaaaaucgcugucugauaagcugccuucugcggggcuugccuucuggccaugcccuucuucucucccuugcaccuguaccucuuggucuuugaauaaagccugaguaggaag

SEQ ID NO: 31918 - DNA, 905 bp, Artificial Sequence
  Description of Artificial Sequence: Synthetic transcript sequence
taatacgactcactatagggaaataagagagaaaagaagagtaagaagaaatataagagccaccatggtgtccaagggtgaggaattgtttaccggggtggtgcctattctcgtcgaacttgacggggatgtgaatggacacaagttttcggtatccggagaaggagagggtgacgccacatacggaaagcttacactcaaattcatctgtacgacggggaaactgcccgtaccctggcctacgctcgtaaccacgctgacttatggagtgcagtgctttagcagataccccgaccatatgaagcagcacgacttcttcaagtcggcgatgcccgaggggtacgtgcaagagaggaccattttcttcaaagacgatggcaattacaaaacacgcgcagaagtcaagtttgagggcgatactctggtcaatcggatcgaattgaagggaatcgatttcaaagaagatggaaacatccttggccataagctcgagtacaactataactcgcataatgtctatatcatggctgacaagcagaaaaacggtatcaaagtcaactttaagatccgacacaatattgaggacggttcggtgcagcttgcggaccactatcaacagaatacgccgattggggatggtccggtccttttgccggataaccattatctctcaacccagtcagccctgagcaaagatccaaacgagaagagggaccacatggtcttgctcgaattcgtgacagcggcagggatcactctgggaatggacgagttgtacaagtgataagctgccttctgcggggcttgccttctggccatgcccttcttctctcccttgcacctgtacctcttggtctttgaataaagcctgagtaggaaggcggccgctcgagcatgcatctaga

SEQ ID NO: 31919 - RNA, 863 nt, Artificial Sequence
  Description of Artificial Sequence: Synthetic transcript sequence
gggaaauaagagagaaaagaagaguaagaagaaauauaagagccaccaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaagcugccuucugcggggcuugccuucuggccaugcccuucuucucucccuugcaccuguaccucuuggucuuugaauaaagccugaguaggaag

SEQ ID NO: 31920 - RNA, 716 nt, Artificial Sequence
  Description of Artificial Sequence: Synthetic transcript sequence
gggaaauaagagagaaaagaagaguaagaagaaauauaagagccaccaugaacuuucucuugucaugggugcacuggagccuugcgcugcugcuguaucuucaucacgcuaaguggagccaggccgcacccauggcggaggguggcggacagaaucaccacgaaguagucaaauucauggacguguaccagaggucguauugccauccgauugaaacucuuguggauaucuuucaagaauaccccgaugaaaucgaguacauuuucaaaccgucgugugucccucucaugaggugcgggggaugcugcaaugaugaaggguuggaguguguccccacggaggagucgaauaucacaaugcaaaucaugcgcaucaaaccacaucagggucagcauauuggagagauguccuuucuccagcacaacaaaugugaguguagaccgaagaaggaccgagcccgacaggaaaacccaugcggaccgugcuccgagcggcgcaaacacuuguucguacaagacccccagacaugcaagugcucauguaagaauaccgauucgcgguguaaggcgagacagcuggaauugaacgagcgcacguguaggugcgacaagccuagacggugagcugccuucugcggggcuugccuucuggccaugcccuucuucucucccuugcaccuguaccucuuggucuuugaauaaagccugaguaggaag

SEQ ID NO: 31921 - RNA, 1316 nt, Artificial Sequence
  Description of Artificial Sequence: Synthetic transcript sequence
gggaaauaagagagaaaagaagaguaagaagaaauauaagagccaccaugcccccaucgggauugagauuguugccccuucugcuuccgcugcuuugguugcucguccugaccccuggcaggcccgcagcgggguugucgacguguaagacgauugacauggagcucgugaaacgcaagagaauugaagcaaucaggggucaaauucugagcaaacucagacucgcauccccaccgucccagggugaggucccaccgggaccucugcccgaggcgguccuggccuuguacaacucgacacgcgaccgagucgcaggggagucagcggaacccgagcccgaacccgaggccgacuacuacgccaaagaggucacucgggucuugaugguggaaacucacaacgaaaucuacgacaaguuuaagcagucgacccauucgaucuacauguucuucaauaccagcgagcuuagagaagcgguccccgagccgguacuuuuguccagagcggagcugcgguugcucaggcucaagcugaaaguggaacagcacguagagcuuuaucagaaguacagcaacaauucauggcgguaucucucgaaccggcuguuggcgccgucggauucacccgaauggcucagcuuugaugucacggggguggugcgccagugguuguccaggggcggagagaucgaaggauuucggcucucagcccacuguucgugugauagcagggacaacacgcuccaaguagauaucaacggauucacuacuggucgcagaggggaucuugcgacaauccacgguaugaaucgcccuuuucuccugcugauggccacaccccuugaacgggcgcaacaucuucagucaucccgccauaggagagcacuggacacgaacuacuguuuuucgucgacagagaagaauugcugcgugcggcagcuuuacaucgacuuccgaaaagaucucggguggaaauggauucaugaaccgaagggguaucacgccaacuucugccuggguccguguccuuauaucuggucguuggauacacaguauucaaagguguuggcucuuuacaaucagcacaacccgggagccucggcugcgccuuguugcguaccccaggcauuggagccauugccgauuguguauuaugugggaagaaagccgaaaguggagcaguugucgaauaugaucguacggagcugcaaaugcuccugauaagcugccuucugcggggcuugccuucuggccaugcccuucuucucucccuugcaccuguaccucuuggucuuugaauaaagccugaguaggaag

SEQ ID NO: 31922 - RNA, 806 nt, Artificial Sequence
  Description of Artificial Sequence: Synthetic transcript sequence
gggaaauaagagagaaaagaagaguaagaagaaauauaagagccaccauggguguaaggcacccgcccugcucccacagacuccuggcggugugugccuugguaucgcuugcgaccgccgcacugcuugucaauccggggguagucgugcgcaucagccagaagggacuggauuacgccucgcagcaggguaccgcggcacuucagaaagagcuuaagcggaucaagauuccagacuauucagauagcuuuaagaucaagcauuugggaaaaggucacuauucguuuuacucgauggacauuagagaauuccagcucccuucgucccaaauuuccauggucccgaauguggggcugaaauucagcauuucgaacgcgaacaucaagaucucagggaaauggaaggcacagaagcgauuucucaaaaugucaggaaacuuugaucucuccaucgaggggaugucaaucucggcggacuugaaacucggcuccaauccuacaucgggaaagcccacuauuacggccucgucguguucgagccauaucaacucggugcacguccauaucucaaaguccaaaguaggauggcuuauccagcucuuccacaaaaagauugagucggcuuugcgcaacaagaugaauagccaagugugcgagaaagucacaaauuccgugucaucagaauugcagcccuacuuccaaacgcuguaaugagcugccuucugcggggcuugccuucuggccaugcccuucuucucucccuugcaccuguaccucuuggucuuugaauaaagccugaguaggaag

SEQ ID NO: 31923 - RNA, 1573 nt, Artificial Sequence
  Description of Artificial Sequence: Synthetic transcript sequence
gggaaauaagagagaaaagaagaguaagaagaaauauaagagccaccaugguauccaagggggaggaggacaacauggcgaucaucaaggaguucaugcgauucaaggugcacauggaagguucggucaacggacacgaauuugaaaucgaaggagagggugaaggaaggcccuaugaagggacacagaccgcgaaacucaaggucacgaaagggggaccacuuccuuucgccugggacauucuuucgccccaguuuauguacggguccaaagcauaugugaagcaucccgccgauauuccugacuaucugaaacucagcuuucccgagggauucaagugggagcgggucaugaacuuugaggacggggguguagucaccguaacccaagacucaagccuccaagacggcgaguucaucuacaaggucaaacugcgggggacuaacuuuccgucggaugggccggugaugcagaagaaaacgaugggaugggaagcgucaucggagaggauguacccagaagauggugcauugaagggggagaucaagcagagacugaaguugaaagaugggggacauuaugaugccgaggugaaaacgacauacaaagcgaaaaagccggugcagcuucccggagcguauaaugugaauaucaaguuggauauuacuucacacaaugaggacuacacaauugucgaacaguacgaacgcgcugaggguagacacucgacgggaggcauggacgaguuguacaaaggaagcggagcuacuaacuucagccugcugaagcaggcuggagacguggaggagaacccuggaccuaugguguccaagggugaggaauuguuuaccgggguggugccuauucucgucgaacuugacggggaugugaauggacacaaguuuucgguauccggagaaggagagggugacgccacauacggaaagcuuacacucaaauucaucuguacgacggggaaacugcccguacccuggccuacgcucguaaccacgcugacuuauggagugcagugcuuuagcagauaccccgaccauaugaagcagcacgacuucuucaagucggcgaugcccgagggguacgugcaagagaggaccauuuucuucaaagacgauggcaauuacaaaacacgcgcagaagucaaguuugagggcgauacucuggucaaucggaucgaauugaagggaaucgauuucaaagaagauggaaacauccuuggccauaagcucgaguacaacuauaacucgcauaaugucuauaucauggcugacaagcagaaaaacgguaucaaagucaacuuuaagauccgacacaauauugaggacgguucggugcagcuugcggaccacuaucaacagaauacgccgauuggggaugguccgguccuuuugccggauaaccauuaucucucaacccagucagcccugagcaaagauccaaacgagaagagggaccacauggucuugcucgaauucgugacagcggcagggaucacucugggaauggacgaguuguacaagugauaauggucuuugaauaaagccugaguaggaag

SEQ ID NO: 31924 - RNA, 1568 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgaggugcagcuggucgagagcggcgggggccucgugcagccgggcgggucgcugcggcugagcugcgccgcgagcggguucaacaucaaggacaccuacauccacugggugcgccaggcccccggcaagggccucgagugggucgcccggaucuaccccacgaacggguacacccgcuacgccgacagcgugaagggccgguucaccaucagcgcggacaccucgaagaacacggccuaccugcagaugaacagccugcgcgccgaggacaccgccguguacuacugcagccgguggggcggcgacggguucuacgccauggacuacugggggcagggcacccucgucaccgugagcagcgcgucgacgaaggggcccagcguguucccgcuggcccccagcagcaagagcaccagcggcgggaccgccgcccugggcugccucgucaaggacuacuuccccgagcccgugaccgugucguggaacagcggcgcgcugacgagcgggguccacaccuucccggccgugcugcagagcagcggccucuacucgcugagcagcguggucaccgugcccagcagcagccuggggacccagacguacaucugcaacgugaaccacaagcccucgaacaccaaggucgacaagaagguggagcccaagagcugcgacaagacccacaccugcccgcccugccccgcccccgagcuccugggcgggcccagcguguuccuguucccgcccaagcccaaggacacgcucaugaucagccgcacccccgaggucaccugcgugguggucgacgugagccacgaggaccccgaggugaaguucaacugguacgucgacggcguggaggugcacaacgccaagaccaagccgcgggaggagcaguacaacucgacguaccgcgucgugagcgugcugaccguccugcaccaggacuggcucaacggcaaggaguacaagugcaaggugagcaacaaggcccugcccgcgcccaucgagaagaccaucagcaaggccaaggggcagccccgggagccgcagguguacacccugccccccagccgcgacgagcucacgaagaaccaggucagccugaccugccuggugaagggcuucuaccccucggacaucgccguggagugggagagcaacgggcagccggagaacaacuacaagaccaccccgcccguccucgacagcgacggcagcuucuuccuguacagcaagcugacgguggacaagucgcgguggcagcagggcaacguguucagcugcagcgucaugcacgaggcccuccacaaccacuacacccagaagagccugagccugagccccgggugauaauaggcugccuucugcggggcuugccuucuggccaugcccuucuucucucccuugcaccuguaccucuuggucuuugaauaaagccugaguaggaag

SEQ ID NO: 31925 - RNA, 863 nt, Artificial Sequence
  Description of Artificial Sequence: Synthetic transcript sequence
gggaaauaagagagaaaagaagaguaagaagaaauauaagagccaccauggccgugauggcgccgcggacccugguccuccugcugucgggcgcccucgcccugacgcagaccugggccgacauccagaugacccagagcccgucgagccugagcgccagcgugggcgaccgggucacgaucaccugccgcgcgagccaggacgugaacaccgccguggccugguaccagcagaagcccgggaaggcccccaagcuccugaucuacucggcgagcuuccuguacagcggcguccccagccgguucagcgggucgcgcagcggcaccgacuucacgcucaccaucagcagccugcagccggaggacuucgccaccuacuacugccagcagcacuacaccacgccccccaccuucgggcagggcaccaagguggagaucaagcggaccguggccgcccccagcgucuucaucuucccgcccagcgacgagcagcugaagucgggcacggccagcguggugugccuccugaacaacuucuacccccgcgaggcgaagguccaguggaagguggacaacgcccugcagagcgggaacagccaggagagcgugaccgagcaggacucgaaggacagcaccuacagccucagcagcacccugacgcugagcaaggccgacuacgagaagcacaaggucuacgccugcgaggugacccaccaggggcucucgagccccgugaccaagagcuucaaccggggcgagugcugauaauaggcugccuucugcggggcuugccuucuggccaugcccuucuucucucccuugcaccuguaccucuuggucuuugaauaaagccugaguaggaag
